United States Patent 12,576,115 (BACTERIAL COMPOSITIONS FOR TREATING AND PREVENTING HALITOSIS) - sequence listing, part 22

SEQ ID NO: 31 - DNA, 2445733 bp, Weissella cibaria
  source 1..2445733: mol_type = genomic DNA
cattcccacgcacgatgaaccgtttgtggccataagctaaaaataaacctaaaaaaccggtacaataactgtatcggttttttaatcacagatattactgcataaaacgcgaagggagaccgttaatgacatcagaactaaattggacggcctacctaaaagctggccagacaacaattagtaactatctattacagcattatcgcgaccttggaatgactaacgatgaatttttagttttcgtacaaaccaaagccggtatcgatcatggcgaattagaacccagtacaacaaaaattggcgaagcgcttggctgggaaccgcaacttgtatttgggcacctggaatcattacgtgcaaaaggcttggttaaattcgtgagcgttcgcgacggtagcgggcgagtgacaacccaacttgattttgaacctttgtatacacaattaatgcgtattacaggcggggcaaagcaagcagccgcgcaacgagttgaaactcaaggtgaaccagcccaaaccaaagatgatttgagccgtgcaacgatttacaacctgattgaacaagaatttggccgaccattaagtcaaatggaaatggaaacggttaaaaactggtttgatgttgatcatttccagcccgaattcatcaaagcagccgtgcaggaagctgttttgaatgcagccttaaacttgcgttatatcgaaaccattttggtcgcttggcaaaaaaagaactaccattcagttaaagaggttcgccaagaacgacaaaaacgatcacaattcaaacagctaaatcaagaagaacgcgtcaacattccaactgatgttgatattctcaacactgattggtcgcaatttaagtaacagaaaagccctttggaaatattccaaagggctttttcattatcttgaactttctcgcgtcgcaggtgcgctactgcttgaagcaggctgcgttgatgacgcacttgaacttggggcattcgaactgctacttgcgggttgtgattcgctgtgagaagcacttgattcaacttgtgaagatgaggtgcttcgttcttcggcacttgattcactcgaagaagtaggggtttcgcttgctggttgctctgtagagctttcaactggtgcaaccgattgttgaacagtttgttgttcacgttggacagttggcgtgcgcgttgttgaaacagcgcctgtaccaccaattgtcttttcgttggccacatcagcaccgactacttggtattccttgataccattgaccgttacttgacggacagtatccggcatcgtccaatcagaaccatcatcgccacccgacataacataatccatcaaggctttgtaagcgtgaagggcgacgtattgttcttcaccctcagctagatagtgacccggttcgtttggcctgtcgtatccagtccaaactgaaattgaggctgacttagtaaaaccagtaaaccatgtatcgtgagcagcaccatcaggaacatcagcgccatcttcataaccaacaacaccagttttaccagcttggctataggcattcgtgttgatcatcttggcatatgagtcggtaataactgacttcatcatgtttgttaacatgaaggctgttgaggacttcatcgctgttgatccctcagccttgtagtctttcacaacaccactttgttcagtgatcttcgaaatgtattgtggcttataataagtaccaccattggcaaacgcagcataggcagcagcttcttgttcagttgaaacattaataccgatggcacttgaaccaaccatttcgttagctgggatatcaatacccagtttcttcaaaaattctagcgatttcgtgtaaccgacctcttgcaaggtacggatagctgggaggttacgagattgtgccaatgcattacgcatggtcatcgaacccataaacttgtgatcccagtcgtttggttgaatatttgtaccagggtaggtgtacggtgtgtccaaaactaagtgattagttgaccaacctaggttttcaactgcgggaccatagtcaacaatgggctttgcagttgaccctgaagaacgaactgtgtttgtggcacggtttgtcccctgcaaggtagtcaaattacggccaccaagttgcgcaataactttaccattattcggatcagttactgtcataccgacttgcatatcatcgtctttccagttgacatagtcggctgtgttaccaatggcatacgcgcgatcttgtactttctggttcaaattcgtttgaactgtcaaaccatctttgttcacgtcgtagccgagtttcttaatttcggccaacgttgacatgatgtacgcatcatcaacctttgcttcttcatcttgagttgaactagaagggtgggtcgtcatcaaaccatcagtcacaggcaatgccatatacttcttggcttgagcttgcgtaatcacgttgttttgcgccattgcttccaagacttcatcacgacgtgccttggcaccctttggattgacgtaagggtcataaccagaaggggattgtggtaatccagccaacaaggccatttgtggcgttgataagttctttaaatccttaccgaaatagtattcagcggcagttttcataccgtaaacaccgttacccatgtaaaccttgttcatataaagcgtcaaaatttgattttttgaatattctttttctagcttcagcgctaaccaagcttcttgggccttacgtttaatcgtttgatcacttgcagccgttgagaaagcggtcaatttaatcaattgttgcgttaatgttgaaccaccttgtaggccaagtgatgacccagtaaagttggcaaatgctgctcctaaaatacggcggggatccaccccgtggtgcttatagaagcgtcggtcttcaattgaaaccaccgccatgcgcatttctttgggaatctctgattgcttagccatctcacgcttgctacctgttgtgtagaaaacgttaccgtctgcatcaagcagttgcgtctgagatgtgccgactaaggcagagttggtgatttttggagcagatgaagcgtagtaagcgaatacgcctgcgccacctaatgcaccaacgacgcccaatgttgcgagcgttaagatagtatattttgcatatcgcttggcctttgaactatttttcttaggctgtttgcgggatgtctgagcattacgctgcacacgggacatctcttctgtcataacgaaagttctccttacttagttacgttgattaagcagttcatcgacagcgacaaggtaaggggtcgtggggttaatgcccaacggcacctgcgcaccttgcgcgacaatgacatcatatggtattgatttacgcgccgtctcttgcgcgtcccagtagtcaaataacagctgggcccaaattacgtacgtctcacgcaatgttgtaaatcgaataatcataaaggccaggccttctgaagcgaccacctgctttaaatgcttaatctgatgttcatggacgtttttcaatggaaaagagcgtttgttagttgtttcttttgcatcgaaatcaatataacggccgtgataaacaccattataatcagttgttgaagcctggcgaaagtaagcttcagtaatcttggcagccgaacgagcggggtagctcacgtttacgatttgaatcggcgtcggtttcttatgaataaccgcctgaccggaaactaaataaaactgattagcatcatttaaatcaccttcaagcgacataccacgattactttgcgaacttgattttgccaccggcttcgcaaacgcacttgcatcaaagcggcgtccatttggataattaaaagccatttcgtactcctgcgtcttaaggtatccttagtattataccaaaacaaacaagatactaacaataggactaaaacgaaacataaatatatggaggtacaccatggatcgcatttggatgactggcttccgcagttatgagctaggggtaaatggggccaaagaccctaagctagctgtgattaaattcgcgattgagcggttattacggacaagtattgaagatggggcagactggctgattacaggcggtcaaatgggcattgaacaatgggctattgaagttgcacttgacctacaagcgacggattatcccgagtttcaaattgcattaatgaccccgtttgccaaattcggcgcgcaatggaatgaaaacaaccaagaaaagttgaaccagctaaaaagtcgcgtcaattttagtagcactgttcaccaaggtgattttggtggacgggcacaaatgcaggcttatcagcggttcatgttgacccacactgataaaggtattattttcttcgacgaagaagcaactgaatcaaaagcccgttatgatgacaccgccatgcgcgaatatgctgaaaactttgattatccggttacccgcattgatttagatcggttacaagactatgcaactgaatatcaagacttgcaatgggataactgataagttgttaagaaatcttcataaactggttttgtcatgacgcctaaaaactggtaaactagatttatgaactaaacggaggagtccaagtgatggaaaatgttctacacaaccgcgaagaaatcctgaataaggaatttaagaagacacgtatcggtgccggatacgacatgacagatgttgatgcctttttggacgaaattatgacggattaccaagcgttccaaaacaacattaatgagttgtcgacgcaaaacgacaagttaaaggcacaagttgcagaactaacgaaacaagttagcgcttcagctacggcacctaaggctacaccagctgcgccaacggcaaacacgaacatggatatcttgaagcgtttgtctaatttggaacgtcgcgtctttggtacaccaacggaaccagctgcacctctttcaacttctgttgaagaaaaggctacacaatcggccgaataggtgtataataagtaaatgcgatgtgttagtgggtaattgcgtgtggcttatgtcgcatgaggaaagtccatgctcgcactgactgtgatgtcagtagtgttcgtgctagctgaaaaaataaggctaggcagccgatgcaatcggttgacggccaacgaaaaacctacgggtaactatggtttagtagttgtgaaagtgccacagtgacgaaccgtcaaagaaatgcgacgggtggaacgcggtaaacccctcgagcgggcaacccaaactttggtaggggcgcttgacctagcgaattgaagtgatggtcggggagacagaaatgtctgagatagatgattgccaccggttatagaccgccaatctgtaatcggtacaaaacatggcttatagctgacacatcaggcagccgacgtcctcgtggcgtcggctttctttttgcactaaaaccctcattttgggggatacatacaagaaaatgcaggtgaaaaatatgcaaaattttaaattgatggccacgatgggcgctggacttgaagcgcttgttgcacgtgaattaaaggacatgggctacgcgacccaaaccgaaaatggacgtgttttcttccaaggaacaatggaagacatctatcgtaccaacctttggttacgtgtcgctgatcgtatcaagatcgtcgtaacagaattcgatgccaagacatttgatcaactatttgaaaaaacaaaggctttcccttgggaagatttgttgccgtatgatgcagaattcccagtaaatggacgttcgaagaactcaatcttgcactcagtgccaacggtccaagcgattacaaagaaagccattgttaaccgtttgactgacgcctatcacgcccgcgggtacttacctgaaactggtaaccgatttgtgttagaaacggcagttgataaggatcacgtcatgatcactttggatacgacaggggattctttgtttaagcgaggttaccgtactgaaaagggtggtgcaccacttaaggaaactatggcagctgccttggtgaatttagcacactggttcactgataacccattcgttgacccaacaactgggtcaggaacgattgcaatcgaggcggctttgattgggcgtaacatcgcgcctggactaaaccgtgagtttgatatcacatcatgggactggtttgataaaaaaattggtgaaaccttgaaagcccaagcacgtcagttgattgacttcgaggtcgaattagacatcactggttatgatattgacgaaaacatgatcgaaatcgcaaaggctaacgccgaagcggctggtgttggcgatgatattgttttcaagcaattagctgctaaagactggtcaactgataagattaacggtgtccttgtggcaaatccaccatatggagaacgtttgggtgacgaagacgccgcccgtcagttgtacagtgagatggggcacatctacaaccacatgcctacctggtcaaagtacattttgacatcagacgaaggtttcgaagaagcattcggtgcgaaggcaaccaagaagcgtaagttgtataacggtgccttgaaggttgatttgtaccaatactggggtaagaagattcgctaatcgtgcgtcatgcacaatttgaaaggggagacaacacatgagttcactacttgatggcatgaatgacaaacaggctgaggcggttatgacaacggaaggtccgttgcttatcatggccggcgccggttctggtaagacacgcgtgttgactcaccgcgtcgcccacctgattaaagacttaaacgtgatgccttggcggattttggccattacatttacaaacaaagcggcccgtgaaatgaaggaacgtatcggtcaactggttgacgccgaagatgcagatgcagtctgggtgtcaactttccacgccttagctgtgcgaattttgcgtcgtgatatcgacaaactcggctacaaaaaagatttttcaatcatcgatgccggtgcgcagcgaacgcttgtaaagcgcatcctaaaagatttgaacgtggatattgaaaagtatgatccccgttctgtgctaggggctatttccaacgcaaaaaacgccatggaaaatcctgcttcctacactgagaaagccaacgggccattcgaagaaattgtggcgaaagcttacactgaatatcagcaccaacttacgattgcacaatctgtcgactttgatgatttgattatgttaacgattgaattgttgcatcaagagccggaggtgcttgaattctatcaagaaaaattcttatacgtgcacgtcgatgagtatcaggacaccaacgacgcgcaatatgaattagttacactattatcagcaaaacaccgtaacctggctgttgtgggagactctgatcagtctatctatggttggcgtggggctaacatgcaaatcatcttgaattttaataaagattacaaagatgctaagaccgttatgttggagcaaaactaccgttcaacgcaaaccattttggatgctgccaatgcggttatcgaacataataacgaacgcatcgctaagaatctgtggactgacaatggtatgggcgacaaaatcacttattaccgtggacaatctgataaagatgaggcgttgtatgttatcgcccaaattcgtgacggtgtacaaaatcaggaacggaattatcgcgactttgccgtgttatatcgtacgaatgcccagtcacgtggtattgaagaagctttggtgaaggccaacatgccttatacgatggtaggtggttcaaagttctatgagcgtaaggaaatccgtgatgttcttgcctatttggctttagtgaccaatcccgctgataatgaaagctttttgcgcgtggttaatgagcctaaacgcggtattggtaacacctcaatcgaaaagttacgtgcctttgccttacagaatgattggccattattagatgccgccacgaatgcggtgatgattccaggattaacaactcgtgccgctaatcaactgacgcaattcgctgaattaattagcacgctccgccaacagacaacattcgacctaagtattacggatttgacacgtcaaattttggatcgtacgggctatgaagaacaattcaaggcctcaccaacacccgaaaaccaaggtcgattggaaaacttggcagaattcctatcagtaactgaagaatttgataagaagtacgaaccaacggaagaaagcatctctaagtatgtggacttcttaggcgaattggcccttgtatctgaccttgatagcgtggacgaggacacagataaccaagtcactttgatgacgttacacgctgctaaaggattggaattccctgtggtcttcttggttgggatggaggaaaaccttttcccactatcccgcgcagctgctgacgatgcccaactagaggaagaacgtcgattggcatatgttggcattacgcgtgccaaagagaagctctttatcactaacgcgtactctcgattgctgtatggtcggacgacaagtaacatcccatcacgattcatcgatgaaattagccctgagctgattatgcagccagccggtcaacaattgtccgctactgcaaatcgtgatggtgcattaccatttgcacgccgaacgcaacaagcgacggcaaccacgtttgctggtcgacaacgccaagctgcacaaagtggcacgccattccgaactacttcgacagtcacgtcagcaacacctggtactggcgctgataaaaaggcctggacgattggtgatgcggttagtcataaaaagtggggtgtcggccacgttgttaaagtttcaggtactggcgaggaccaagaattagatattgctttccctgatcaagggattaaacgtttgcttgctgccttcgccccaattcaaaaggtggagtagcacttgcaggaggttatagaacaatggataactttcaagatatcgcaacgatgactgtcattgaagcgaaagcagaaattgacgcgctacagcaagatttgaagcaatgggcgcaagaatattacgaaaatgatgcgccatctgttgaagatgccgtctatgaccgtgaatacaatcgattggaagcactagaagcagcctatcccgagttagtcacaccagattcaatcacgcaacaagttggcggtaaggccactaaatctgacttgccaaaggtagttcacgacatcccaatgctgtcactaggtgatgtcttttcattggatgaattgtacgactggctggccacaacgcaaaaatcatttaacacgccccttagctacaatgctgagttgaaaattgatggccttgcgatcagtctagtttatgaaaatggtgaactgattcaagcatcaacgcgaggcgatggtaacatcggggaagatgttacagcaaatgtccgccaaatcaaacggattcctaaacaactaaacgaacccatctcagtcgaagttcgtggcgaagtgtacatgccgaaagcagcttttgtgacgttaaatgaacaacgcgaacgagacggcctgtcaacgtttgccaatccacgtaacgcagcggcgggctcactacgtcaattagatgtcaaggtgacgaagcaacgccaactggatgcctttttatatgcagcagttgacgccgaaaacacgcttggtgtcacgacgcaggctgacttattacaacgtttagctgagcttgggctaccagctaacccaacaaacgcagttgttgcttctgaagcggacattgcggcctacattaatgatgaaacagccacccgcgatgagttagcttatggcattgatggcattgtcatcaaagtcaattcgctagcttatcatgaggagttgggcaacactgttaaagtgccacgttgggcaattgcgtataaattcccgcctgaagaggctcacacagttgtacgtgacattgaatggaccgttggccgaaccggggcggttacgccaacagcggtgatggatcccgtccagttagcggggacaaccgtggcgcgtgcttcgttacacaacccagattatttgaacagtaaagatattcgaattggtgatactgtgactttgcacaaagcgggggacattattccggaaattggccaagtaattttgagtcaacgtccaacggatagtgaagtctatcaaatgcctttgggctgcccagcttgtggccaagaactggtacacattgatggtgaggtggccttgcgttgcattaatcctttctgccctgcacaagttcaagagtcattgacgcactttgcttctcgcgatgcgatgaatattgacggccttggaccaaagatcgttggacagttactctcacgtaatatgattagtcaggtttctgatttgtatcgcttgacatttgaacaattgctaaccttggacaagtttggtgaaacgtccgctaacaatctattgcgcgctatcgaaaattccaagcaaaattcagtcgaacgcctgttattcgggttaggtattcgtaacgtcggggcaaaagctgctaagaccattgctgcaaaattcgtgacattagatgccatagctcatgctagtgcagacgatatcgcagaattaccgggcatgggcttgatcatcggccacagcattgcgcagtatttcgatactgagcatgcgcaagaattagtcgctgattttgagcaactcggtgttaatacgcgttacacgcaagctgttgaaatcgcaacggatactgtcttttctgataagaaagttgttttaactggtaaactagcgctatttagccgttcagaagcaaccgcctggcttgaatcccaaggggcgactgtcagtggttccgtatctaaaaaaacagatttgttaattgccggtcctgacgctgggtcaaagttaaccaaagcacaagaattgggcatagagatttggtcagaagcgcaattgcgtgatagtatggataacaacaactaaaaatgaatatttgttgacgataagcactatttcgccaactaaaggagtaacacatgcgtgcattaaaatggattgccggtattctcggtgttgttgtgctagcagccgcgctcgtgttctttgggaatttcttttcaaagaactcatcaaacgtcgcgacaaaatctagcacaacgaagtctgcgaattcttcttcaaaaaaaggcattcaagtcactggtaaaacggatgattcatcatacaaaactgtcatcaaagacggtaagtatttaacaagtaaagcccgtggtattacggctggccaagaatcaaacaacttcaatatggtcagttttgaaagtggtctcttggacttttcaaaggaacacttcaatacatctaagtacgtgttccaagagggacaatatctctcagctacaacggcgacagagtggttggatcgtaaggcggccgataatccagatggattaaatccagaggataatggtaaaactgacgattcacgagcacctttctacctacagacacttgaagagcaagactttatgacgcaagatggtaacgacttgaaactcgctggcatcgttattggtatggcaatgaatacgcaagatgtctaccaaaaggaacagtggggcgcgaactttacgcaagacatttcaaaggcagaacgcattgcgcacggtaaagaaatggctgcagaagttgtcaagcgataccgtgccatgagcggtgttggcaatgatgtgccaatttatgtggcaatgtacgcccaagcacctgaggattcattatcaggtggtaatttctatagctggagtgttgctaactcgggcgataccttgggcaattggactgacttggatcgtcaaaccgttgttttgccaatgcaagatgggacaacatcagaaaagtccgttggtagcgctttgaatacaagctttaagaacttcacggataagctccaagggttcttcccaaacttgtcttcaatcactggacaagcttcctatgatggctcaaacttgaaagggttgaacgtcactgtctcaacgcagttctattcagcaacagaaattgaaagctttgctaactacattgctgaaacagcaccaagttatctaccaaatggcgtacctgtacaaattcgtatggaggcctcaactggtatgcaagcctacattatcaagggtgccaatgatagtaagtacactgttacaatccttggttcatactaaaacgtttaaccgacaatcccgtaaaatggattgtcggtttttacttgcattttactaagaatacccgtagtatagaaaaaatgaaattttgggggagtaagaatatgggaatgcatcaatacctatctggattaaatgaattggaaatgattacgcgtgcaccgggttacttcaagtaccaaccacattctgttgcagcccattcatggaaagtaactgaagctgcgcaatttttgggtgacatcgaagaacaggctggcaatgaaattgattggcgtatgttgtacgagaaggccttgaatcacgatattacggagcgcttcattggtgatattcgaacaccagttaaatacgcatctgcaactttacgtcaaatgttagcggatgttgaagattcattatcagacaacttcgtcaaaacagaaatcccaacggagctacaagcggtttacaagcgtcgccttcacgaaggtaaggacgatactttggagggacgtattctttccgtcgccgacaaggttgatttgttgtacgaagcatacggcgaactacagaagggtaaccctgagcctgtgttcctggaaatttacaaggaaagtctcgccactattttcgccttccgcgatatgccaagtgtggcttatttcatcaaggaggttttgccagagctattggcggaacaatttcctggatcagaacaactccaacgtatctacattggaatctttaattcaaaatagagaatttccggtataataatagtaagagacaaaaagccactgcattctcagtggctttttgattgttttaccaaccagtgataattaaccgtaatcattggtactatggagagagaatctatgagagtaagtcgcactttattgttcagcgcagtcgttgttgctgaacttgcggttggcctggcaagtcaacccactgtgatttctgctgcaccggcaacggcggaagaaatcaataataattatcaaactgttcgatcaacgaaagattcgttaggacacaaaatctttgcgcaacagcaaattgtggcgaaagacaatgcggatgtgtaccgtattttggccaaaaaatctgatggatcatttcaacaaattgcctctacaaacgataagcatgtgctgaaaaagttaacgcattatcgggcactgccgtacattcaaaatacggcagctttgacaccgcaacaagcgtcattaaagacccacacaaaattactttcatttgtgggcggacaattatcgaataatttgtcatttaaaacactgaagacgctaaaaaccacgttggtaactgctgatgcacaagtatcgattatggctcccatcaaaaagggccagtggacaacaacgctctactatcatattaaaagtgatgttggcgacgatggctatgttagtgcaaaagcagttaaacaattaactgaccccaatcaggcaagtagcacgtcgacaaataatactgccttaccgtttgataaaaagacggcattaaagaaaatgacggctgcaatcaacgcattgcgccaaaaaaatggcgaaaaaaaggtggtagtcaataataaattacggaaaatcgctcattaccgcgcacagcagcaagccaagatgggaacgctcgataaccacatgggcatgcagacggcctttgatcgcaatggtggtaacacttggtcgctatctggggaaaaccttcaaatgggggacacaactacatttgggacatccgcaattgattttggcaaaaatacagttgctaactggtacactgataatggggttgccaatttttctcaccgcaagctgatgttatcaccctacatgaaccaaattggggtcgctttaagtgaaaaagacggtaaaatctttatcgtaacggaatttggttcaactaaaaatattaatcaaactggaatcgatgcttggaatgattatttcaaatcaacccgcgagacagggacattcaatcgaccagcgcatgatctaaactaacaatacggaagcgaggggcaatatgataaatcgcgatgatagtcatgaatatgaggtcgtctcaaaatatgagccaaccggtgaccagccaacagcgatcgataagctagtaactggtcttaaaaacggggtaaaagagcaaattttgttaggtgccaccggaaccggaaaaacgtttactatttcgaatgtgattgcccaagctaataagcccgtcctcgtcttatcacacaataagacgctagctgggcagttatacggcgagtttaaagagtttttccccaacaacgcggttgagtactttgtctcttactatgactactatcagcccgaggcatacgtaccatcatctgatacgtatattgaaaaagactcttcaatcaacgatgaaatcgataagttgcgtaattctgcgacggcttccttactcgctcgaaacgacacgatcgttgtggcatcagtctcgtctatttttggattaggtagtcctgaacagtataatgaccacgttatcaacgtccgtgtgggtgacgtgattgaacgaaacgacctcatgcgtcgcctagttgatattcaattccaacgtaatgatattgacttccaacgtggtcgtttccgcgctcgtggtgatgttttggaagtctttccggcatcatctgatgcgaaggcgttgcgcattgaattctttggcgatgaggtggaccgaattcgtgaagttgattcccttactggggaagtaacggctgacctagatttggccaccattttcccagctactcactttatgaccaatgatgccattcgtgatcgggcgctaaagacaatccaagcggaattagatgcccagctaaaagtctttgaagaggaaggtaagctgttagaagcgcaacgcctgaagcaacgtactgaatatgatattgagatgattcgcgaaatgggcttcaccagcggtatcgaaaattattcacgccacatggatgggcgggcaccgggggaaccgccattcacgttactcgactttttcccagatgatttcttgattgttgtggatgagtctcacgtgactatgccccaagtacgtggtatgtataagggtgaccgcgcccgtaaggaaactttgattgactttggtttccgactaccatcggctttggataatcgaccactacgtttagaagaatttgaagaacacgttaatcaaattatctacatgtcagcgacacctggtgattatgaagaagcacgggttagtcatgatgatgttgcacaacaaatcattcgtccaacaggactgcttgatccggaaattgaagttcggccggttatgggacaaattgatgacttgttgggtgaaattaacgagcacactgccaaagatgaacgtgtgttcgtaacgacgcttaccaaaaaaatggctgaggatttaaccgattatcttgaagatgtcggggttaaggttaagtacttgcactctgatattaaaacgcttgagcgtactgagattattcgtgatttacgactcggtaaatttgatgttttagtaggtattaacttgcttcgtgaaggaattgacgtaccggaagtgtctctggttgcgattttagatgccgacaaggaaggctttttacgtaatactcgctcactaattcaaacgattggtcgtgcggcccgtaatgaaaacggtcacgttattatgtacgccgataacataaccgggtcaatgcaagccgcgatggaagaaaccgcccgacgccgtacgatccaaatgtcgtacaatcaagagcacgatattacacctcataccatcaaaaaagaaattcgtggccttatttccgttagtcatgatacgacggagaccaacgagtcaactagctttactgaagttgcctttaaggacatggctcgtccagatcaagaagcaatgatcgctaatttggaagaccaaatgcgcgcagctgccaagcgattggactttgaagaggccgccagcttacgcgatgctgtcatggaacttaaactacaacttggtgtctgacggcattgcacactatgttataatgattattggtatttctgttgtaaatacagaaaaatatagattgctaggggattatcatggattttagtctagctgatattcaggcgttaatgcgtgatttcgagaatagttcattgcgtgaattcaaactcgatacagatgacacccatttatacttgaacaaaaatgaagcacaaacgacacccgtgtatcaagcaacaacggttgatacaccagttactgttgatgaaacactaacaatcacggccccattggttgggacattgtatttagcctcgaaaccaggtgttgcaaacttcaagcaagtgggtgatccagtttcgattggtgaaacggtggcaattatcgaatcgatgaagttaatgactgaggtacacagtgaggtagccgggactattgtggctattaacgctgaaaatgaagcggtcgttggttatgacgacgttttgtttactgtacaaccgaattaattcatgagaaagagaggccggaacgttgttccagcctcttttacgttaatggagtttaaaaataatgtacaaaaaagtattagttgctaatcgtggtgaaattgcagtccgtatcattcgggctttgcatgagttgaatatcaaagcagtggcaatttatagcactgcagacaaagaagctttgcacgtacaactagccgatgaggcaattggcgttggcggacctaagccgcaagattcgtacttaaaccggcaaaacattgtcagtgcggccttattgaccggtgctgaagccgtccacccaggctatggcttcttatctgaaaatgccatgtttgtgaacatgttacatgacgttggcattgattttatcgggcctcgagctgagaccatcgacttgatgggggataaagcggcggcacgagaaaccatgcgggcggcgggcattcccgtcataccgggaagcatcggtacattagcaacgagtcaagaagctgctgaaattagtgctgaaattggttatccagtcatgcttaaagcagctgctggtggtggtggtaaaggtatgcgtttcattcccgacgccacaactttagttgaacaattcgatcgcgcccaagctgaagcagtacgtgcttttggatccggtgagatgtatgttgaaaaagtgatgacagacgttcgccacatcgaagttcaaatcatgcgcgatgcaacgggacagaccgtttattttccggaacgtgattgctctattcaacgtaatcaccaaaaaatgattgaaatgtctcctgcagttggtatcacaagtgagattcgcgaaaatctaggccaactggcagtaaaggccgcgaacgctttaaactacgttaataccggtacctttgaatttcttgctgaccgggataatcatttttattttatggaaatgaatacccgtatccaggttgagcatccagtcaccgaagccgtgacagggttagacctcgtcaagatgcaaattcttgtggctgcaggtgaaccattgcccgttgcccaacaggatatccaggttaaacagcacgcagtggaagtccggttaaatgccgaaaacccccacaaaaactttcaaccgagcgctggacaaatttcatttagttatttaccgtttggtggccctggtgtgcgttttgattcagccatctatactggcgaagaaatcgcgccctattatgattcaatgattggtaaagtgattgtatctgccaatagtcgtgacgaggtcttcacaaagttatctcgtacgttggacgaggtggtcattcacggtattgctactaatctctcaattcaacgggatttggtacataaccaggccgtacagcaaggtatcatcccaattgattttgtcgaaacgacatttttgccggcttggtcagtagaggagattcaggaaccatgacgcaattatttgaaaataacccggataagtttaaacacacagcacccgcggatgcccggactcgtggccagaagggtgactgggtaacttgtgctttttgtggggcacaacagtacaaagaggaacttggtgagttcttggtatgcggtgtttgtggctatgggttccgcttaggcgcggcccaacgcgccaacatgatgaccgacagttttactgaatggcacgctgatatcgaaatgacaacacctgatttccctggctatgccgaaaagttaacgcgcgctcaggctgcgactggcctaaaagaggctgttttgactggtgaagctgtcattgaacaccaacggactgcgctagccattatggacgctgggttcatgatgggttcattaggtgctaaaactggtgccaagttagtggccctatttgatgatgcgacggcaaacggcttgccagttatccttttttctgcatctggcggtgcgcgtatgcaggaaggcattcgaagcctgatgcaattagcaaacgtttctgcggcgattgcacgacatcgcgaagctggtttggtatacattgtcgtcttaactgatccaaccatgggtggggtcacagcttccttcgctatgcaaggtgacatcatcttgtctgagccacatgccttagtcgggtttgctggtcgccgagttatcgaacaaacaatccatgagacactgcccaaggatttccaacgcgctgaacatatgcaagccagcggcttcattgatgcgattgttgcgcgacctgagttgcaacattaccttggtcagctcttgcgcgtacaccaagcacccaaggaggatgctcatgtctgaaaaaacgccgattgacattgttcgggcttcccgtgaagaccgttttctggctcgtgatatcattgctggcttgataacggattttcaagaattacatggtgaccgcgcccaaggcgatgacccagcaatcattggcggcgttgggttactgggtgaacaaccagttacagttattgccatcaatcgtggggctgaaatcgctgagaaattacaaacgcgtaacggatcacctgaagcgagtggttatcgaaaagcgttgcgcttgatgcaacaagccgatcgattcaaccgaccaatcatcacctttatcaatacgccgggggctttccctggcaagactgctgaagaaggcggggttggtcaagcaattgccgagagtatcttacaaagcatgtcttttaaggtgccaatgattgctgttatttacggagaaggcgggtcagggggagcgctagcactagcgacgtctaaccgcgtgtggatgtttgaacacgccatctacgccatgctgtcgccagaaggttttgcatcgattttgtttaaagacgccaaaagagcggatgaagccgccgcattactggggttaaccccacaggaactgttaacagctcacgttgtggatcgcgttattccagaaatggataatcatactgccttttacgaacaacttcgattagatttaaaaaatgaaatagccgacttacaaaaactatcaacaacagaactgattgcacaacgtcaacaacgctttgcacaattttcataaataaaaaggacctcaaatgaggtcctttttatttataatttattactccgacagaccgatttgaagtgccttaatccgcttagaagcaatccaaagcaagaaaccagccacaatcgtaataccaccaataatcaagaagtaattaatttctgttgattttgagtacaactgaactaactgggcattcgcagcttgcgcggttgcatcagatagattccaaacagttagcatttgtgcctggaatgccactggcgccatctttgctgacgctgataggccaactggcgagatgagcatttcaccaacttcaaccaaggcccacgaggcaatcaaccacagtgcgttgaagtggtggttaacgccatacagcatgcctggaaaggccatccaaacaaatgatagcccagcaaaaacaagccctagtgagaatttaacgcccgttgatggttgcttatcacgtagctttttagaccatagccacacaaagaatggtgtaaacaacataatgaacaagggatttaatgactggaaccaagatgctggtgcaccgtgcaaggccgtttgatcagatgcaaacaacgccaagacaacagatccttgttcttcgattgaccagaagagcatcgcggcaataaagaggggaatgtatgcccaaacgcgcttgcgctccgctttggtcgtcttatcagaagttaacatcaccacaaagtaaataactggcaccaaaattgccacgaacgtcagcaaattgataacgttgttaatatttaatgcctgcatcatagccatcacgccaatgattacagcgaatacgacgataattccaacaattttacaaatcaacggcatgatttcttctggttgcaaaggagaaggggcttggtgcgctgtgtccttcaaatgtttgcgtccatcaaggctgtattggataaggccgaaaaacatcccaatcgctgctaatgagaacgcaacgtgaaaattaacatgcacttggaaccaaccaaccaaaagtggcgcgacaaacgcacccagattgataccaaacacatagatagaaaagccggcatcacgacgctcatccccaggctgatacaagttaccaaccatcgtggccacgttcggcttcaatagacccgttcctaaaataattaaagcaattgatagaaataatcccagcttagctaatggaatcgccaaggaaatgtgcccgaacataatcaagacaccaccgtagaagaccgttcgccaaggcccaagtactcggtcagacaaataaccaccaataatacccgacagataaaccaatgacccatagattgacatgatggcggcacccgttgcttgaccaaaacctaggccgcctttatcaactgcataaatcatgtaaaatagcaaaatggcacgcataccataatatgaaaaacgctcccacatttcggtgaagaacaaggtcatcaggcctcgaggttggccgaagaaggaggtatcacgtttctgttccatcagaaaaaacctcactcttaacagttactcattgtactgaattaatattcgtaaatttgacaatgcacttattttacgccgatttttcatagaatgcaatttttcttaatatatctcacattaaacagaaaaaagcgcctttgttaactgacaaagacgcttttaatattctcattatgacatcactgcattcgctggcgtaaccgtggctgctggcattggcaaaatttctgatgcggcttcacgatccaaaagcaacgtgaagttggggtgagtttgcaagatagacgctgggacgtcttcactgattgggccaaagaaagcttccttgataatattcgccttcttcttgccaaacgcgatcatcacgatttccttggcgctcatgattgtcttaggtcccattgacacgtaaccggcaggaactttctcttcagaaccaacagaatgaaccaatgcggcgtaaacttgatcatttgcttcagaaggaatataacgtgtcccgtcttcaaacttggtcacaccaggcaggttacctgcgtaacgaccatctgacccaataccgagaagcataaagtccaacccgtttgcttgtgccaaacgcttatccaaggtatcccagtttgacaaatccaaacggtggtacaagtaagcgggcatttccgctggattcaaaaagtacttacgtaacgttgaagttgtcataccttcttctgaatcttcttgtggcacttcatcaaagttccacaagtgaagcttaggcatgttgggatcgtgaatacgttccgtaaacttttccaagcattgctcgtaagaagcgacaggtgaggtaccagccgtcaaggcaatgttacgtacctttggatcataaattttttgtagtaggatgtgagacgtttcgtttgttacatcttgctttgtatcaacaatttcaattcgcatatttattctttctcctgacttttgtttcacttaacacttacaagtgtagtgggagaatttgactaatttttgaagggtacgcaaagaatattagtgagtggtctagtattggtccaagcaaaaagcgctatcgaccatcgataacgctttcaccattatttcttctttttaagcgaggctagttctgtctgaatgcgagcttgtgcttctgcaattcggtccaaacgaggttggttcttaaaattcattttttctacttgaatttgtaagtcttttgcaaaggcttggacctcaggtacagcctgttgcacattcgccacagcttcctttagttgcttcgtaccagcagttgttcgcttaacggccgcaacccaggtcatgacgtgttgcttttgtgtttcaaaaaaagcttttgcttgatccataggttagtcctccatgtgacttgcaattcggtcagccaatgcacgatagtcgtcttctgtcgttgtttcactgtggtcaggcattggcacatcaaaagtatcgtctgcgtaacgcggaattaaatggaagtgggagtggaacactgactggcctgcggcttcaccattatttgacaaaatattcagtccaataattttgtcatcgctggccttaattgcacgggcaattttaggtagctttgacaaaacacgcgccgctaactcttcatcgtattcaaaaatatctgcgacgtgtgtctttggcaccatcaaagtatgaccaggcgtaacttgactcaaatctaaaaatgccaacacatcatcatcttcatataccttataagcggggatatcgcccgcgataatcatatcaaatacatctgccatgagaatgcctccaagttttatatattacttctattataacgtgctttgcgctgtgtgtccgggcgtaaatattagggattatttggtaaaatagaaatagacgaaaaaacggaagtgaaaatatgacattatcagttaaaaatctttcgggtggttatggtcaattggctgtactacacgatatttcattcgatattcaggccggcgaattactagcgttggttggattgaacggttcaggaaagtcgacgaccattaatcacatcattggtttattggcgcccaagcaagggcagattaccctaaatggggtaacgctccaagctgatcccgtcaactataaatctcaaattgcctacattccagaacaaccagttttgtacgccgaattaacacttcgtgagcacctcgcattaacgattgatgtatatggattaaatgaagaaactgcttggcaacgtgcaacaagtctcttgcacacgttccgcctggataacaagctggactggtttccaacccatttctcgaagggtatgcgacaaaaagtaatgattgtcatggcttttatcacggatgccccattttttattattgacgaaccatttctggggcttgatgtgattgccgttaacgatttgttgaccctaattgacgcgcgcaaagcgaccggtacgagcttcttgctaacaacgcacgtgttaacgaccattgaaaaccacgctgatcaattcatttatttgcgtgatgggcaggttgccgcgcagggagccgcgcaagacttcgcaacattagtgccggatatgcaacccaacgaggtaaactgatggataagcggcacttatttcaacaacgatggacacaacaatggcgtctcttcagtaagtacttacgatacgtgtttaacgaccacgctgtcttggcgttatttttcttattaggtgcagctggccttgcataccgcaacctttggcaacatgcgccgattacgctgggaacaaaagccttgctgttaattatcctagtcatcactttggtcatcttcaaaacaccggctaattttttaaaaccggctgatcctgtgttcttaatgggtgatgaaaccgcgttgcgacgtttgttcagaacagctacgctatacagtgcagtcattaacggtgtgatgcaatttatcatgacacttcttttgtggccgatgatgtttcgcctgctgacgccgtacttgagtgtggtcattttagtaacacttgtcctggtgataactaaaatcatcctgacaatcaccgcagctaaacgtatcgcaatgtatcgacaagccgaagcaggtgacatgattgattggcgtgcattaattgcgaatgaggaaaaaaggcagaatagcatcctagcttttttcaacttatttattgatgtacccggtcagcgaccaagtatcaagcgacatcgttgggcggatcgattcattcacaattggcctggtcatcgacagaatccactcgttaaactaatggtgacaactttcgttcggcagagccaatttgcaggggtctgggtgcgcttaactgccatcggtatcgtagccggtctggttacgacagggtggctacaaacagctctctacgcgattttaatgtacttgattgtgttgcaggtattacctttagtcgcgagccatcaacaactcgtttttgaccatttattccctgttacaattggccaacgtcagcaagcgttccgctttgccataacaccttggttagtcttaaccattatgatttggtcgctggtgggattcgcaacgacgccttctgtcacacttctattacaaaatgtcataggacttgtcgtagtaggcggtattttggtattctggtatacgaatcgcagaattgcaaacacgtttagaaggagaaattcacgtgcgtttacgaaataaaaagtggacaagcccttggttggcagaacacacggacttagttattactcaggaccgtgcaaccggcctacaaggcaactggcaaagcatcttcgaaaaggtgcaaccattgcacgtcgagattgggactggtaagggacaatttattattggcatggccaagaaataccctgaaattaactttatcggcatggagattcaagagggggcggttgcagtcgccgcacgtaaggccgatgaagacccagctgacttacctaatttgaaattcatttatggtgatggtgctggcgttgagacgtactttacaaagggtgaagtatctaaactcttcttgaacttttctgatccatggccaaagagtcgtcacgagacacgtcgtttgacgtacaagtcatttttggccggttaccaagcggtattgccagcgggtggagaactagagtttaaaaccgacaaccgtagcctgtttgagtattcattgtattcattcgctgactacggcatggtcttctacaaggacggcatttcactgaacttgcacgaggacgaggaaaaaatgcaggataacgttgagacagagtacgagcaaaagttcgcttctcaaggattcccaatttacaaatttactggttctttcaagtaatacaaaaaagacgactaatcaacatgattagtcgtcttttttgttagggttgcaatgtgccgggattttccgtcattaccgtaatcacaacggtctgcttatttgcttcccattgtgcctcggcacctgtgccaagctgttgctgcgtttgttgggctagaaaacctgcttccaacgcgaaacttgcatgattattttcatcaaagcgggcactgaccacagggccatctaaccgccatacttgttccgttggtttctttgacgtcaaggttaagaatccaaaaccagcatccatgaaaaacgtttcgagtgccatgacacctgttaagtcaacatcacgggcaagggccttaccagcccaataaataatttctgattcatcatcttgcaacaattctggtagcaagcggtcacgcaatagcgttaatgcgaataaattcatttctgtcgtttgtcctgattccgacataacgcactccttttattacagtttcataaactaattatagtgtattctagccatatttgccaataatttacattagtgttacaataaaattcttgaaaggatggattgtggcatgactttacctgataatccgttaataaatagcacgttgggattaatcaatggtgacctttttgcacaaaaaatcatcatgggcgacagttcacaatggagtagcgattcatcgctaacgttagcaactatcgatagcttatctaacggctacattttaaccgacatcatgacccagtttacatactggtatacaactggcgcttatacagcggatggcgcaccccagcatgctggcgacgtgacccgtatggccattgaaaatttccgtcaaacccaagatccatttacgtcgggtgggcgagatgagagtgataacgcgaatggtgcattacttcgaattacgcccgtcgtgttatacctacaagcaacgtacggggaagatttcattaaagatgaccctgctatgttaacgttgcatcaagtgggtggcttgacacacaaccacccacgttcattaattgcgattggcttatacgccatgttactaaacggcttattgagtggtatgagtttaccagcggcctttgacttcgcaattagtaattcatatgaatattacgcaaaacatgcggtcttcgctgatgagttggtcgcttttgaagcattaaacacaccggattttgaaaatatgccaatcgagtctttgcatgcctcgggttatgtcgtcgacacattagctgcgacgatatgggtgttattaaacagccaaaactacgaggacgcgttaacactcgctgccggcttaccgggtgaaccaacccgaattatgccgttagttggtgcggttgccggcttgatgtatcatcaagcgcaattgccgacaacgtggctcaatgcacatgaattaacgattgttacgcgagtgcttgaaaaagcagagcaaagcggtcgctttgcttgccccgacacgcacccagtcgaataggtgattaaaccagagcctgatttcggactctggttttcttgtttagaaaggaacactttataatggcaattatgtggcacagtatatccggtgttttaatgattcttggtttagtaggcaccggatacgccctactaaaaatgcatattttcaacgatgatgatgagcgcttaagtaagtttttatctggatttgtcactaaaattgccatacctgcttatttgatcgttagtattccggaagactttacaccacaaaccctactagcaatcgggccgaaattagtcttaccgattactagtatgttagcgttatttgctctgtcatttttaatcgcgaaattaatcaaggtaaatccacaccataagggattattccaatcattgttattcaattcaaataccgtcacggtgggattaccggttaacatggcattattcggtaaagacagtttgccatacgttttggtctactatatggctaataccatcgtcttttggacattgggcgtatatatgattgaacgtgacacggcaaccggtcggcaattcagtctccgcaaaaccctgaagggaatttttacgccgccgatgattgccctaatcatcgccgtgattttagtcctggcacgcattgaattgccaacctttattcggaccgatttaactgatctgggtaatacaaacgttccgttatcactaattttcattggcttttccatcgctaaagctcaaaaaaccgacttaatccctgatcgcgaaaatttgacacttgccttaggccgttttgtcctggcacctagtgtcatggccttaatgatgatgccctttgagctacctaaattacttaaagcagtctttatcattcaatccgctatgccaacaatgacaaatgcagctgtcatggcgcgcgaattaaacggggattttagatttgcgtctatttcaatcacacaaacaaccttattgatgttagtcgttattccaattttaatgattttagtcagttaaacaaaagaaacgccctgtctcaagcacgagacagggcgtttcttttagataaacatattcaaaatcaagacaataatcaaaccaaccaccgcaatcaacgattctaggaccgtccaaattttaagtgtctgcttaacgtcgaggtcaaagtactctttaaacatccagaagccagcatcgttaacgtgtgacgctgcaagagaaccggcaccaataactaagaccatcagggccggatcaacaccagcttgatgcatcaacggttggaccaagccagcagcagtaagggcagcaaccgtagctgagccaagagccacacgtaggataaccgtaatcacccaagctagaatcaatggcgagatgttaacgtgagcgaagagggtcgctacttgatctgaaataccaccatcaatcaagatttgcttgaaagcggcaccaccaccaataatcaacaacaacatggcaattgacttaactgactcttcaatcgtggcagccatttctttaaccgtcttatgttgatgccatcccattgaccacagtgcaaatagcagggaaataatcatcgcaccaactggattaccaatcattgtcacaaacgcatccaagcctttaacttttgcagcgttaaatggttgcccatcattcacaatgattgagtagatggtcgtaattcccatcaaaataactgggaacaatgatgttaacaacgatagtccaaatgagggcgtttgctttaaatcaaactgcttcacttcaccaaacgccgtcaattcacgcttcactgtgaaagcttctggtgcataggttttcgccaatttcgcgaaaaccggtccggcaataatcgcagccggaatggcaacaaccaatcctagtaccaatactttacctggattagcacctaaagcgcctgcaatggccgttggtgctgggtgagggggtaaaaacccgtgggtgactgacaaggcagcggccatcggaatacctaggtacaacaacggtacacccaactcaagcgcaatggcgaagacgattgggattaacaaaaccatacctacttcgaaaaagagggcaatcccgataatgaaggcggcaatcattaccgcaatctgcacacgcttgcgaccaaacaaattgatcaatgtgtgtgaaatgcggtaagcaccaccagcatctgcaaccaagcgcccaagcattgcaccaaacccaaacacaattgcaagttcgcctaatgagctaccaattccattttgaatcgaaactggaatttgcgcaaaattcatgccgaggccaagcccgacagccacagccgttaagattaacgcgataaacgtgttcatcttaaccttaataattaaaaacagtaagagtagaatgcctacaaataatacgagtaatgagctcataatcttaattctccatatatccccaaataaatatctcaatgcgactgctatgtcgtaccactattataaagttagtttaactaaatgtaaacgctttccttatttagtttaaattaatgacaaaacagtcatatttaaaaagcgtataatagttataaatatttaatttttgggggattaagatgggatcacggctaattcacgcggcaatcgcacaaaagttaatgaccattcattcttttttagatgatgctttcttccttggtaatgaggcgcctgacgctgataaaacgtctgatttgactaaaggggacacccattttcttgtaccaagcaatcgtggcacacaacgaattgatctcagacaatttttaacgcaatatcctagcagtctcactaacaacttcatgctggggtactatacgcatttggttgctgatgaactttggttacaggacatcttcagccaccatattccggcaggtcccattggcgtccgacaacaattgttgacgctgtattatcaagatttccagcaattgaatcgtttcttaattaatcagtatgcactggtaccttacgaacgggatatcacacctgttgtacccactaccgtgaacttggatgcgttacgtcagttaatggccgaatacaatcatgatttcgacctaatcgatgcgcgcccgttacaattattgcaacaatctgaagtggacaaccatatcgccaaggtcgtaaaaatgatgacaaacatgattaacagcgggcaactcgtagaacagctaatcatgccgcaagacaagggggatttataatgaaaaaattttggttaatcttaattagtgtactagccgtgattggcgtgttaatttttgcgggtattcaaattgaacgtcacgtggtggccaataaggccaccacgttattacctattgttagtgggacacacaccaccggtgttgatttgaaaaatgttgaactcgccccaacaacgccccaaaatgttgccctaaaattaaataatgaagcttttaatcttaaacaaagtgccaacggttgggtaactgatgcttcagcacaagtcaccggcgatacagtcacctataccattaagacggataaagtgtcacagacaatgcttaatcttggtctgcgtacaaatggtgaccaaattgatgcattgggtagtaaaattgtccaatcaatgcaagatagcggggccaaacatccaaaattggttattaatgtcaccaatgacacgggagattctttgaaatcactaacttaccgataacgttggtaatcaaaaaaacggtagacgtcagcatgatgtctaccgtttttctattgcacgtacaagtgcttatgcagggagcacccgggattaaagagggccccgcaactttcacattgatcaatcgcttcataatgcgcgtaggtcatttgtaacccacagacaccgcataacacaatcttttgttgggtttgtgctgcgtaacgaccgaatgggtggctttcatatgcctgatggcattcataacaggcataaaatttgccacaagtcgcacagcgattggcgataacatcacggtcactatgccagtgaacgcaccggcctgcggtatctaaaatattaccccatattgttgttttttccatactattatggtcacatgactcaccaaacaatacaactcttcttttttagcacagatataaaacaaatatagcccttttttgaggacaacaagtgtgtgatttaacaaactaagttgttttttaaggtttctttgacaagcatttttcgacaggtatattaaattttgtaagcttttacggctttcaagggaggtgtctacatgtgattcgaatgaaatttgatagttaatatatgcacaaaataacatacgattaatgggggattatcatggtaaaacaaaaaattgcagtcattggcgcatcacacggtggtcacgaagtcgcactagaattgttaacacagtccgatgcgtacgatgtcacggtcttcgaggccggtgacttcatttcatttatgtcttgtgggatggaactctatctaaccgaggcggtacaaaatgctgagcttgtccgaaatttcaagccatcagatttagaaaaatatggtggtcatgtccgcaataacgcgaaagtcacgggtattgacgcgacgaaccacacgctcacaattaataaccaggaattattcacttatgataaagcagtcttaagtgttggtgtaacacccgcgcacttaaccatccccggttcgaatttagccaacattattccgatgcgtggttacgattgggccaaacgtattaaacaatacctcaacgatgcaactatcaaagacgtcaccgttattggggctgggtacattggtattgaggccgttgaagctctggtgagagctggcaaaaacgtgaccgtcctagacatgttacctcgtgtactagccgcttacctggacgccgatatgactgatattatcacgcaagaactaattgcccatggcgtcaacgtaaaagtcggtgaggccatcaccgcatttgagggatcggaaaatgagggcgtgacagccgtcgtaactgaccagggaacctatgcgacagacttagtcattgaaggaattggggtaaccgcaaacacggcaccctttgcagatacgctagcactcgataaacgaggctggattgagacaacccgtaatttcgaaaccaatttaccagatgtttatgccattggtgacgctgtgaagccttactatattccaactggacagcaacagccggtagccttagcttccaccgcacgtcgtgaagcccaatatgtcgcccaacgaattatgggcaacaagcatgctgttgatttcaaaggggttgttggtgcctcagctttaaaagtttttgattatacattcgcctcagccggcctaaacagcgtcacggctgatcggtcaaaaattaaaatttcagccgtcacctacaccgacacacgtcagccagctttcgtgcccaccagtgaagggaacggggacattattgtccgcttagcgtttaatcctgattcacgaatcattttgggtggcgctattatggcgcgtgattacgatgtcaccggcttcggtaacacgctggccctagccattgcacaaaaaatgaccgtagatgatttagcagaagccgactttttcttccagccaggattcgaccggcaatggtcagtattaaatctggccgcccaaaaagcttgccattatggtgaattcaccaagtaaaagtaacctatttgaataatgtcgtgttaaaagcggtgctgattctaagcgattcagcaccgttttacgatggtccattatagtatgcacaatgttaaatgcagtcgtgagccgtcgacaagagctaaaatattgttataatgaagtcacctaatcaatgtatgcgctttctttaccacaacaattattggagcataaaatgacgcaacctaaattattcctagatatggataatgttcttgttgatacattatccgttttaaatgagattgacatgcggcaacagtctgttgaaaagccagatcaaatccctggcattttccgggatttgccaccaatgcctggggcaattgaagccgtgaagcaactagcaactgaatacgacatctatgttttatcaactgcaccttggcaaaatccaagcgcttggcaggataaactgatttggctacaacattatttcggggaagataacactagcccaatttataaacgaatcattttagcccacgataagtccgtcgcacattttggtggtggcatcttggtggacgaccggccttatcatggtgccagtgactgggatgacccagatgctgacagcatctggctccaatttggtgccgatcctcggctaacgtggtcaaatgaactcgtgtcatttttgctagatgtttcacaagtccaagatgtaacagatacgctaagagaagcagtggccgtcgttgctgaacgtggccatttttacgttcatggtgataaaaccgaatttgacaaggcccattgggaataaaagattcttttaaaagagacagtcatcaacacgactgtctctttttttgattgtgaatgaatgtttttgaatgaaaaacgttgcaaaaggcaccaaataacactatagttactggtgaaaaggaagcgcttacatttttataggtgaatgattatgatgatttcagaacgacaagacaaaatattagcattgattcaaaaacgcggtcgcatatcaatccgcgagctgcaagaactgctattagtgtctgtatcaacaatgcgacgagatttggacaagctggcagacgaagggctagtgaaacgaattcatggtggggtcgaactgctaagtcaacaccccacgctacaacccgaaattgccattgccgacaaaactaaattgaatcaaccaagcaaacaacaaattgccctgaccgcaattgcccaactgcaaggaggtgaaacactttacctagatgcaggtacaacaactgggtctatgattgcattacttggccaggtgacgccagcgcctttggtcgttactaattcagttcaccatgcatcgcagttagctgatttaatggtgccggtagttgtcattggcggtcaagtaaagctatctactaacgcaactgtgggtatgacagcggctgaacaactcggacaacttgcctttgatgtaagttttattggtgctgatgcgattgaccttactgcagggattacgacacctgacctagaggaagcggccattaagcgtttggttatcacacattcacggcatgcattcgttttggcagatgccagtaagtttaatcaacgggcatttgccaaagtagctgacttggaagaagtaacgattattactgaaccaaattcggcaacagaattggcttcatatcagacaaaaacacaattaaagatcggagaccaatcatgatttatacagtcacactcaatccatcgattgattacgtgatggcagtgcccgactatatcagtggtgcgactaatcgggcccagaccactaatgcttatcctggtggtaaagggattaatgtcagccggattttagaagctaatcatattaataatcaggcgtgggggtttctcgggggatataccggtgcttttatcgcaacaacattacaacatttagccattaaaactgacttcacaccaattcaaggcacaactcggatcaatgtgaaattaaagtctcgccaagaaactgagataaacgcatcgggacctcaaattactgatgctgaatggcagacttttaaacaacaattttcaaaattgcaaccggcagataccgttgtattttccggtagtttacctagtacgctaccacatgatgcttatcaacaattaattaagctggtggttagtaaacaagctaattttattattgatacgacaggcgatgatttgaaacaagcattggctctgcacccgttattggtcaaacccaatcgtgacgaagtgcaagcactgttcaaactgacagatatcagtttgaacagtttgaaaatcgctggtcaacaattaattgctggcggtgcccaacaagcaattatttcgctcggtggtgatggcgcattactatttgccaataaccatgtgtactttgctgaaccaatcgcaggggacttacaaaactcagttggggctggggattcgatgattggtggtttcttagcacagtggacaattgaagaagacccggtgactgcatttaaattgggggtcgcaagcgcaaccgcaacggcatttagcgaagatattgccacgcaaacaaaaattaggtccatcttggatcacgtacacataactgaaattggttaattaaacgggggattaatcatgcaaattaatgatttgctagcggcagagacaatgattttgaatctggccgccacagacaaaattggggcttttaaggaaatgattgctggtttgaaacaagcaaatcggatttcaagtgaggctgatttcttagaggggattttggcacgggaggcacaaacgtcaacaggtttaggtgatgggattggcattccacacgcaaagaatgcagcggtacttcaaccaacaattgtattcgcccgttctgaaacgggggttgcgtacgatgcgctagacggtcaaccagtgcacttactctttatgattgctgtcccagacacggctagtaatacacatctggaagcactggctaatttgtcacgattcttgttacgtgatggatttacaacccaattaatggccgccaaaacgccggctgaagtgcgccgactatttgatgaatcatcgccaaataactcgggagaagacggggggatagctaatgaggacgcgccgttgttagttgccgtgacggcctgtacaaccggaattgcgcacacctatatggctgaggaatcattaaaaaagcaagctgctgcaatgggcgtgcgcattaaagttgaaacgaacggtgccagtggtgttggcaacaaactgaatgcgcaagatatcgtggcagccgacggcgtcattattgcggcagacaaaaaagttgacatggcccgttttgcagataagccactgatcaacgtacccgttgccgaggggattcgtcatcctgaaaaactgattacccaggccttagatagtcatgcaccaatctatcaaacagcggaaacagtcacgcattcggacacgaccgagaagctgtcccttggtaaggcgttttaccgtcatctcatgagtggtgtctcaagcatgctaccattcgtcattggtggtggtattgcgattgctctggcttttttaattgaccaaacactcggcgttccccaatccgctttatcgcaactcggaacttaccatcccgctgctgcattctttaagcaaattggtaataccgcttttaacttcatgcttccagtcctggctgggtacattgcttattcaatcgccgaaaagccaggactagtggctggtttcgtggctggtgcgcttgctgcaaatgggtacagcattttcaatgttggcttgaacgcttcacaccaacctgtgccatcaggatttttaggggcattggtcggcggattcttggctggtggtgtcatgttaatgcttaagcgagccttcgcatttttgccaaaagccctagatggcatcaagtcaattctatttttcccagtcctgggtgttatcgtaacaggctttttaatgttgctgatcaacattccaatgtcggccattaacagtggcttgaacggctttttatctagcttgaatggtactaacgccatcctactaggtgcactactcggcgggatggaagcaatcgatatgggtggtccagttaacaaagccgcctatgtctttggaaccggtacacttgccgctagtgttgcaaccggcgggtcaactgtcatggccgccgtcatggctggtggaatggtgccgccattggcaatctttgtcgcaacattattgttcagacataagttcagtcaaaagaaccgcgaagccggcctaaccaacattgtcatgggattaagtttcatcacagaaggggcgatcccatttgcagcggctgatccagcgcgtgccatcccaagttttgttgctggttcagcgttggcaggtggattagtaggcctagcagggattaaattattggcaccacacggcggtatcttcgtggttgccttaacaaattcaccattgttgtacttgctcttcgtagccattggtgcaatcgtagcgggcgtcatctacgggttactcaaagtacctgacgcggattaaaagaaatgggggacattatcatgtctttaaattggggaattattggtactggcacgattgccaacgaaatggcagcaagtttattagcgcaccagcaaccggctatggctgtgacggctcgagatcaagcaaaactgacagcctttgcggaacagtatcaaattccaaaaacctacgagacagtcgcggatttattagccgatgaaacaattgatgctgtctatattgcaacgccacataatacacactttgactttatcaaacaggctttggcgcatcataaacatgtgttagcagaaaaagcgataactgtctctaacgaagagtacactatcgttcgaaagttagctcaggacgctggattagttctcttagaggcgatgacaccagtacacatgccacttttcaaacgacttcgtgaactcattaatcaaggctcattggggcagattaaggtgattaacacaacctttggtagtcataagccttacgatccaaaaaatcgattctttaaccctgatttagcaggtggggcactacttgatattggtggttatgcaacacaggcctctgtctactttatgaacagtacgccaagtagggtaaactcgatgatggtcccttttgaaaccggtgttgatgaacaatcagtgacgattctagcaaatgacaatcatgaaatggcgaccatcacattatcaatgcaagctaagcaacctaaggccattacaatttctggcactaaagggtacctacgtataccagatttcccacgcgctgatgccgccatttggtatcacaccgataccggcgagtcagaagcgattgcgttaggaaattctgcagatgctttgtggtatgagatttcagattttgagcaagcagtacaagacccaaaaattgctctcgaatttaccaatttaacagggatgcagttcgaaaccttaagtaaaattcaacaagaatggtaataattgcattatttagcggcgttgcgcacaacgccgctttttattgttaaaatgaatacgaaagatacggaggggcaagatgagcgaaaaagaacgtataacaataaatgatatcgcccgtctagccggcgtcgggaaaagcaccgtctcacgttatttaaacaacgggtcaattagcgcaaaaacgcgggctaagctagatgctgtcgtcaaagagtatgactatgaacccaatcgatttgcccaaagtttgaaaaaaacttccagtggcatgattggggttgtggtccccacatttgcctcatttgcattgacggagatgatgcgtggcatggatgatgttaatcaaggagattttttcttaaccatcaacacctatcacgatgccaagcgccaagttgaagcggttaagcagcttgcccaacaaaatgtcgatggtatcgtcgtgatgactgggcaaattactaacgagatgactactgtgctacaacaagtatccgtacccgttgtggtgcagggacaaccgtcacgacactttgaaactgttaacgttgataaccaacatgccggcgagttactcgtgccattaattgctaatgttaaaccaacggatgtgttgttacttggtgttgatccgactagtgactacaatgttgggcaaacacggttcaacgcgataattcaagctttagacaacaacatgcaacgtctttatacgacatttgatcgtactgaaacggctgaaattatgcgcaactaccttgcgacacatacgtcgcccaaatacatcattgcagcaactgacacgattgcgttaggggcactagcagcattgcaagagcagcacatcgccgtgcctgcaaacaccaaaatcgtcgcgtttgacaataccccggctgccgaaatcgtgacaccagggttaagcacggttagtttcgattattttgcattaggccaatggctgtatcgtcgtttaaaggatctatctcaagcagaacctgtcttaactgatcccttactacgtggcgagttggtgcgtcgcagtagttggtaacgccaataaatgaaaagatatcttaaacttccaattcactcgggagacactatgtcataatgagtttctggaggtgtggtatgaaagcagcaattattaaccaatatggggatagcaatgaattatcggttgtcgatgattatgtcaatccaaccataactgacgatcaaatattgattaaaacctacgcaacgagcgtcaatccaattgactacaaagcccgtcaaggcgcgttgaaatgcatgtttaattggcaatttcccgtcgtcttaggctgggatatcgctggcattgtagttgaaattggcgatgatgtcactgattttaccgttggcgatcgtgtatttgcacgaccggacatggatgataccggtgcttttgggtcttacgcgacgttaatggcggtaaacgctgacaaagttgccttgatgcctgaaacgatgtcattcgcggaagctgcagcgttaccattggctggtgaaacagccttacaaatgttaaacgagctacacgtgacggccggttctaaagtattgattcaggccggggctggtggtgttggtattgtcgccattcagcttgcaaaagcgcttggtgcaactgttgctacaacggccagtcctgaaaacgcagcttttgtacaacagttaggcgcagatgttgtcattgattatcaccaaaaagctatcaccgacgttatcagtcaatatgatgcggttctagacagtgttggtgacattgatgctggattagctgttttagcacatggtggccgaattgtgacgatttcagcaaaaccgacatctgaacagttagcagcagccgcagccaacaatcaaacattactggctggttggttacaaccaaatgggcaggatttagccaagctagcggcgtattatcaaaacgatgccttaaagattgtcattgactcaaagtttccgtttacaacggccggcgtgcgggccgcgcacgaacgtattgaatcacatcatgcacgtggcaaaatcgtgattgaaatggttgcagaataaaccaattaaacaccaaggtaggctagttgtcgtatcttggtgtttaattttgcaagcaatgtcgtgtttacagaaaacagacttattctagtttacataatatatattatcgtgagttgaactaaagtgggtaaatgaccccaaagtatttgattattgataaacgattcaaactaattgtcaattataagctctataatcaaaacatgatcgttctataacccgctgcaattatcatgattaagtaaaaaacgctaccggccgcaatttcggcaagtagcgttttttacttaagttatattacataaacaacatgcggaagatttcttcgaacatgaaaccgatcaatcctgctgatggcaccgtaataatccaggccatcacaatattctttaacgtactccattttacggctcgaatatcatcagatgcacccgttccagcaattgctgacgtaaccgtgtgtgtcgttgaaattggcgcgtgaacaaagtacgcagaaatgaacaacactgctgatgaaacggcttctgccacgaatcctttttgtggactcaataccgtaatcttgctacccaacgtgtgaataatgcgttgtccaccggccattgttccagctgagatggccaaagatgccatcaagataatttgtagcggaatttccgtttgtccaggcttaatgccaaagaaaccaaccggggcagccgccataaacatcaatcccattgacttttgggcgtcttgcaaaccgtgtcccaaagccaatgaagcggatgtgaaaatttgagcacctcggaaaaacttatccgtttcctttaaattagcctttttaatgatcttattcaaaataaccatgattataagtgcaagaccaaatccgacaactggcgacaacaccatgggatcaatcaccttttcaacgactttggctaacttaatgtgtacattattaccggcaatttgttcagccaaaccatcttcatcaacccaccaataatcgcgtgagttgatgaagatggtagaccaaaccaccacgtaatcaagttccacccaattgcaccaagcaaggcggcaataaccaagaataattgctgctcagcgctcacttgcgtcatatcaacgatgtcacgtgcaataactgcagcgacggccgttcccatcaaggccccaatcaagttcatcccggcagccatgataattgccgtccttgccttcaaagcacctgttgtaatagccgtagcgattgcattcgctgcgtcgtggaatccgttaaccccatcaaagatcagggccacgataatcaccacaactgctagtacgtagacttccatatttgtctcctgaaataaatactagttttaatttttttatttgttaaaaaaacaacagaaataattatatcagtaaatacgcggtttcctggattttgtaacaaaatttacagtgccggttcgcttcgtaatgaatcattaaaacatattatttaaaccatatgaaaagcatacacaggaattagactatatttataaatcacgttaaggagaaaaggtatgcgttctaaaatactaataagtaccacccttgtgacaacagtcttagctgctggcctaatcggtgccaaacttgggtcgaattcattgaaaacggcacctgcaacaaatcatcgtacgtcatcagcaaaacaggtaaataatccgccggcgtcttcaccagctacaaagcattcggcagtagccagtacttcatccccatggtcagctaataaaagccaacaactggctaaatttatgctgaattgggcaagtcaaatgggtcaacactacgagtcatattaccctggtcatgattttaatctatacggtgtcatattcccaacacccctcacgaacggtaccatgaacatgcaccctgcagtagatgatcatgctattgatttgcaatggtccgacgatggcactggtaatcatgactataacttggttgccgtctatggtggcagtgccagttcgaacgacagatatccagtgttaacaatgtacctattcacccttcataacgaaaaacctgaagttcttgtcacgcaacaaaatcaaggtaatcctgaaggttacttgtatttcaagccaactgacaatcaagcccttgcatctgggtttgcatcgattgttaatcacaactaaaaagtagtcatcgcgcaaactgtacgatgactactttttagttgtgattatttcaaatagtaacgcataaagaatgtgccattatcaccaaagtaataacggatgccgttgattgtctgccatccttgcacagcacgtccttgattgtccgtgtagtacgtataaccccaagcatgacgccaaccggcattttggcgcacaccatcaacaaaccagtagtatgtgcccatataatgcttaaagccggtgtacaattgcccattctcataccaacgataaccaccattcaacgctgaaccatcgtaaatatagccattcgcagttgctttagttttattctgacgggtgttgactggattatctcgtaagtagtacgtgttattatcaccaaaatagtattgcttgccagcaatcgtttgcatgccttgcactgctcggccatttacatccgtataataggtcatcccccacgcgctccgccaaccagcattctgacgcacaccatcgacaaaccagtagtatgtgcccatgtaaaacttaaatccggtatatagttgaccattgtcataccaacgataaccgccatttgctgctgaaccatctttcaaataaccagaaactttaccacgcaggtagaacgtctgatcattgccaaagtcgtacgtgatcccattaattgtcaccaggtggccttccacgcttcgaccatcagcacctagataataggtcttaccccattcggtcgcccacgtgtttgtttgtcgaacaccatttataaaataataatttgccccaaaataattacggaacccggtatatagctggccattctcataccaacgccaatcacgattagcagtaaacacataccctgacagtggttggttcgtcgtcgcatcggttgtaactgtgtcagcttttgcctgtccagcaactagcaaactcatcacgaccactaccaaccccaaaacactaaactttaacttcatgatgcttcgtcctttgtttttatctatcaacattctaacgcaatccgacgactatcgtgatagagtgctaaaaaccggacataattcttacagttttctaacggtatccgctgtttattggcaaacaaaaaccacagatagcaacctacctgtggttttcttgatgcccatcaattagtgtaaggatttaataattaaagtagcgtagttgtggtttgtttcgtgacgggcatcaatccgctaatcgcctaagtcttccccttgtgtcgcgatgacttgcttataccagtagaacgaatccttgcgcaaccgttcgccagatccttcacccatatcatccaaatcaacgtaaatataaccataacgtttcttcatttcaccagtacctgctgaaacaatgtcgataggtccccatgacaagtaaccgattaccggaataccatcattgacaatcgctttttcaacttcagcaacgtgagctttaagataatcaatacggtatgggtcgtgtacttgaccatcaacgatctcatcgtaagcaccaaacccgttttcaacaatcataattggtagatatggatacatatcatttagttcatttaatgcgtaacgcaagccttgtggatcaactgcccaatcccaatcattcaccttcacgaaatcgttcttcacaacctcaacgtcagctggatgatcaatttcggcgtcttgttccgacgttgcgcgaacggttgtcgagttatagtacgaaatggccatgtaatctacggtaccagccaataagtcagcccgatcttcatctgtaatatctggtcggataccagttcgcttaaagaatgcctccaactcggctggataagcaccacgaacgtgaacatcagtaaaccagtcacgtgcctgacgcgccttttggaaagccagcatatcggcaggctttggactagccggatagagagcggccacgttgaccatccccccaatcacgaaatcaggattaatctcatgaccaatttggaccgcctttgctgaagcaaccaactcatagtgcccggcctgcatcatagctgcttgcttatcagccagtgttgccttgtcatcaaatttcagtcccgaattcgtccacaccataaactcgaaaaatggattgtctgagacggcggcttgatttgaaatttcattgtgcgtcatccagtacgtaaccttatcacgataacgctcaaagactaccttggcataatttacgaacaaatcaatcacccggcgatctgaccaaccgccatactcagtgaccaaatgatacggcatttcaaagtggttcaaggttacgactggttcaatgccatgcttatgcatctcgtcaaacaaatcatcatagaattgcaacccttcctcgttgggtgctgcatcatcaccatttgggaaaatacgtgtccaggcaatcgatgttcggaaggccttaaaccccatttcacccattaacgccagatcttctttataggtatggtagaaatcaataccatgatgatttggataattcaatccatctactacgccgttcgtaatctgtcgtggctcagtatgactacctgctgtcagaatatcagcgatagatacacccttgccacctgcttgccaggccccttctgcttggtgggcagcaattgcaccaccccaaagaaagtcgtcttgtaacttaattcccatgtcatgtcccccgatacgtatgactgcatttgctatatctctattgtaagcgctttccgatttgaaagggggtgttttttgactttaattatcgctttttttgcgaaatcaaaaaacgaccggcatttaacaacgtcgatcgttttcagcaagcactttagttttcagtcgtcgcagcctgttgcaagatgtccggccagtcaagacgtaatttggcaccggatgccttggcgtgaccaccaccattaaaggcggccgccacaagcgatacatcaacatccttttccttagcgacacggaatgacaatgcaccattattaatcactaagccgaaatcaacgtcttgtaatgatgtcaatgcattaccaatttcagacatttgctttgacgctgtcacatacgcatagtggtaggtagtggcgccaatcatcaaatcaccaaactccgcatcttccgcttttttcaagacataggctgcattagctgccatgcggtcatctaccagtcccatgatgaccggtgagaaaattttaatcagcagctcacgtggcttctcatctgatgaaatcgatgcttccttagcagccgtaatgagcgtactaaaacgttcgcgacccaaaaagtacaacacctcattcaaagcttgcgcagttgagcctgtcgctacgtcatcatcatatgccgcatcctgccacagccaggtatcgtataaattcgttagtgtcactagggtttgccaaaatggcaatgcggtaaaggacgctcgttgatctttaaataccaactcggtcgccgaagatgtccccgtatcgtcagtaataaaccgagccaccgtcgtcgcctcagcccacaccggtgcattcgaaacgtggtggtcataaacgactggctggatacccgttacttggttgaattgcagtaacatttgcattgatggggtattgtccaacagtatcacgtgtgtcggtttacgtaccttgtctgctacaatatcatccagcacttgctgcaggacagcatcaataccgggtgccccagcttcagcgtacagaatagtggcgtctgattgactagtttgggctgccgttaagccggccatgaccccatctaaatcagtatgggtcacaattaaagtcgttttcatcgtatcttcctttcgaagtgaaaccttaccgtctattgtacgcatcttcaggtcagttatgcaaaaagattagtgaacggacgcaaaacatcataaattcaccattatcttgtcgaaattatcgccagctttcacaacacgcctttcttagacttatttttaaggaagacgttatgatgaaacatgaaatcaatttttgctggcgaaccacctgcctggttttgcttgctttcgggggatgtatcttgtcgtcgcgctatctatatcgattagacgcggcttgctacctaccactacttgctagtatctgtggtagtctgattattggcgtatggctagcggctggtctagtctggctcctcacgaataaataacgacactaaaaaaccgggtaatggctatgccaattaacccggtttttttagtggtcatagtctgtttttaagatactgtaaacgttgctatccacgaatgtgccatttggtaatttttcatagtcgcgcaaacgaccttcatacgtcatccccgcccgttgcataacccgaccagaggcagcattatccggtgcgtgataactatcgatacgatggaggccgagttgttcaaaaccaacccgaataactgcttttaacgcttccgtcatgtagccagagccccaataatcgtgattcaaagcatacccagtctcggcgctcgcattcttttccgtcaaacggatgtcaatgctgccaatcattttgccgctggctttttcaatcaaaacgtatttccccagcggatcagccaagtgataccgtcggatactaaattcaagcgtttccgccactgactcaggtaccggtacgtgaatccagcgtgtcacttccggatcatgaaacagttcatacatatcagccgcatccgtttcaaccgcatgtcgcatcactaaccgttctgattcaaattgcgttaagttcgccaatcttgtttttaattcacccaatgtaaaaaccccctactaaagcatttgttttatgctagcagaaggcttttgaacggtcaattattttttaatttaattttaataaaagcagaccaagtgggataaatattaataacaaaagaacgtttatcagcatagaacgcgtcggaaatgaccaagactgttcgtcggtttgaagttggtattggcgccaggctaataaattagccaacgaggcaataatcgtccctaaaccaccaatagagacccctaaataaagtgggtaaaccagatgtgtgaattttgataacaaaatcgcaccggggacgttactgataacttgactcgtcaagatgcctgcaaaaaacactttgattggtccatccgtcaaatgggttaacaccgatgctaaaactggcactcgactcagcgcccccacaatgacaaaaaatcccacaaaaagcagcaacaccccatagtcaattttaacaaaggttgttcggtcataacctaacgctaatagcccacttgcaataagtgcaacaccaatcggtaacgcgttcagaatagcagctagtacaacgaccgtgactagtaacaccactaccatgtgtcgcttattgatggggtgcttctctagcgcaactgctccaacagtgtcgttggcaaacaaatacgttactaagaagagcaaaccaagacttaccatgcctaagggcaatgacattttaaagaagtctagtgccggcaattgataaaacgatgccaaatacaagttctgcggattgccaaacggtgtcaccgcactacccaaattagcaaaaatagtcatgaagaccaacggtaaaatcatcttaagttggattttacgagcaattgtaacaaaaatggggaccaacgttaaaatggccacatcatttgtgaagagcatcgatccaaaaaaagccatcaggaacgtcacccgaataatctgacgagtggtttgaaagtggctgacaaccgtactagcgacataaaccagcagaccttcagtttcataaacactcactaacatcattaacgctgccagggcgatgatggtatgggcattaatatcagaccaatgtacgttaccaaaagccaaagccagtagcgcaaaaacaccagttaactgcaatgtccgatcagcaagtaatcgtttccagataatttgcataataattcctaattctttctagtttagatatccagtatatagtaaaaagcaggcctcaacgagacctgcttttttgtttatagttgacgcttacgcttttgcatgtagaaatataatggcaatcccgccaaagttagtagcaatccaatcactgccagttggaattctgagattaacgtcatcacaatgatgaacaaaccacctagaataccgataattggcacaaccggatacaaaggtaccttatatggtcgtggcaaatctggttctgtgatgcgcaacttgataactgcgacaaagaccaacgtataaaatagccaaatcacgaagattagcatgtccgtcaatgtgtcaaacccaccaacaaacatcaaagcaattgccaataccaattggaagatacccgcaacatatggaatttggaaacgattcaattgacgtagttgctttgaaaatggcaattcattttccaaagccattgcatatggcaaacgcattcctgtcatcgtataaccgttcaatgtaccataaatggaaaccaagataccgatggtgatcaatttaccaccgaaaccaccaaagatatgtgaggcaacatccattgaagtattctcgttaccagcaattgcgccaaatggcaatgaatgcaagtacacaaagttaaccaacacatagatgaccataatacccaacaaaccaccagtgatagcacgtggcaagtcacgacttggattcttcatttcaccggcaatattaccaacgtgaatccacccatcataggcgtacatcgttgctagcaaaccaccgccaattgctgtcgcccagccaccagtatgtgcacctggtgtcactgggaatagactaacatcaaccccgcctggttgcagcaacccaaagattacgattaacgctaatggaattaacttaaagaataatgtaatcgattggaattgtcctgccacttttgagcccaacaagttaatgaggaacacagaagcaacggccaaaacaccggccgggataattgcattcgttgacaggtgaaataaattagcaacttgcgtaccaaagatgacacccttagcagcgacacttgccgggaagtaaacaatgatttgtgcccaaccaagtaaataacttggcaacttaccgtaagcccgctcaatgtacaccaacataccacccgtttgtggtaatgctgctgccagctcagcaccagttaatccggcagccaaactaatcaacccacctaatatccagacaaaaatcgacatactagttgaaccggttgctgatgcaacactagacgctttaaagaacacgcccgcaccaatcaccgttcccataaccgttgaaacggctggtagtaacgtcatggtacgattcaatttgttttgctcgttcatgagttgccccttattcataattttttcaatattgtattattttaccaggttccgcacccgctgtctttttaaatgtcagtaaaactaacatcaacctgtaacaaaaaaagccggcacatcatagtggccggctttcatttaattttagcgtactttagctgaacgcaacttactatgtgttgcgctctcaatttgacgaagtgtcgcagcgtcaacgtgtaacccactggcaatttgaccaaaagtccacgttgggtggcgctcacacaaatccaaataatgttcgaccaacttttcgttgaccttgggttgtgcaactgtttgtgtcccattcactgcaaagtcctcaacctttgctttttcgaagctgtaatgcaacgtgctgggccccatttcacctgatgaatagtccatatctttaatcccccgtgattgacaatagactccctttctctatatgcacaatataatagcatgcttacaaatcaaaagaaagaaacatttcggcaatgttctatgcctaaattatgtaaaattatagcgtgtaagcccatacatgtcctatataatttttattgttcgggaaaatgacatagaaacctagaaacggcaaaaaaatggtaaactagaggaatattattttttagaaggagatctcatgtcaaaccgacaagcactcattcgaaactttgccatcatcgcccacattgaccacggtaagtctaccttggccgatcgcattatggagatgacgaacactgtctcagaacgcgaaacagaagcccaattactcgacgatttaagcgttgagaaggcccacggtgtcactgtaaagtcccgcaccgttcgtaactactatattgataacactggcactgagtaccaatacaatctaattgacacgcctggtcacgtggattttaattacgaggtctctcgtagtctatctgccactgacggtgtgttgctcttggtcgatgccacaaagggagttcaagcccaaactgttgccaactaccgtcttgcgaaagctgctaacctggtgattatcccgatagttaataaaattgataatatggccgctgaggtcgacaagacaattgaagaactacttgacttagatgactcattccgcgaagaagacattctaaagatttctgctaaaagcggtcttggtgtcgacgctgttttggaagccatccgcgaccgaattccagcacctgctggggatgaaagtggtaaattgaaagctctagtctttgactcaaagttcgacccctacaagggtgttatcgtgcaagttcgtttgttcgatggtcaactaaagtcatcagacaacgtgttgtttatggccaacagcatcaaatcacaaattaaagagatgggtgtcttctcaccgttgatgaccccattagacactctccaagccggcgatgttggtttcatcgttaccggtatcaaagatgcccgagctgtccgtgttggtgatacgattacgttagcaaacgatcccgtcgcaacaccccttcctggttacgaagacgtggagccaatggtttacgccggactttacccccgcggcagcgaattcaaggatttgaagatcggcatcgaaaagcttggtctaaacgacgcggctttccaatacgaacccgaacaatccgaagcgctcggtatgggattccgtggtggttttctaggtatcttccacttgcaaattatccgtgagcgtttgcaagaagaatttggcctagatgtcctgacgacgatgcccaattcaacgtatcgcgtgaccgttaagaatgaagacgaacccttatacgttgaaaatccaattcaattcccagactacgggcaaatcgtaaaggttgaagagccgttcatgcttgctaaaatgaccctaccaaacgaaatgttgaatgacattatgcgtttggctgaaggtcgccgcggtgagttagttgatttggctaccatcggttcgatgctaatggtaacgtaccggatgccaatttcagaaatcgcctacgacttctttaacgaactcaagtcagcttcacacggtttcgcaaccctctcaaccgagtttgattcttaccaagaatctgacttggtccgaattgatatcgctgtcgattacgcgaaagtcgatgctctcacattcgtgatgcaccgttctaaggttgatcgcgtcggtaacgaaatcgtctcaaagctgaaggatttgattccgcgcaagttacaatcaatgccggtacaggcaattgttgaaggacgcgctatctcacgtgccgacgtaccgccgctacgtaaagcgcaggcctctggtacgaaggtctcaaagaaacagcaacaattacgtcgccaaggccaaaagaaaagcgatattgaactgccccaagcagtcttcgacgcaatcctcgatatgaattctaattaaaaaacgaccgttcccataggaacagtcgtttaacgacacgttagcgtttacaacgctagcgtgttttttattagcggttcgtaactggcttaccagatacttcagctggtgattcaccagcaccaagtacttcgatttcttccaatgaacgaccacgtgtttctggaacagcaaagcgaatgaacgcaacaccgagcaagcagataacaccaaagatagcaaagactgcttcttgtggcattgatgcggtcatgattgggaacaacaacccaactgcaaatgaaccaatccagttgaatgatgaagccaatcctgaaccacgaccacgaatagccaatgggaacagctcaccgaccaaaacccaagtcaatggggcccaagtaactgcgtagaatgccacgtaaatgcacaagaagacaacaatcatcattgggtgcgcatccatgaatgagttaatcaaggctgggaagataaatgacaatcccatcaccgttccaccgaccatcaacaatgtacggcggttaaacttttcagcgattaccaagaacagcaatgatccagccaccaagataattccttgaataattggccacatcaacgcatcactggcagcctggccagttgccttctccacaatcaaaggaatgtagtagaagatggcattcgcaccttggaattgctggaatgcagcgactccgataccggcgatcaccaacttgcggtaacgaccttctagcaaagatccccaagttgtgttctttgaagcttctgactcaacttccgccatttcttgaattgacgtcaattcgtcatcaacttcttcaggcttacgaatccatgacaacacctgacgggcttcgtcaatcttacctaacttcaccaagaaacgtggtgactcaggcaaacgcaacacacctaagaacaagatcaaagccggtaccgccgccaatgacaacatcaaacgccaagcgatgtgttctggcaatcccttcaacaagaagtccatgacgtatgaaatcaacataccagacacaatcatgacttgattaattcctgacaaacggccacgcaatgctgcgggtgccatttctgacatgtaggcaggtaccaaggctgaagcagcaccaacggccaacccaagcaacacacgcgttccaatcaaataaccaacagcatcgtgtggtgataatccagccaaaactgacccgatcataaacaagacggctgatagcaacaccatcttacgacgacctagcttgtcagacaattgacccgccaaggcacctccagcaatagctcccaacatcaaagatgatgtaatccaaccaaccactgcggcatcgttcaaattccaatcactttgcaaaaatggcaaagcgccagtcataaccccaatgtcataaccgaataggattcccccaaatgcgccgaagaagtaaataaatccgcttgggattttcttctcagacatgaaacaattcctccaaatgtataaaaatgatgtgtaaacgcaacaaaactaattgtccgtacaactgaacagtaaatctaacccctcggcccatttgtactgacgccattctgtcaaaacgacttttcgttaaaagaaaacgttttcaagaacatctttattatacacattgtccgtacaaattgtaaaatattctgttaaaccggacaaataccggacgaattgttagtaacgccccattcgtccggtatttgttataataatgtcatgaataatttaaaaaccttacacgactttttccaacttggcgcaaccgaagttagccaagcgttaaaaattactgttgcagagcttaacgactacgaatccggtaaaaaacaaccggaaattttgatgtggcaacgttttgctgaatattatgcggataagtttcacgttgacgcgttgcctgataacactgagccgattcatttccgtcttagtgttgactacttaatgaatatcgggttgaccatgaatgatctcttggccttcaaatggtattttgataacacccggccggaaattggtgaatttacaatcgcgttattgccagccaacgggcagcctaaaacggaacgtcggaccactgacttagccaccgtgttggacgaatttgctggttatatcttgttgaatcacgacggcaccatgaatcaatttatcgatgaacgtcatgataacaaagtcagcgattggcgaattctgctgtacaaaaacgaagaattccgcatcgacgtcacacctgatttaatctattttgatcaattagttaacatgacgattatgtagaccgcatgtaaaaagtggcttgtgaacggcgttttgagttcacaagccacttttttactgtcatactaatcaattctctctgctgctagtggcgtaatcaaaaactgaacctgatgattccgttcaccagaaacacgataggctggttgcacatctgcgccccagctatcaataccgccaacaccgcgaacggcacctaaaatcgagacaacaccgcgcctcacagggggtagctcattcaaatgcgtggctgcttcaagctccaacggcgaaaaaggcagcactgagaaagcaaacggttgcgcaagtttttcgattcgcagtccttgttgtgccaaatttttcaagaccaccgaatccgttttaatgtgcatccccatttcctgggggactaaatacggcgttactggcattcccgtgatatcatacgtaccaacctcaccaccgtgccagcggtctggatatgtttctcccgataggcctgtgtaggcgtacccttgcaatggcgtcggcgttacaaatcgtaagccgaacaccggtagttctggtaacccttgccgaccagtatagtgtgccgtcacctgtaatgttccggccggcatcacggtataactaacgtcaaccgtcgtttgcggttcggtcgcggtggtatacgtaaacacaatcgtcactgtcgtggcaaattgctggtcatcatagtgattattttgtggcgcaattggctgaccaatggtttgctggtcgactgacacgacaaaattggtaaccgtactgaattgttccgcaccaagccattgtgctgaccggcgcgagaaaccattcccccgatcgttatcggtcgtggcacgccaaaaggctggcttcgggccacggtatagccactcttgtccaccgaatcgtaacgactccagaccaccacgttcataactaaataaataactcaccgcccgatgatgcacgccaaggacaccatctccgtaaacaatacgtaatggcttagttgtcaaattgttcataatagtacgctacttcctgtaaagctggttttggttgacggtcagcaaagaataatccattaccggaaaactcgtaatccgaatggcgatcattgaagtcaccaccataacttaatacttgttcacctgttatggcgtcatgttgccaaagcgcctggtccacatagtcccagacaaatccacctgtgtaagctggcgactgattgtacagcgccatgtattcatcaaagccaccaactgaatttcccatactatgcatgaactcgcagtttaggtacggtttgaccggcttttgctggagatacgctaaaatgtctgccggagatgcatacatccgactttcaacgtcagaaatcactgcattgaattggcgattgtgaaagacaccttcataatgggttaaccgtgtcttatcgtgctccttatagaatgcattcattgcggcaatattttcacccgcatatgattcattaccaagtgaccaaaatagaatcgagacgtgatttttaaactgctcataattgctacgtgcccgatctagcaccacttctcgccatgatttatgactgcctggtacattcacagaaggctcaacggcgcccattttttgccaggtgccatgagattctaaattggtttccgccataacgtagacgcccgcttcatccatcatgaaataccaagccatttgatttggatagtgcgacgttcgcaccgcattgatgtgaaactttttaaacaatgccacatcttctgccatatcagccaccgtcaacgcacgtccacggcttgggtgccactcatgccggttcacaccatttaaaaacaatcgccggccattcaactgaatttgttgttcagccgttactgagagcgtccgaaacccaattctgtacggcacaaaggctaattcggtgccatcagccgcccgaatagtcagttgcatttcatatagtatcggcgactgatgcgaccatacttgtacctccgggactgacaactcaaaaatgacgtcatcattcgcaagtggacgttgggtcgtcgccaccacctgattatctggaccaatgacaaccgcttctagtcgtgcatctattaacccggcgtgttgcacagcaaccgtccccgttactttccccacgttgtcagtaacggttggcacaaaggacacatcttgtatatcaaccagtgcacttgcttctaaccagacgctccggaagatgcccgaaaagcgaaacatatcctgatcctctaagaatgccgctgtgctcaacttataaacagccacggctaaaaagttctcaccgggtaccaagtatgacgtgatatcaaactccgcccgactgaaactgtcttctgaatacccgacaaagtggccattgacccaaacatacatcgcctgttcgacaccttcaaattgcagtcgcaccgtacgattcgtaaaatattctggcacttcaaatgtccgggtatattcacccaccgggttatcgctagcttcgctaaaaataccgggataactcgtttcatcttcatcaatcattggtggtcgccgatacacctggccatcccatggatataacgtattaatatactgagtttgaccaaaaccttgtaactgaatatggcctggcacttgaatagaggtaaaattttgccgagcaacctgattctttggctcaaaaaatgccggcgtacgatgttgtggtgtttcaccataatgaaatccccatgtaccatccagcgactgtcgtaaccgctgtgacccatttcgataagccgatgccgactcatatacagtgtgatcactacgggcaggcaatttaccaactctaaaaaccgtcggatcatccaaccatgctaatgatgcttccataattcccccaattatgtgtaaacgctttcaaattatagtttacacacattccacaaaataaccacccggcgtcttatgacgattcgttacttaataccaaaacagcgcccaaactgtaccgacaaaatcggccgtttgagcgctgtttattaatcatttgtagtcagcttagtccgctgtaacttctgaaatttcaattgtatcgtcaaccaaatcagcttgcaaagccttagcatccaagtgatccaagtagaaatcagtcaccttgtcacgaatttgttgttcaattacacgacgtagtgggcgtgcacccattgcctcatcgtaaccttcctcaatcaaccaagccttagcagctggcgttactgacaaagtaatgtctttcttagctagtgtgtggttcacatcggccaacatcaaatcaacaatttgttgcaaatcatccttagtcaaatgtgagaattcgacgattgcattaaaacgattcaagaattctggacggaagtatggtgccaagcgatcattaagcgtttgatcagcagcatcgtctcccgtgagcgcttcattaccaaagcccgcatttgacgttgcaatcaccacggtattcttaaagttgaccgtgttaccttgaccatccgtcaaacgaccatcatccataacttgtagcagcaaggtcaaaacttgcggatttgccttttcaatctcatcaagcaaaacgatggcatatggttgacgacgaacccgttcagtcaacgtattgctgttatcatcatacccaacatagccagccgtcgccccaatcaactttgaaaccgccgtcaaatccgaatactctgacatatccaagcggatgacgtgttccttagatccaaacatatccaaagccaattgcttggctagttcagtcttaccagttccggttggaccaacaaacaagaaactaccaattggacgattaccttcatcgaagccagcacgattacgacgaattgcccgcgaaacagcttcaacagcctcatcttgaccaatgaccttaccacgtagacgttcgttaattcccttcaaacgctcaatgtccgaagcacccatttgggcaacgggcactcccgtcaaacgctcaacactttcggcaacatcattaaccgtcgccgtcacacgcttagcttcaccagcattatcaatctgctcttgtagcttatcgatcgtcatcttgtgcttagctgcttgctcatagtcttccttatcagccgcagcttgttgcaagtcacgttcacgcttgatatctgcctccaaagatacgacgtcggccactggattcttcgcagccaagtgagcagctgtcatatccaacaaatcaatcgccttgtctggcaatgaccgttgtggaatgtattgcactgaatagtcgaccgcggccttcaaaacattatctggaatttcaacattgtggtgttctgcatacaaatcgcgaatccccaacaaaatgttgaacgtatcttctgaactaggcgcgttgaccgtcacctcattgaaacggcgtgccaaggccgcgttcttcaaaatcgtgttacggtactcgtcttgtgtcgtggccccaataaccgtgaactcaccacggctcaaagctggcttcaaaatatcagccaaccccttcgaaccagaatcgccacccatggcacccgtgcctaaaatttggtgaatttcgtcaaagaagataatgacatttcccgcctctttaacttccttaatcaaattttggacgttctcttcaaaactaccacggtattgggtacccgcctcgatacttgaaaggtcaattgaaataatctctttgttgcgaattgaagctggcacatcaccagcaataatcgcttgtgctaacccttccactacggccgtctttccgacacctgcatcaccaactagcactgggttattcttcgtgcgacggctcaaaatttcagccgtttcctgaatctccttatttcggccaatcactggatccaacaaaccttcacgtgcctcttgtgtcagattacgaccaagtttagccaacatgccgtcttgcttcatcgcaccattctgtggctcaacctctggcaagtcattgccttcttgaccaggaaggcggccactttgtcgataagctgcaaactcttccggcgtcacctcacgcccgttgatcaaataacgtgagttctctgagttcaagccacccatgcggcccatcatgcggttgaaaatatcattcatatctgagttaaaagcgtcattgtaatttgccataagtttaattacgctcctttttacgtttattttttagtctaccaaggctgagacccctctctcattaccttgtaacattattatatacccgtgacaaactgattacaagtattttttagcactcttttgcatagagtgctaaaaataatcacaactctgaataatccttaacaagtacatgaaaaaaccggttgaatccaaacgaattcaaccggtttcggtttattttttgatttattaaacgacattcgctgccgcttacacgtgatatgacgatttcatgtcatttgattgtccagccaccatcaattgtaaacacttgcccttggatgtacgtcgcctccgggctcgttaggtacagtgttaaatctgcgacttcttgtggatcagcccaccgtttgacaggcgtgtcggctgcgacttgcgctgccattgcaccatcgccagcaaaatcggccgcattcattggcgtattaatggcacccggcgcaatggcattgacgcgaatcccctgaccagcataatctaacgccaattgcttcatccaccctaccagcgcatgttttgacatcgtgtaagcagcgccaccaccgccagcaacttgaccagcgatcgatgccataaaaacaaatgtaccagcctggcgcgctaccatgtatggtaggaccgccaatgatatttgaacagccgcatacacattgacctgcatcagttgtttaatggctgggtaagtggtcgctaatgccggtgtaaaggcatccagtacaccagcagttgagagcacaatatcaaccttttccaacagctttacatgcgttgttaaccacgttgccagctgttcttcatcggccaagtctagttgaaatgctctcaagcgcggatgatcaattgaaatgacttgtttatctaatgcgatgacagttgcacctgccgccaaataagtctgcatttgcgaaaatccaattccggaagctgccccagtcagcaaaatcgtccgccgttcataattttgagtaatcatttatttttccaaatcaacacgacgacttaataggtagaaaataattgccccaataatcaaagcagcaagttcccccaacgcagtccaagcaaatgttgcccagaatggtgtcttcgccataaagtataactctgcagcaacgacccacatcatcaaggcatcaataatcgtactaatcgctaaacgtttcacaacgctttttaccttgcgtgtcgcaaagtatgacatcgtcgtcattgctaacgttccagctgttccaacgatcatatcaacaatgccatacggcgaccaaatgttagcgataaatacaccaattgtcagtgcaatgatatagcgcttgttaaaaaccaccaggtgattaaacccttctgaaaagcgcaactggaatggaccatacgatgcaaatggtagcgccaccgtcgccacggcataaagcgcagcaataacggcaatcagggatatatcacgagctgaaaaagacttcttttttgtttccatcttcaattctcctagtttttttgagtgggatggttacgaaccactaacctacagaatagcaaaatgacacccgacaagcaagctacgcttttcggacagggttgctaaccccgtccgatatatgctactttaaagtaatactaattatttgtatggaggaattttatgaagcggttttttgaacgatcatttatcgtcggcatcgtcacgacgttaacaatggtcacaattattagtatttggaatgggacatgggtagcaggctggcatcgacgtaccatcttagctaccctaaccattgtcccgttaacgttcattttagccactttgctgaaagagaacgttacattgccactagtgattaaattacataacatcttacccaaatggttttcagaactcgtccctcgtcgacactctatggctattttcatcgtaactggtaatgtgtcagtcatgtccttctacggcctgtatatgtcacatcattacgattcacagcatttggttctgtcatacttcattcaatgggcccacaccttattattcgcaattcccttattattatttatcgtacgacctctaataaccgtcgtattcgatttaatttggcgtgaggatgatcctgcttaatgtaaatacatactaaaagaccggtctagtccaacaaaccggtctttttaagtcccaaaattagatttttatgtgattttttgataagctagttctcgtacatgtacgaggaggtcacatgaaaaattcaaaaaagaccaaaaaaatcggcctattccagctagtcatgcttggattaggttcattgatcgggtcaggttggctcttcggtgcctgggaagcatcccaagtcgccggaccagcagccattatttcctgggtaatcggtggtatcgttatcggtgcaatcgcttataactacatcgaattgggaaccatgttcccgcaatctggggggatgagtaaatacgcacaatacactcacggctcattgttaggattcatcgcttcatgggctaattggatttcgctcattacgctaattccaattgaatcagttgccgctgtgcaatatatgagctcgtggccttggtcctgggcaaaatggacacagagtttcatggccaatggcacgattacaaacgaagggttattagccgttttcttctttattgtcgtgttcacgttattgaactattggtcagtcgaattgctcacaaactttacaagtcttatttctgtcttcaaaattggtgtcccactattaacaatcatcatgttaactttatcaggattccatcctggtaattacgggtcatcactacatgaatttatgccatatggcacggcaccaatctttgctgccacgacagtatctggtattatcttctcatttaatgcgttccaaaccgttattaacatgggaagtgaaatcgaaaaccccaagcgtaatattggacgtgggattacttattcactattgattagtggtgtactctacattctgctacagagtacgtttattaccgcattgaagcctgacatgattgcagcaaatggttggcacggcattaacttcgcctcaccattcgctgatctagctattctactaggcattcactggctgtctgttttgctatatatggacgcttttgtgtcaccatttggaaccggcgtatcatttgtcgcttcttcaagtcgtacattggctgccatggtaaccaataaccacattccaaaattcgtcggaaaaatcaacgataaatacggtacgccccgtatcgcaatggttgttaatgccattttgagtatgctgatggtctcaattttccgttcatggggaacgttggccagcgttatttcaacgtcaaccttgattgcttacttgactggaccagtaacggttatctcattgcgtaaaatggcgcccgaattcacccgtccattccgtggtaaaattcttaagtttatggcacctctgtcattcgttcttgcttcattagcaacgtattgggcaatgtggcctaccactgtagaagtgattttggttatcttgcttggcctaccattctatttctactacgaatggcgcaatggtttcaataaaacgaagcgtgcctttgaaggtagcttctggatgattggctacttggttttcatttcgattatgtcttatattgggtcgaaggaattcaacggtcaaaattggatccattacccatttgatttcgtggtaattattgttggctctctcttgttctatcactggggaaccgtcagccacgtcatgacgaagtatttcaagcaagcgcaacgcgtgaacgcaaaggttaaatttaaaaaataatcaaaaaacctgatgactttaagatcatcaggttttttgtatattatcctcattaaccgcgccatttcgccaaatagcttgcagcagcctcaacatctggtacccgtaggcgttcaccagtaattggattcgcattctcaaagtgcaacgcaccgattaattcgccaaccgtcttcgatgaaacataactgtctttgcgataagaagttggtcgcacacgtgtatttaccggtccaaggaccaacgcattcacattaaagcgacctgccatttcaacagcatataactcactcaacatcaaaaccgctgcgccggccggtgcaaccggtccagaatatttgctaaacgcagcatcttcagcagacacgccactaataaatgtatagttcgaaccttgacgtaacaaaggcatcaacgtcttgctagctacaaagtgggctgtaagcaagccctgcatcaattcttcccattctgccttcgtaatatccgtcaaagcagcaccttgccaccatccacctaatgacgataccatgccatccaattgttcaaagtgatcaacaatcacatcgtgcatcttttgtgcatctgcttcatccgaaatatcgccaaataagtaaaagacattcttccggtatggttggtcaacataccccagcgcgtcaagcgccttgtcttcagagcgagtgggcaccagaacggtagcgccattttcggctaagtactttacaattccttcgccgaccgcgcctgtcccgccagcgaccaaaattactttaccttcatacatatcattcgcctcttcgttagttaatacaattatattaacgaaacgaaggccagaagtgttgtaaaaagggcatttcaagtcttaacattgccactcatcacgaatgacccgcaaaatcgcttgtgacatcggccccacttcagctcgatcccgtgacaataaatagatatcaaacgtcggcatatcaacgtccaaaatatcaatttgctttagcccggttgcattttgcgttagcgccaaagccgtaataaaactcatccccacaccatcgcgtaacacgtttttcaacgtctcagggtttgaggtttgaaacagaatttttggatgcgtgtcgctcgcttcggttaaacgtttaaaaatacggctatgcacaaacccctcatccagcatgacaaattcctcagcaccaatttcatcgaaatacatactgtccggtttcgtcgcatcgccagtcgcaaacacaaatggaaatgaggcaattttcgttgccgtcaccccgctaatacgtatcggatcaaccgaactaaccatgccaaaatctaactgacctgtcttaatttgggacattaaatcggcgctacccatttcaaccgtctccaaataaggtaatagttctaacacgcccaattttttaagtaaatctcgaaagtagtacataccaatgattggtggcaatccaaaacgcaacttctcaattgactgtaatgcgacttcttcttttgtaaaagcaatttctcgcctaattttgactgccaattcatagaccaattgaccggtttttgtcagaacaaccgactttttagtggtatctcggacaatcagcgccgattcgaactcttcttccaaacgttttaacgcatacgaaatcgttggttgggtaaccccgaattgttcagatacagccgtaaactgtttttgctctgccaatgccgcaaaataagttaaatctttcaagttcatccgaaatcccccacacttataaattatttttattataccatggttatttgactatatatttttataaggcgtaaggttgtcaacgttgagaatttattatttattttttgtagggagatgtttacacatgcgtggacaagaaattttgaataaccccttcctaaataaggggactgcctttaccgaggcagaacgcgaagaatttggcttgactggtatgttgccagcccacgttcaaacaattcaagagcaagctgaccaagcttatgcccaatatctaacaaaggttaatgacgttgaaaagcgtattttcctttcaacgttgttcgacacgaaccgtacgttgttctactacttggttgatcaacacgtcgctgagttcatgcccgttgtctacgatccaacaattgccgacacgattgagaactattcagcattgttcgttaacccacaaaacgccgcattcttggacatcaaccacccagagaacatcgaagcaacgttgaagaacgctgctgatggccgtgacattaagttgttggttgctaccgatgctgaaggtatcttgggaatcggcgactggggggttcaaggtgttgatattgccgttggtaagttgatggtttacacggctgccgcgggtatcgaccctgcctcagttttgccagtttctgttgatgctggtacgaaccgcaaggaattgttggcagacccactatacttgggaaaccgtcacgaacgtgttcgtggtgaccaatactttgagttcattgataagttcgttaagacggcgcaatcattgttcccagagatgtacttgcacttcgaagacttcggtcgttcaacggcaacgaagattttgaacacgtacaagaatgactggccaacgtttaacgatgacattcaaggtactggaatcgttgtgacgtcagctgttttgggtgccttggctattactggtgaagacatcaagtcacaaacgtacttgacgtacggtggtggttcagctggtacgggtattgctaaccgtgtcttggctgagtttatgcaacaaggtttgtcagaagaagaagctcgtaagcacttctacatggttgaccgtcaaggattgttgttcgacgatgacgaaacgttgacacctgagcaaaagccattcgcccgttcacgttcagaatttgagaacgctgacgagttgacggacttgttgtcagttgttaaggctgttaagccaactgttttggttggtacgtcaactaaccctggttcatttactaaggaagtcgttgaagcaatggttgctaacacggatcacccaaagatcttcccattgtcaaaccctacgaagttgcacgaagcaatgccagatgatttgatcaagtggtcagatggtaaggcattggttgcaactggtgtgcctgttgaccctgttacggcttcaaacggtgtaacttacgaaattggacaagctaacaacatgttggtttaccctggtttgggattgggtacgattgttgctagggctaaggttttgtcagatggtatgatttcagctgctgcccacgctttgggtggtatggttgatgcctcacaacctggtgcccctgttttgccacctgtttcacgtttgtcagaaatgtcattccgtgttgcggttgctgtggctaagcaagcaattgctgaaggtttgaatcaagttgaaatcgacgacgttgaagctgctgttaaggctgctcaatggacgcctgaatactaatcgcacataggagtcatttaagatgtctgcattgctaacttcaatctcatctgttgttgagattattttcgtgattgctttgggtttcttcctccgcaacggcggtaagtttcaagactcattcaagcacgatattgaatttttgattatgaaggtcgcattgcccttaaacattttcgtaggtgttttggacaacttgacccgctcaaagttactatccctttctggatcactgatttttgttattatttcttttgcttttggttacttggtagcttggctgttaacaaagattttgaaggttcgcgaaggccgtcgtggtacgtttattaacatgtttgttaatgcaaacacgatttttattggattgcctttgaatttggccttgtttggtaaccattcattgtcattcttcctggtttactacctagcaaacaccgtttcaacgtgggctattggtattttcttcgtttcgaatgacggaccaaagtctgacgttgcgcaaaagtttaactggaaaaagttgttacctgccccattgcttgggtttatcgttgccttgatctggttgctacttgatttgccattaccaacgcttgttgataagactttctcaatggtcggcggtgtcgttacgccactgtcattgatttacattggtatcgtcttggccgacgctggattgaagtcaatccactttgaccgtgataccatcgttgccttactcggtcgtttcgtctttgcgcctgccgtcatgattgttgtcatgatgatgttcaagcacaatatgacgatcccttctgtcgagcaaggaacgttaattatccaagcggccgcccctggattagctgttttgccaatcctagtaggtgaagctaagggtgatgttgaatatgcaacaaacgttgtcacaacgtcaacagtcttattcgtgatcgtggtgccaattttgatggaaatcatcaccctattgtaagactgaattcatttataccaaattaaccttttaaaccaatctcatagaataaacttgatgcatcgtgctataaacaactacacgaactagcagaacacttttacaaaacaaattgttgtttgctgttgcgatacaccaagcgattgtacctaccatttaaagaaatgtatggtactaaaagaccccgttgcctaaccagcaacggggtcttttttatcagaacaaatttttaattactaattacaattggccccatgcagacgatgcaattgatgggaacaaatgtaccatacgctcaatttcagcttgaccaaatttaaactcaatggctggcaacaaagcattaatgacatcatctgccttatgtgacacttccgttgcaccaaccagcttgtgtgcttgatcaaaaattaaaatgttgtcaccaatcttttcttgatcaacttggcggtaccaatcatctggaatgtgattttggaccatcgtgtacaattcaggattagcctcagcttcagccaccgttaccccaacctgtgccaaacgtggtgacgtaaagacaacagacggaattactggatacacgattggatctgtcgtttcaccggcaaacgtatgcatcaggtaaagtgactcaaaaatggccgttggcgttaatttaggttgtaccttatcaatcacgtcacctgacgcataaatatttggtaccgtcgtccgcaagtaatcgtcaacgacaattccctttgcattataactaacgccaactgtttccaagccaagctcttcgacattcggaatacggccagttgcgtctaagacccaatctgtttcaaccgccaaatcagcaccacgcacaactaggccatctgcgccctgcacaatagcatcaacttgtgtgtcacgatcgaatacaacgccacgtgatgtcaaatcagcaatgatttgttccacgaacggttggtggtaagcgcggagtgcctgtgtgccgcgcatcaaaacagtgacttctgcaccagcagcatttgccattgttgcaaattccattgcaatataacccgcaccaataattgtcactcggtttggcatgtcactcaaattcaagaaatctgaagaatcatgcgctaaatctgcacctgggattgtcagacggtttggacgcaatcctgtcgcaatgacaatcttgtctgccgtcttagcctcaccattaaccatcactgtgtgggcatctgccaacgttccacgaccaaacaacacatcaacatcagttgaatccaacaagccttggatgaatgctggcaaaccatcaataacatcgtgcttgtgcgcttgattagcaggccaatcaatcttaacgtcacctgttacaacgccgtgaacatcctccagatggcgttggaaagccactggtgaatctaatacaatttttgcgttgcagccacgatttgggcaggttccaccgaccaaatcctgttcaacaacaccaaccttcttccctttcgctcccaacggaattgccccgtcaaatgtaccgtggccactaccgatatacaacacatcataatcatacgttgtcataaaatctttcctcccgtggaaatatgcgattgtttagatataattgagctctcaaaatcaattacattatctagtatatcggaaaagtaagcgaattcataatatttaacctaatacaaaaagtcgaccttgattgatgacaatcaaagtcggctttcttaaggtttattatttgaatagcgcccgcgacgctagcgcaatcaactcagttaattcatcattagaaactgttaacccattgcgtaaacgtgattgcaataaccactgcatcggttgcaatgactgcgcaacaataatatccacattagccgtcatcaatagttgttgctggtatgcgcgcttaataacagttaacattgccggtcccagcaaagatccttccccctgaatctccgttggcaggaattctggattcgctaccaacgttgccataaaggcaacttgcttgggatgctgctcaaatgtttgtgcgtacgctcgcatcacgacttcgaattgttcttgtggtgtctggtcatcgtcaggcaccgcaatactccccactaataatgtctgaactttttcaaatagctgccccagtaaatctgctttatttgcataataaatgtaagctgtggcaaccgaaacacctgctcgcttagccaatttattaatactaaaattcgcaatacccgcttcttcaacgaggtcatatgtcgcatcttctaatgcttttattttattactgtctcttgttctcatactcttatattaagggagtttccctttccgttcaagcgtgaattcgacgccaaatcgcttgtatgacaacagtcaaaataaccgccgttaacgcgccagcgctatcaagcatcacatccgcaaacattggtgaccgaccacccgtcaaagactgatggaattcatccaggccagcataccccgttgcagcctgccacgcaatgaaagcagcaatgaaccaattaccgagttgtttatgaatagccatgtaccaagccattccaagaataaagtaagtgctaaaatgcgcaaacttacgcataaaaaactcaacatatttaaaataattttgcgatgcgtccgtcacatccccaccgtaatgaatcgggaactgagcgaaaacatcctttaagggttcgtttgccaacacatggtgcaacgtaccaatttgactctgttgggcataggtttgactactcgaataaaaaagcaccgccatgatcaaaaaggcgatgccataccaaatggtggttccttgtaattttctcatgctcatatgttactaagcttctcttggcgccgtcaagtgggcaaaagtaagtgcctcaactcttttctgataagcgaccgtcgacaatttcatacgtccgatctgcaaactcctgtaatcggatatcgtgcgtcaccacaacaactgctttatgctgttggtgtgcaatttcagccagcagttgaccgacctcgtttacccgctcactatctaacgcagctgtcggttcatcagccaaaataattgttggatccgcatatagcgcccgtgccaacgccacccgttgcttttgaccacctgacaattcgtctggatatcggtgcgtcatggccacgatacccagacgtcttaaaatacgctcaaacgttttttcagctacattaggcgttttctttacctgatcaaccaacttaaattgatcggcaaccgtcaaataaggcaccaaattgtatgcttgtaaaacgaagccaattttatcaagtcgtagtttctctaaatcgcgttgcgttaatgcttgtaaatcttcgttcatcaagcgcacctcaccttcagtcggtgtttgcaaccctcctaaaatcgtcaagagcgtgctcttaccagagcccgagggaccgataatcaacacaacttcactggcacggactgacatcgacgcatcctgtaacgccacgacttgattttcgccctgaccaaaccgttttgttacatggcgaacagctaatacttcctctgtcatgattaccctccgatcacacttgctgggtcaattttactaatcaaccgaattggtacgacggttcctaacagccccgtcagcaacaggcctagcgcaattagtcccgtaacaggccaactgatatacaccggcacggtagctggtaatagggttaaggtcatcacggccaatccacccccaatgaccaccgccgacagcacaattactcctgtttcgaatagtgtattgcgagtcaaaaaacggtttggtatgccttgcgcacgtaagaccgccaaattaggcaatttttgaatcgtcaaaatatataggaagattgtcataataatcatcgaaatgataaccaaaaagccgatcatcaagccaaacgtggctttttgtgccacatacccaggtagtttatcaatgagttgcttcgttgaatagttcactaattcacgcggtacattcggcgcatcctcgcgataaacggctaaacttcctgcataatcatttgaaacacccttgattgaagaccaagcttctaaatcaccgtaaacaaccggtgccatattgtactgcgcttgggcgacatagccaacgatcttataacgcgttgctgataagcctaatgtcaccgtctcgtggcgggggtaccgtgcatgatttaacgtcgtatcaacagcaatttcgtccgcatgctgtggcagccgaccactaacaacttgcaaccggtccttcacaaattcatttgcatgcaacccaataaactggactgactcacgatgtccggcacgtttcatcgttgtcggcgtaattcctaaaattgctgcgccacgcttttgctgtaatgaccgcgcttcttgctcagttaacaaggattgaccagcattaccatttgcatcccgtgtcattacggctgatttaatttgccaactctcgattgccactgtattttcacgtgctagtcccatcgccaatgcacagagcacaaagacgaggtaactaattaacatgacgaccgtgataactagcccgtatcgtattttctcttttttaatttcacgccaagctaagaacattggagcacctcctatgattgatagcgctatcatatcaatgagttgccgcttacgatactatcaaacgcgcaaaaacggcatgccttaataaaactgacatgccgtttttatttctttttatcaacctgatcgatgtatcaatctttaacgatcaatatgttgccgttgaaagcgcgcaatagcggctgtcacacccgcaacagccgcaacagccgcaaccattactgcgaccacttccactaccgtttgttttacaacagctgttgtatctgctaccgtttgacgcaatgtcgttgtcttgctctcagaagccactgtcttcgctgtaatgcgttctggtgtcgagacagatgattgactactttgacttgaacttgcctcagagacgcttgtcgcacgactcaatgacgttgccgcagcggacgctaccgccttacttgttgctgttgactcagtagcgacggtcattgcagatgacgcacggttcttagtcgatgacatcgcccggtcacttgttattgctgatgacgcgggcacactaaccgacgccgattctgttaccgtcgaactttctgcgacagatgtagacttcggcgcatcaaatgctgcgttatcaatttcacgtccgtgtgacgccaaatctacctttaaggcttcataatcatgcgcttgaccacccaactggccgcccgctggggccatcaaggttgaatttggatcatgattcaaccctaacgaatgccccatttcatgggtaataaccgtttgtaaatcaaccccttgcgtcgcaattcgagctggaaaaacatctgtaatcccatcaggcgcatatgttaacgcaacgtttggatcggaatcccctgttgccgtctcttgtttttcaactttaacagtcgccgcagctggatcgtttgtaacctgaacaacagttgcgccagctaaactattccaataggcagccgcttgagctgtttgcgcggggtaatcggccgaataggccactacttcgccttgtgaatctaaattactgtactcccaagtcacagcgtgcacagactgcccaaacggcagtgaagccactgtcagtgacgttgcaagtacaactttaatgaatcgcattgtttttctctccttgaaaactcagcatctatcatattacttttgttttgtaaggagaaagcgaatcgttttatgtaatcgcttacgatatataagtgtaattttgtcacaaaaaagacacttggcctaaagccaagtgtctcttgttaagtcttattattaagcttctcgcgccgtcatgaatgcacgcgtcattggcaaaccttgtcctgcaggtccctttgtcatcaagaattgaataacgtcaatgttacccgcttcaaatgacgccgcactaccttgcaaatacaagtcccatgcacgagcaaatggctcaccatgctcagcaatcgtctcgtcatacacgttatggtaatttgccgtccacgtttccaacgtcttttggtagtggcgtcgcaatggctcaatatcatccatttgcaaaccagcttccataatgtgtgtcacattttcagcaatgtttggaatataaccacctgggaagatatacttttggataaacggatcgacaccagcaccatagtgttgtcctgtgataccgtgaatcaatgcacgtccattaggcactaggtactcagcaaccttcttaaagtactcaccaaggttctcttttccaacgtgctcaaacataccgactgatgtaatgtagtcaaattgcatatccttgatatcacggtaatccatcaacatgacgtgcaccttatcttcaagacccaattccttaacacgctcttgcgttagggcatattgctcttcagacaacgtcacaccataggcatctaagccatactcttgggcggccgtaataatcaacgttccccaccctgaaccgatatccaataacttcttaccaggttcagcatgcaacttatccaagatgtggtgcaccttggcaacttgcgcttcttcaagcgtcatatcatcacgcgcccaataagcagctgaataggtcatcgtcttgtctagccacttattgtagaaatcatttccgatatcatagtgactatgaatatcttccttagatgattgcttatcgtggccgtgcatcatcttcgtcaaagttcccttaaacccactttggttcgttagaaaactacctgacttacgataagccgacgcaatcaattcttgaatactaccttcaatttcaatgtcacgactcatataagcctcagacaaagtcaacgttggcattttagccagcgtcttcatatccaattttttatttaacttaatgtggacctttgaaaggccctcgccatagttttcagtcttgccatcccagtatgtcaccataactggcatgtcaaaggcatttgctaaaagcttacttaaaacagttttttctaacatctctgcaatacacctcaactaaaattagatactaacgtcattctactcttttatttcggaaaacgtattaataatgtattaaattttacttatttggcattaatagttaagggcataacttatattagatgcccgacactccaaagtacaagccgtctggattggcgaaattaaagactttttgcagtcccatctcaactagttcccctgtctcaatccctagactttgcattttttcgtacaaagtctcaatatcgtcggaatgcaacatcactgatggcacattatctgctacctcaggggaattttctttaataaacgtcaaatcaaaaatgttaaacgcaaaagcgccatcttcactaggcgccatttgcaccatttctgtcgctcccatatcttggcgatcacgctcgacaaaacccaccgattgccagaatttcgcctcccggtccacatccgtcacatatagcatcacttcaacatcattattcatctctttagcctaccattccgatttttctaaatcataccataatggcgtaaaaaaaagcatctacgtcaaacgtagatgctttctttaagacttaaggtaaaatgcagattaccaagaagccttcttaacaccagggatcaagcccttgtgtgccaattgacggaagttcaaacgtgacattccgaactcgcgcatgtaagcgtgaggacgtccatcaatcttatcacggttgtgcatacgtacaggtgaggcgttgcgaggcaactttgacaaacctacgtagtcaccagcagccttcaaggcagcacgcttctcagcgtacttctcgacagttgcttcaatcttcttagccttagcgatctttgacttcttagccatgattacttaacctccttgaacacagtaacacgacgcaactttggagagtacttcttcaactccaagcggtctggtgtgttacgacggttcttagaagttaggtagatacgctcaccagtttcggcggcttctaacaaaatgttaatgcgcattaacataactccttgaatttaatttgtgaggtgcccctcaccactaatttgaacgacaggattagctgcattgggctaatccccaagcttgcgccgttacaatatagctagtaaattacaaataattatattacacagtttgttcgcaaatatcaagtgttttgaccaaaaaagtgacaagtaattttacttgacgcatttttagtcgcccaacaaacgttaaataaatccacaggatacttaaaaagccaccaatcctcagctcttgaatcaggaaattggtggcttttatgagtttaattaatctgtcacagtagctgtttcgtcacgaatctcaggcgtatcatcaatgacacctgaatctccgcgcaacacaaccccgccaaacttcttaacatccaaaaccatgttaggaatcatgtagtcctttgagtaacccttgattggcaatggtccgatgtttgaatcgattgtttcgtcgaaccatggtaacaaaggttggtcctcacgaataatggcaaacacgaatgaaacttgcatggcaacctcaccgtggtgtgaatatggtgagacaccatcttcatacatcatcaccaaacgccgaccaggctcggccttcaaaatagggttaatcttctccaatgcagcatcagtaattgtcaaatacatgatttcttcctccttcagattttgtctgaattcattcaatttaattgtttcatctctttcaacaattaaagtatagcaccctgaattttgagcggttgaaaaaaggcacacttctgtcacgatacctgattaccagagatcatcagtccgccaagcgcataaaataccaactcattaggccaaaaccagctgataagacatcaagtgctaggacatcaaagaaccctgccaatggccagcctaatagtggcacaacaaattgcaagacatggaacaaaccgaaaagaattgttagcaacttcaacccattagctaaagaatccatttcgcggcgcacactagcaatcgcaacgcgccagagcgaccaaataagtacaatcaccaagccaccaaacacaacatcacggacaattacgccacgtgctaacactgcctctgtgatcgaattcaacggccaaactaactgtaaaatagcggctgctaaccagacaatcaataattgttgcattgctgcagacaacgttttgtcttgctcataccgggcaaaacgccacacggcaaccaaggttaatagtattaatagccccgccactaactctaacccgtgaaagccacttgcatacatcgcatccggggcagtcagcaccgctaatgggtatttcgctaatttataagtgggccaaacaaatgttgcgataacactctctaacattaaaataatcgcgccaattaacccagcgcctaaaacaaattttcgttgccaccattgttgcatgctatcacctcgtttaaatcaatagttccattgtacaaaaaacgttcagatgcgcctagcacctgaacgttttcttgtcgtctcattaaggtttacttcattttagttgtccggatttcttcaaactggccgtcaaagacgtttgttcgattggctgaggcccccattttatcaaatggcgtcacatgatccgctttaacaacaacgcgcttcaaacggtgcttaccgtaaaaccaaaagccgattgctgcaattatcaaaattgttagcatttaatgtccccccttattcatatacaaagtatacctggcgaaccttaaattttacttgcctgcttgtgccttaagacgttcaacatcacgggcaatttctagttcttcattggttgggactaacaacacagttgcacttgattcgggtgttgagataatacgctctacaccacgaacattgtttgcttccttatccatttcaatgccaaggaactttagacgcgcaataatatcctcacgcacattagcggcattctcaccgataccagctgtgaagacaataccatcaacaccacccatttcaaatgtgtactggccaaggtagcgcaccacacgattcaagaacatatcaagcgccaactttgcgtgttcatttgtatcagccacttcttctaagtcacgcatgtctgacgacaacgtcgaaacgccaagcaaccctgacttattgttcaaaatacgcaacatttcagcgtttgaaagaccctcacgctcttgaatgtagtaaatcaaagatgggtcaacgtcacctgaacgcgtcgccatcatcaaaccagccaatggcgtgaagcccattgaggtatcaaatgatttaccatctttaattgccgtaattgatgctccagcacctaagtgcaacgtaatcagctttaagtctgacaatggcttgcccatcatatcagctgcgcgttcagcgacatagcgatgtgaagttccgtgcgccccgtacttacgtgccccatacttcgtgtagtactcgtatggcaatgggtacaaatagttttcacgaggcaacgtctggtggaatgccgtatcaaacaccgcgactgaaaccgcgtcgggcaagagttcttggaatacttcaattcccgtcgcattcgctggattatgcaacggtgcataatcagccaaacgatgaatcttatggagtacctcatcgtcaacaatcactgatttgttgaaccattcaccacctgccacaacacggtgaccgacaccggtgatttcgctcttatctgcgacattttgtgtgcggaactgttccagcatctcttcaatagctgctttgtgatcggcaatgtcgcgcacaatttcagttttttccccattaaacttcattgtaaagacactctcaggcaagccaattcgttcaacttgtcccttcgcgatgaccgtttcggccggcatatctagtagttgaaacttcaatgaagaagatcccgcgttaattgccaatgtttttgccatatttcatgtgctccctgttcgcaatggatatcatccaatttattggactaattataacatgtaagcgttatcatgactagtccattccagaaaatgctgaaggattgacaatcaaaaaaagccaggcaggccattaataggcatacctgacttttaatcaacattgattacttgttattcaattcaataatcttcaaaattgtgtcaaccgcttggttcatcacctttgttgacacatattcataacgaccgtgcatgttctcaccaccagcaaacaagtttggtgtaggcaagcccaagaacgtaatctttgaaccatccgtaccaccacgaactggctcaataactggcttaatatccaatgccttcatggccgcttcagccaaatctaccggcgtcatatcatccttaagaatctcacccatattgtagtattggtcattcatctcaagcttaatacgctcaagaccgaactcaccattcatcttttcgacgatatcacgcaaaatttgcttacgttgctcaaaaataacgcgatcgtgatcacgaatgatgtaagccatttcagcttcttctggcgtaccagtcaacttcaagatgtggaagaacccttgacgaccttctgtcaattcaggacggtctccggctggcaaagctgcgtgcaaatccatggcaacttgcaacgcattgaccatcgtgtccttggctgaaccagggtgtacgttacgaccttgaatcttgattgttgctgcagcagctgagaaagtttcccattccaactcgcccaatggaccaccatcgaccgtgtaagcaaaatcagcaccgaattcagccacgtggaagttatcggcaccaataccaatttcctcgtctgggccaaagccgaacacaaccttaccatgcttgatatcagggttagcaatcaagtattcggctgctgacacaatttcagcaaccccagacttatcgtccgcacccaacaaagtcgtcccatcagacgtaatcaacgtgtgacccgcatacttcttcaatgatgggaaatcagctggtgacaacgtgtactcttcgttcaacttgatatctgattgaccatcatagttttcaacgaattgtgggttaacgttttctgagttgaagtcagccgtatcaacgtgagaaataaacccaatcgttggcacatcagcatctgtgttcgctgctaattcagcaaatacataaccgtccgccatagtacgaacgttttctagtcccaagtcctttagttctgttgccaaatcagccaaaaaagcaacttcctttggatctgatggcaccgtcgtcgactcttcgtttgaacgcgtgttgacctttgcgtaacgcacaaaacggtcaattaagtttggatatactgtttctgtcatgtctattacctcttatctatattaaatatatgtgtaaggatcggtgttctgcgctgaggcaaagacatcggtcagttgccaaccattttctgtttgccaagttttcactaggtcgactaacctgtccttggcaatggcctccatgtgatgatctggatcaatcacgacaaaatcatcagccaatacatcgtgagcggtatggtagtaaaaatctgctgtcacataggcatcagcccccgctgccaatgctgccggatattcgctacccccatcgccaccaaggacagcaatacgcttcaactggcggttcatatcattggcgataacgcgaacatgggctacttggaataagtcacgcacaaaggttgcataatctgcaaccgtttgtggtgttgccaactcaccaattcgcccgagacccgtttggccatctggatttggaatgaggggcttaacctgttccagttgcaaggcactggccagccaatcattcataccacccgctgctgcatctaaatttgtatgcgccgcataaacgacaatgtcatgcttaatcaaatcagcatacatccgattctgcggtactgacaaatctaaattcttcgccggacggaaaatcattgggtgatgggcaaaaatgaaatcaacgtgcttttcaatcgcttcttgcacaacttctggtcggacgtccaatgcggtcatcaccgtctgaatttcttgctctggatcgccgagttgcaacccgattggatcgcgttcccaagctaattcgcggggagcataagcttcaattcgtgcaattaattcttttgccttcattctcccaagacctccccaatatcacgttgcatcgcttgatactcttgataagccggggtgtcctgcttattagcatcagctaacttcgccataatcacaccaatgcggtcatattcacgttgccacttcgttagccacgcctctggtcgattaaccaagttataaggaccaaattgtagcgcttgcttatcgtaagttacatgacccggtaccgcaaccaaaatttcatagaagtgaccatcatcagccacaaccgtttcgtcggttagctgataaccgttatccatcaaccatgtccgtaccacatcaatatcaatattaggttgcaggatgagccgctggtaacgttggacatcggcatggccagccgttagaatctgggcaattaagcgaccacccattccagcgattgtgaccgtgtcaatcaagtcttcgggttgaactgccgccaggccatcagccaaacggggcaccaacacatcccctaaccgatgccgattaatttcatgttgcacattatctaacggcccctgcgcgacttcacctgcaatcgcaaatgaaatccgcttgttcagcaagagatttgctggcaaataagcgtgatctgagccaatatcagccaggcgggcaccgtcgggtacatacgacgcaaccgtcgccaaccgtcgtgacaattgcaatgcatccattcgcatgtcctcgtttccattaagtttattacaaatatattagcacaaataacgccggcctgctaacaggtcggcgtttctcatcatttttgtttaatcttcaattttgatgcccgatgtttttgtaacttcggtcttcggcaacaccacgtggagtacaccattcttatacttggcagtgataccttcccggtccacatttggtaagtagtatgatcggccaactgacccgaaactacgctcagattgcaaaatattaccatctttgtctgagtgatctttaatttcatgacgtgtggccgcaatatgtaacgtatccgcttcgtaatccaccttcacgtctgccttatcagcaccaggaatatcggcagtgacttcaaagcaatcatccttctcaacaacgtccgacttcatatcagtaccaaacgtttgtgagcgtaccaatgacgcatccattttatcaagcaattcccctagcgtttcatgtcgtcgacgtaacaattcatgtgccatgcctttagtcctccatttttctaacatgtttacccttcatttttaacacgtcagttaactcagacaatagcgataagactcggcttcacaaactgtttaacttcgtgacgtagccatggtgtttgtgtgaataaaaaagcccataccgcaaagtatgagctaaaaatttataggcccttgtcttccttaagttggtcgtaaagttcggccatctcgtagtcgtttggtgccaattgtgtgtagttgaacaacgcctcttcagccaatgctgtctcaccttcttcacggaagtagtagtaggctggcttcaagaagttaatgttatccaagaagaatggcaaagcggcgttccagtacttcgtagccatctcgaagtcctccaaagccgtatagctttgtgccaagttccagtacaattgtggatcagtttcagaatcgtcttcacccaagaacgcgttcaataagttaatgttcccaacgtgatcacccatggcaaccaacaagtttgaataaccaatcgtcaacgtcaaatcttctggattattctcaagtgcttcacggtaaatacggtcagcttcttcatcttctccttggatttgcgcaacggctgctgctcgttggtaaagcgtggtgttaaaggcgtcgaccgcgataccagcctggtacgtaatcaacgcttgttcttgatcatttgtatcttcatacaattggccaagtggttcatacaaccccgcgtatgatggatcgatttcttgcaattcctccagggcgtcgatcgccttgtcggccgtttcagggtctgccgcgtatgtcattcccaattggaaacgaacatctggcgtcaaatcagtcgtcttgatttgctcaaggtaacccaaagcgttcttgaagttacctaccagtgcgtaagccacaccaattcgtgacgcaatgtccaaaccagagaagcgacgctcaccggcttgtagcaactcacggtagaacggaatggccgtgttgtattgcccagtcgcaaagtagaactcggccaaggcaaacttaatgattgactcttctggtgccaaatcataagcttcacgcaacttcgcttcagccgcttcattcaatccttcagactgatacaagtcggctagtaccaacaatgattcaatgtaagcatttgactctggagaaatttcagccaaataagcaatcgcttcatctgtcttatcctcgtcaatcgcaatatcggccaacgccgtacgcaattgatcttcatccggatacttctccaacaacttctggtaagcacgcttcgcttggcttgagaatcccaaaccatatagctcctcggctagtgagtaaactgtgtcatcgtcatcataacgcaatgatgacgcaaatgacttctttgcatcctccaattgtccaccagacaattcatcaagcatgcgttctgcaaatgttgccataagtaccactcttccttcttgtttaaagtcaacaatttatcatacagaaaacgcgccaggattgccaataaaaagggtatcctgacgcactttggctactttgtttctgttgccgtcgctttcgccttagcacgtgctttttctagcaacgcttgacgtgccgactgcttttgatcacgcgttacagcacccttagatgctgccccacgcgcgaagtcatttgacttaatggttcccttgcccattctgacatacctctcttgtataacacgttacttccattatacaagtccaacgtgcttacttcaaagatttgttcgtcaaagcaataacattcgcaactgaggcgcccttcactgtcttggccttaatctgaacgtcatccccagcttgtagcaacaatgctgtctgcgcctttgatggatccagcgtaaagagcgtgtcatcatcaactaacttgaaaataacgacttgtttatcatcaagcgtcgcatttgcattgacacgtgccacctttccagtgattgtttccgtcttaatgctatcatcgttggcgctggccgtttggacactacccgctagcgcatttcggtaagaagccaaggcatcggcagcattcgccccttcaccaatgacattttggtccgcccccttaatgtacgcatactcgcggaagcgttcgttttgatccatcatcgacacgacccaagttggcgtgccatcaatgttcataatcactgggtttgagccgtgccacttattctgaggatgcaattgcttagcaaccttcatcgccccatccgaatccataataccgacgttcttaccaacgtagaacgtcagatcaccagtccgcgtattaatcaacgagtaccccttatccgaatcagcgttcgaggttaccgtcgtaaagtcatcgaaatatgagattgaacgatcgttattaaagaccggtgtcacaccactttctgacccgttttcagtgggcttgatttggttcttgtggcggaaattgaaggcgtatggattaccatacgtacggttcatccgtgtggctgcctctggggaaaccccagcgtccacccattttggtaggtctttagttgcataaaccgtcgtcttacccgtgtccgcattggtcaacgacacgtgaatgtcattaaacaccaactgacccgcccaacgaacattcagcagggtttgtacccaatatggttgcccattgttatcaatttccaaaattggttcaccaacttgttcaaacttcggattgcgcatataaattttgcgagcaatattatgtgagaaccagctggtttcagaataatccaacttttctttgacaaagtgagctgtatcgttaatgtcagtcgctgaaataatgaaatatcctggcaatgtgcgattcataaaccatgacataaacccagcgaattcgactggtgccacgtaataaggcttgccattaatgtactgggctgacaaatcccccaaacgatacatggatgaatctggcacttgtgaaaaagccttcttcatcatgttctgtgacgcttgcgctgagagcgcaattggctgatcatctttcgtcaaaggtgcttcttttttcactgttgctttaacagaatcatacattggccgcacagtgactgcctgcgaaataccggccgctaatgaaatcacaaacgcgacaattggaatcacaaacggccagatggttaatcctgcaaaactaatacggctgccgcgcttagttacccgttcaacaacttgtgctgaagcacctgcaaacagtgtccatagcacaagagccgttgtttcaatagccactggactcactaactgcgagagtgttggtaccggcatgagccaatacacataaatcgcatttagaaccgtcaccgcaataaacgtccaaattgttagtttagaaatcttgaacttaattgcccagactaacgtaaccaacgccgttagctcgagcaccagaaatgatgttaacatatcctacccctaatccatgtaataccttaatactaccgtagttcagacgtggtgcctagacagaaaaacgccgactatttgtcagcgtttttctttggttacttattctgaatcgtgttgtgacttcaggtttagtttaggcaattctgcatgttgatggccgaaatccaactctggaataccgtgcgccagcatatgggcatttcggtgttcaaactgcgcatcttcccacgccgcatcaacttcctgccatgaacccgtttgtgccaaaatctcacgatatttagctggcatttgttgcgcgccaatggccaccagggcatctgcatgcgcttgtaatgctggactaaatgctgcgtgtggttcagccaaccaagcaaacaggccaattgtttcaatttccaacggggtataatccgtttcagcgaccgtcgtgaatgtatctggttcaaggtgcatcgcttttggcgcaaccaacatttttggtgcaacttcccactcaaagaaacctggcacgtctgttgatggtgtcacgcggttgattgtcacaacccctaactggtagcccagcgcaagtcctaaggtatactcatccggcaatggttcgtcgccagacaccattaaaaattcggccacatcagcggccggttcgtatggaaaagctaacaacgcttgctgacctagcatgacatcgttggcaattggttgtggcacaacaagagctttcattactcattcctcaatctgtttcagttttaatcttcaaaaagttccgccaagcggttcattaggtaggcttccgccgcttctacggcatcttctaattcctcagcatcatcttcagtaaaattgccaacagcttcgcgattatgcaaattacgaatcgtcaacaaggtggtgcgttcaccatctgataaccccgtatgcagattctccaaggcacggctcaccatgtcatcggtggctggtaattcagcaaacactaaaaatgattgcataatcttacggcgctctgattcatattcagcgtggatgtcttcttccgggcgttgggctttggcaacttctgccgtttcacgctcagtcacttggtctaggtacaaaaccgtccctagctctatatcaaattcatcaaacgtcatatcaacctcctgtacgttgctgtggcccttattgtaacatattcacagaagtaagttagccagccaaactagtaaaaacgttaatcgaagcgccacagccactatgatacaatgagctttagttaaaacctcgggggtcctatgatggtgatggaaaattattttaaagcactgcgtgaaaaaatcggccatgatgaaattattatgccaggtgtcgccggtgttctattcgatgccacacgtacaaaagttttgctggaaaaacgtggtgatggtgaagttggctggagtttggttgccggcatgcaaaacttgggcgaatcttcggtgaccacgattattcgggaatttaaggaagaagccggcatcgatgtggcggtaacagccttaatcggcgttgactcaaattttcaccacacttttccaagcggtgatcaagcccaaataccaatgaccttgtacgaagttaaacagaccggtggtgaactgcgcgcggatggggatgagaccttatcactcgcgttcgtcccgctagctgataatcccaaaatgtacaacgtccaacaccaactagtcatcgaacaattacagcgtcaggcaccttatggttggttcttctaataactataatcaactgccaatatttttagcacatcaacaaaaggccagcccagaaaattctgagctggccttttcattgatagttaatctattacctgaccaatcgttgccaatacattagcccggtaatctgttgacgtcgcatttaattgacgcatcttgtaataggcatccttataatcaaaatcaccatggcgcgttgccgcgtaaaccattaacaagttgcaggcgtcagttaacgagtccattggacgcaactcgccacccgcttctaacgtacggatgtcggtcatatagtcttcgtgatcaaactcataccacgtctgcatctgcaacaagacaccagttgcccatccttcttcgcggacaatcgaagacatcgtttgtcctgctcgcatcttccgtaaaacattattaaatcggttgttcacattcagaatacttgtcgcaattaatgccatttatcattacctctaaatcaaaatctttctgaatttatcttaccacaagtttgtgaaataaagaacaataaatacaacaaacagcaattgaacgcgcttacaaagcggtttttaattgtgaaaaccttttcattttgtgattagtccgacaaaatgaaaaggtgtctggcttaaaatcagccagacaccttttatcacagcagttagtgggcacgtcagcagtctaaaacccaccgacattcccagtccgctttattgtttacttatcttctgccaaaaaggcatcgatttctgctggtgaatcaaccaactcaacgtgaattaaaccacgcttcaattgtaactcggtttccttcgtcaatcgggttgcttgcttctttgctaacttctcatacttcttcatgagacggcctcttttcatttaatacccttattatacacgaagaagcatactcttaattttcatttgttcgatgcaactttgcaaagcacgtcatcacccagtgttcaacatcagctgctgccgttgaaaaggtcaccgcataccaaacgccgagcaccaatgccatcaaaccaactgtaaacattactgaccacacaccactaatgcccatattagggaaaacaaaataatccagtaacataaaaattattggactcgcaatcaccagggttaaggtcatcattaaatcattttcgtgttgggtccgcgctttgtcggccgccacgtacaaatcgtgagttaactcatgcaacccagttgccgtcaaaatctgtacctggtcctgtaccgcaatcggtaaagcttgcttgatcaaaatagcagccatcatgctatcacctgcagcacgtggcgccaagaaacgtgcgcggcgcttaggtagcatcgcgtacaaatccgttgcatttaatttttcagcataaataccatcttcattttgagcaaatacgattatctcgtctgccaatggttgtacaacaaaaaacatcgcacatacctccatcactaagccgttaaatttctctccgagggaccattattcccctattcactaacaaaagcaatgcgtttgttctagaaattccggtaaagcggtttcattggtttagaccattctatatgtcagacgactacgtccatccccgagtttcgtaaccaccatctgttgctgaatttggcgtttcattgattctacgtgcgaaatcacaccaatcaagcgaccactttgctcgaccatcgagagcgcttccaaggcctgattcaatgtgttactgtcgagtgaaccaaatccttcatcgataaacagcgcatcaattttggcaccaccagctcgacgttgcacaatctctgccatcgacaacgcaatcgacagcgccgcaataaatgattccccacctgacaacgtgcttgtcgaccggactttgccaccatcttgatcataaatatcaatatctagtccattctggttcgcccgtcctgcctgccgacttgagagcacaaattggtaccgaccacctgataaggtaccaatatagtgttcattcgcataggttaggacctcatacaggaaactacgcaagacatatggctccaggcgtaagtgtaacaaattgttaccgtcgaccgcctgagtcaatttaatcaaatcagctgactttgccgtgatggcatcaatgtctgtttgcaatttcaaaattgtagtctgttgctgttgcaaagactctaagagccattccgctttgtttaaacgttcagttgcttcatctaaagccgtttgtttttgtgtcaattcagcttgtaactgtgacaaatctggccgttcttgaccagcagtcaacgctcggctctgcgcaatggctgtcgcgaccgtctgacgttgtgtgtcataagcagccaattgccgttctaattggattaattcatccggttgattctgaatgcgatctaataacgcctgtagtgcctgttcatccgcaacggggccatcagtaatcgcaattcccaggcggcccttcgcttcatctaatgccgtctggtacgtattttgttcttgatttaataccaaacgtcgttgcgaaagctcttgttgcgtttgttcggcggaacgaattttctcatcagcgctctgaacagcttgttgataggtcgcaattttttcagtcaacgcctgttgttcaacctcataatcactgactgttgaaagcggtccgtccgaattcaattcgtgttgttcactgtcattttcagccagctgcgtcataatgcccgctaattgcgtttgcgtccgtgctagattcgttttaacagatgcaatctcctccgtcacagtcgctaatgtcgctgtcagttgttcttgtttagtaacctgatctgataggtgctggcgaacttgtgcgatgacagtctgtacggttgacgtatcatacgtgtctggcaacaagttgtttggaaacacggttgcccatgctttgaaaaactgattatactcactcgcaaatccgtctcgttctgacgtaagctgctttgccaatgtatcgtactgttgtttggtttgtgtagcgtccgtcgtcaaacttgcttcagtcgcgattgcctgttgctctgcagtctcagcctcatcaacagccgccatagccaccttaatttcagcatacgaggtgctaccaacgtgtgggtcagctccctcgcccgtataaatctggccacaaaccatgcaagcttcaccaattttcagctcactatgaagttgtttaatcatgagttcccggcgcaatgtcgccttcgcttcacgcatcgcgatgacatcctgcagattagctttagccgtatctagcttacgtgtcacccgcatcaaattctcagcctgttgcgcgacctttttttcagtttgttgcagacgttcatcggtccgttgtagctcatcagcttgggtagcaaaaaccaacaattgctcacgcgatgatgaaacagacgctactgtcgccaaagacgtttgtagcgcaacttctttggcagttaattcagccaattgcgtctttaactgggcttcgttagtttgtcgtgtttgccgttgctgggccaactgagtcgcttgcgtaatcagcattgccagacgttgcgcattaggcaacaaagtccgtgtaattgtcgtcaaccgtgcttcagcaatcttaatatcagctgcttgtgttaaaagttccgctttcgtagccgtcgcctctgacaggctatgggttgtggccgcttcgcgtgtcgccagctgtgttaattcagttgccacccgcgctatttgttcttcatatcgcgtcacatcattcacgatactttgctgttggtttccccactgcaatagcgtcgcttgctgccgttgctcattaatttgatcggcttgttcatcaagtagttgttgctttgccgtattttcagccaacaactcaaattgacgatttaattgttcggccgctttcacccgttcctgcgattgcgccacggccgttgttgccgtcgccttttcagtttcacgcgccgtcaccaggtctgttaaacgcgcaatataagcagttaaagccgtgattttctcaacggccgtcggtgcgctatctgcaattgctggatcatcccacgaaatttgtgacaacgccacatcccgctgggtctcaagattcgtgacttgttttaacgtgtctttttgttgttccttcaacgactccgtgaaccgattaaaaacttccgtcccaaatagactccgcaaaatggtcatcttatcatcgctctgagcggccaaaaattcacggaactgattctgtggtaacaaaatgattttgcggaattggtctgcatttagatgcaataattcttgaatcgcatcccgcacaaccggaattttctcgcccatcgccgcgataggcgattgtaaagtttcgtcaacctcagtcaatgacacttcagctttacgttcagtggtatcatcgtcggatttcgcaccacgctttttctttaattgttgcgtcggtttgcgactaattcgatagtatcgtccgttatgctcgaaccaaaaagtcacaaccgtctccgctgttgtgggcgcaaattcactgcgcatttcctctggcttacgttcactggttccttcaccaaacaaggcgtaggtcatgccatcaaacattgttgttttaccggcaccggtatcgccagtgatcaaaaacaatttcgattctgtaaatcgctcaaaatcaaccgtcgtttgttcgtagggcccaaaatattgtaacgctaatttaattggacgcatctttatccctcttcctgttgtcgtaactgtactagtgtatctgcgataacacgttcttgcgctgcggttagtgattcttgtgtgacttcttggtagaaggtcgcaatcaaatcatcatcggacacatcatcggcaacgacttctggaataacctgatcaaccatcgtgagcgccggtaagtcatactgcacttcgacgacatccccataaatgtcaaccaacgttgcgcgtgcattcgttgtgtgtgcaacgccctgaatgcgaatactaaaaaagttggcatgatttctagcatactgttgataaaattcaggacttatcaaagtctcaaacggtgctgataggacaatcaaatctttagtcggtgtaattgggtgccaagtcgtgtggaccgcgtcgggtgtgatatcaacaataaagacccctttctccgtttgtgcttccttggtattgaatttaacaggcgatccagcatactgaattgttttagtaggactagcttcgcgtaaatgcaggtggcctaacgccacgtagtcaaatgctgaaaattggtcagcagtgatccccttcaatccaccgacgcgtgaattcgtttcactagtaaattcatagtcttcattacctgcgcctgtcacataataatgggtgaccaaaatatgttgcttgtgtggatcaaatgttgccaccatatcttgcacaatccggttcataacctgttcaatactttggtacgccgccaattcgtcttctgggatttgataataaacacgcgcggttgttggttcgataaatggtagtaaataaatttgcgcttctggcgtttccactggtttaaatgcacccgctagcgttgtattaaggaataacccggtttgctcacgccactcatggcccgctcccagacgtgtcgcaccgtcgtgattcccagagactgcgtaaatcggtaaatgatgggtcaggttcatttctttcagcatccgctccaaggccgtcaccgcctgtgttgatgcaatcgcgcgatcataaaggtcgccagcaataatgaccccgtcgactttttcagcaatcgcaatgtctaacatctttttaaaagcagcttcctgctctgataacaaactgaagccacctaattctttaccgatgtgccaatcagctgtatgtaataatttcatgtgtctctcatttctcaaatgaaaaaggcgaccaaacacgcaccgcttgtttgggtcacctttcagtgtcttacaatgtgtcgacaatctcgtcaaacttttcttggataaagtcacgtgatgctaatagcttttcttgctcatcagttgttaagtctagattagcttctgctaacacgccgtcacggccaatcaccgccgggtatgacaaataaatgcccatatcatcacgtcggttcgaaaccactaattctgcgtgcgcatcagccatcacagcttttgcaatccgaactgcagccgttgcgacaccgtaactcgtataacctttgccgtttaacacggtaaagcctcccttacgcgcttcggcttcgataccggccaaatcaatatcaccagcatcggccagcttagcaattggctgaccaagcacttgcaccgttgaccacgcgacaaattgcgaattaccgtgttcacctaagttatacccggatactgaacgagggtccaagtcaaacgcctcacccaccgcacgttgcatacgtgccgtgtctagcaaggttcccgtaccaatcaccttatgtgttggaaatccagtaacttgctggaataatgcggtaataacgtcgaccgggtttgaaatcacaatcagaaccccggtaaagcccgattcttttaaattggtccccaccgatttcaccatactactcgtaaactttagttccgcaaatcgatcaccgcttggattgtcctgctgtaacttaatgttccctaacgtcgaaatcacaacatccgcgtcttccaacgctgaccaatcattaattgtgatattaccatgcatttctaaattagccatcgcatcttggaagtccagttgatccgccgttaccttacgctcgttagcgtcgataaatacgtaatcatctgcaaccccttgtgcaattaacgcgtgtgccactgcactaccgacgttccccaacccgataattccgactttacgtgccatatcatcctccaaagttttaataatttcattataccgaaaacggccattgttctccaccgaacaacagccgttacctttatgctttaaataaatgtttcgttgccgccatcaacaatgcggctgcaatcatcaaaaccaccaaaattagataaacaatattctgaatttcgccagctggatttgccgtaaaggccatcccgtaaagcatcggtccaaacgcagacatgaagtagccaccggcctgagccattccggatagtcgcgcagtttcaactggtgaatccgtcttcgcagcaaacatggtcatcgtgtaaaggaagaagaacgatgtcgcaaaaccaatcaagacggttaatgtccaccaatatgccagtgatgacgtatcctgattaaacaacatgattgccccagccagcgacagcacacccgcaatagcaattgccatcatcgtcccacgacgacgcatgtgaacaagaatgtttggtacaataatcgaaattggcataccgataaatgagtaaaatgacataataactgaaattgcccctgctgacacgtgatgatgagccatcatcattggtaaccaagcaactcccgtgtaattaatcgtggcctgaaccccgaacacaatcaagaaaggccatgcccgtacattggtccaaatacgcttcttaggcgctatgacttgtttttcagtcgcggttgttttcactttttctggcaccaaccgtgccgtatagaaccaaaagcccaaaacaattgctggcaatagcaccaataaccacatcactgcatgccaaccgaacgtcgcaacaaccggtgcagttaacaaactaaatgcggctgaacccaccataatcgtgagtgagtagagtgatgtatagaccccgactttatgtgaaaaataagcagccacaaacgaaggcataaagacatttaaatgggcaataccaattcccacaaacaccgtgcccaacagcatcgttggcatcgtcacaaccagtcgcagtgccgtccccagaaaaatacttgcaattgacaagaataatgcttttttaaggccgaacacagccattgttttggatgcaaagtttgagattaacaaaaacatcaccaatggaatcgttgttaatatacctaactgaccgctaggaacacctaactcctgcgatatttgtgacaacatcaatggcaatgtcgtaattggcgaccgcataattaatccgatcaacatgacacttgctgctaatgcaatgcccgtcggtaaaacttgtttcttactcatgtacccgctcctaaaccttttaaatcaagatatccagcataccattgtttcagatatgaaaaaagccaccagacgtctcaatctggtgacttttttgttactttgcaaagttagtgacttttaggcatcaaaatcttgcgcaacggtacgctcagcaacaaagccaagataaacccggccaatacttgcatgatgttagctggtacatcggctagtcccgccaaaaaggctggaccaagctgcatttttgcaccaccgttcaaccagattaagaatgaaccggctaaccagtacccaacaaccatcaccaaaccgcctaagaaattgccaaagacgcgcttcccaatcgaaggatttaacccatacttaccaatcacccaaccttcaccaccatgaataagtaatgaaaagatcatccattggggataaccagcaagtaaatcaagcaataaacctgttaacccaccgaccattgcgccggttcttgacccatagtgccaagctgcgataaaaataccagtttccaccaatgatacaaagcctgttggcgtcggtatcttggcgacataactcaagacaatattgatagcgacaatcacggccgcgatggttaattgtttcgttttcattttattgttcctcacttaaacgtcgtgctgcctgccaaacattaccaaccggcaacgcctcgtttaacggtaccccatgtttaataccttcgtacacaaatgcttttgcatctgagactgcatgcgccgttgttgccccagcagctaactgactagctatcgcggaagaaaacgtgcaaccagctccattattgtaggcattggccaccttttctgtcttaaaggtcttcagaccatcagccgccactaaaacatcaactgcttcctgaccagctaaacgcttaccgcctttcaccacgaccgattgggcgcccatttgttgcatgatacgcgctgcctcagtcatatcagtggctgttttaatcgttcgaccgcttaacaattctgcttccactaaattcggtgtggtaatagttgccaacggcaataattcagtttgaatggctttcacgagttcattgacgttcgtcgtgcttgtctctttaaaagccatcaccggatcaattatgactggtaggtgactggcatactcttttaaatacttcgccaccagttcaacgtgtgcaacagtcggtagtaagccaaccttcacaccagcaatatcgtcaatcgcaaaaattgcgtcaagctgggccgctaaaatagcaatcggcacaggatgaatggtgaaatcatctggcgtgacagtcacaatactggtgatggcactaagcccaaagtaaccatattcattaaacgttgccaaatcggcctgaatgcccccaccagccaaaacgtccgaacctgcaatcgttaacatttttgttggtttcaatctgccatacctccacatcgatatcaataagattaagtttagcacagaattttatgagaatgtatgaaaaaataaaaagagtgaatatcatcattcactctttccatattatcaacctttttggccccacgaattaccgtgaatgccagtattacaggctttagattacttgatggcgtccttcaaggccttaccaggcttgaaggcaggaatctttgatgcagcgatttcaatttcctcacctgtttgtgggttgcgacccttacgagctgcacgtgtacgaacttcgaagttaccaaaaccaatcaattgtaccttgtcaccctttgccaaagtatcttggattgatgcaaagacagcatcaactgctgccgttgcgtccttcttagtcaaaccagttgtcgttgcaacgtcgtttaccaattcttgcttgttagccatgttaatatcctcctgcttaatagctgattgggattcccaatgtacgaaatgaaactcgttgttcccttatttcgatatttagaatagcatagttacctgaccttaacaagcgattgtttgcttaaaacgttgatacagcgcgcttttcagcctttttcaacaaaaattcatattttgccatcatttttcgtacaaaaaaacgaaaaagcaccaaatccgaacggaccggtgctttttactcacttgcttacgtacgagcacgcttaatcaagtgaattggtgttcctgtaaagtcgaatgacttacgaatttgattctcgaggaatcgcgcgtaagagaagtgcatcaactctggatcgttaacaaacaccacaaaagttggtggttgaatggcaacctgtgttgcatagtaaacacgcaaacgcttaccatttaccgtcggcgttgggttcaaagccaacgcgtccataatcacctcattcagtgttgcagattgcacacgcttttggtggttttcgttaacctgcttaatcaactcaggcaacttattcaaacgttgcttcgtcttggctgaaacgaaaataattggtgcgtatgataagtattggaactcatcacgaatctggttttcgaagtcagacatcgtgtgattatccttttccagggtatcccacttgttaaccacgatgataatagcccgacctgcttcgtgcgcataacctgccacgtgcttgtcttgctcacgaataccttcttcagcgttcaataccatcaaaacaacgttagagtcatcaatcgcacgcatcgcacgcatcactgaatacttttcagtcgactcgtagaccttaccacgcttacgaataccagcagtgtcaaccatgacaaactcatcaccgtcagcagacgtgaagcgcgtgtcaatggcatcacgtgtcgttcctgagatgtcagaaacaataacacgttcttcacctaggatggcattcacaagtgatgacttaccaacatttggacgaccaatgaatgagaagcggattgaatcatcatctgcttcggtgtccgtttctgggaagtgtgagacaacttgatctaacaagtctcccaacccagttccgtgagaacctgagattgggaatggatcaccaaatcccaacgcatagaactcatagatttctgaacgcatttcaatgttatcgaccttattaacggccaatacgactggcttttttgaacggtacaaaatttttgcaacgcgttcgtcagcttccgttaaaccttcttgcgcagaaaccatgaaaacaatcacatcagcttcgtcaatcgcaatctcagcttgttggacaatttgcgtcataaatggctcatcagccatgtcaattccaccagtatcaattagacggaattcgcgggtcaaccattctgcgcgcgtataaatacgatcacgcgtaacgcctggtgtgtcctcaacaattgagatacgatcaccagcaatacggttaaaaatagttgacttaccgacgtttgggcggccgacaacggccacaacaggaaatcccatgttaccctcttttctgtcagcgcaccgaggcggccgacgtgttcattactattttcgattatactgtttaatacagcatgtgtctgttatcgtgtgaccagcacaaaaaatagcccatttacgaaattaagcgtgcgttaggacaacccaacacacgcttaattttttaagctattaaaagctgattagttgaagtccttgaagatatctccaaaggcatcacccaacgtagctgaaccctcttcttctgaagttgagtagttagttggagcttgttcttggcgaggacgacgttggcgacgaggacgatcgttgtttgattgaccttcttcgcgagcaggagcctcttccaaagccttgattgacaatgacaaacgttgcttgtcagggtttacttccaaaaccttaaccttaaccttgtcgccggccttcaaaacatcacttgggttagcgatgtgcttgtgtgagatttgtgaaacgtgaaccaaaccttcaacaccagggaatacttcaacaaaggcaccaaagtcaacaacgcgcttaacagtaccttccaaaacagttccttctggagcttctgaagcagcagcttcccaaggaccaggttgcgtagccttgattgacaatgagatacgttccttttcaggatccaatcccaaaaccttaaccttaacatcttcaccaactgacaaaacgtctgaaggttgtgaaacgcgctcgtgtgagatttcagatacgtgtaccaatccgtctacaccaccaaggtcgatgaatgcaccgaagttagtcatgcgggcaaccttaccttcaacgacgtcaccaactgacaattcgttgaatacacgtgccaatgctgctgaacgctcttcgttcaaaacatcacgacgtgacaagatcaagcggctgtcagcagcgttgatctcaataatcttcgcgcgaatagtttgacccttgtattggttcaaatcttgcacgaaacggttctcgatcattgaagcaggcacgaatccacgtacaccttcaacgtcaacaaccaatccacccttaacgacttgcgttacaggtgcttccacaatgtcatcaacattgtgcttgcttgcgatttcttcccaagcacgacgagcttccaaacgacgctttgacaataggtatgatccaccttccttgtcagaaccgatagttgaaaccactaccaaatccaaaacgtctcctaccttgacaaggtcattaacgttagcatcacggtcagccgtcaattcgcgcattgggataacaccctcaacaccggcaccttcgatacctacgataacttgacgagcatcgtcaattgccaagacttcacccttaactacatcgccaactttaacttcggctacgctgtcaagagctgccaatagctcgttgttctcttcgttcattacaatatatcctcctggtcacacgactctagtagttattatacctaatccttttataaaatactagtagtcacggccaactttctttactaatttatattatttgttggtttttgtcgcgatgatatctttgactgctgccacaacaccatcaattgacaaaccggttgtatctaattcaactgcatcgtcagccttcttgagtggtgaaatttcgcggtgcgagtcaagataatcacgtttttcaatcgcaacttccaactcagccaacgttgtgttcatgcccttagcctggttttccttaaaacgacgttgcgcacgttcagcaactgatgcaatcaagaaaatcttaacttccgcatttggtaagacagttgtaccaatatcacgaccatccatcacaacgccacccttggctgcaatgtcacgttgtaaagcggtcattgcttcacgaacagccgcatacgcagagaccgctgaaacattggctgtcacttcaacagaacgaatagcttcggtcacttctgtgccattcaagaaaacccgttgcacaggttcacccggttcaaaagtaatcgttaggtctggcaataatgccgtgacccctgcttcatcttccggcttaacgccggcttgaaaagcagctagtgtaattgcgcgatacatcgcaccagtatcaacatacacaaagtttaaatctgatgccaaaattttggcaatcgttgacttacctgctgatgcaggcccgtcaatcgcaatttgaatcggattcatttcagtaagttcctcactcgttaatttaacaattaattgtacgctatttcagaacaaaataaaagagacacacgatcattgtgtctccttatttttacttcacttttagcgattgtccgtagtaactcgaataatttgccgccgttaaacctggattcaacgagtaaagtgcttcaggggttgtcccattcgcaacggcaaagctgtacaaagtacctgattcgaattttacacttcctgcctcgtcagcttctgatgaagaagatgatgctgatgacgaactagctgatgacgaggatgccgcctcggaactcatgctacttgtcgcggcattcgcaacgctttctgactcagcgactgccttagacgatgctgcggcttctttcgctgctttttcgctggctgcctttgctgcctttttcgatgcctgtgtggctgcctgctttgcccgtgactctgacttagccgtttccgttactttgcttgtagtcgtcgtggtcttagttgatgatgcagctggcaattccgtgttagtggtcgcatctaccggcttattcaacgcttgcaaatacttgtaaacgggcacaaatgacagagcaatcacaatcaataccaaaattccaacaaccatgctgacacgttgtgacttacgtcgattttgtgtacgtgagtattgctcaggcgtgtcttctttaaaagacgcttcccatggctgttgttcattatttttctcggtcatgattggtctccttacttctcttttgattacaccttagtctacactaacggctcatcaaaatttagtgtcacacccattccttaacctaaattaaaaagttttgccacttgcgtacgccaatccgtcacaccaactggttgttcatcctgtgtcgtcgcaactaacgcaagttcttcagggtgccaatcatgtgcaccgaccgactcagtatttggtgcaccggtcgtctcatccccaaagtgcgttagtaacgtcgcgcggagaccagacggtgacttagcatacccaaccaaacgcgctaaatcagcctggcgttgttgccgacgttgatcaaacatgtctgcaatttgatctgctgttaggccttgcttggtataaaagtctaacaaattagccttatctttaccaatttcatcagttccaaaacgcttttcaagatagccaaaaatcacttcacgcgttggaattgtactatcgatcatatgcaattgcatcgtttcatcaccgggcacatacaacaaaacagccgctgattgctcgccgtcacgcccggcacgtccgatttcttgtaaataatttgctaaatcattactcaaatgatagtgaatgacatagcgaacatcgtctttatcaattcccataccgaaggctgatgttgccgtaatcacgtcaatttgtcccatcataaactgttgttgaatccggtaacgcgacattgtatccaatcccgcatggtaagcagccacacgttggccggttgtctcacgcaaccattcggccattgaagtcgctagcttgcgacttgaaaagtagacaatcccgggccctttcaactgccgcactaattcagccaaacgttcacgcttttggccttcgttatctagctgctcagtgtgcaaataaatatttggacgatccactgattgccggtaaataaaccaatcttctggtactaacccaaatggtgatgtgatatttgacatcatttgaggagttgctgtcgccgttaataacaaaagttgtggttggccaagcttctgatggacttgtggcaaggccagatagtcgggccgaaaatcaggcccccaactcacaatcgtgtgtgcttcatcaacaaccaacaaattaatctttacttttcgtaaagctgattggaccaccgtttgaccaagcatttcaggagacacaaacaaaaacttatattggttcaaaccacgcaaaatcgtacggcgggcatcttgtggcagtgttgaatttaacgcaaccaccttagactcacccgcataattcaaacgggccacttggtcttgcatcaaagacagcaatggcgtcacgatgacaactaatccttcgcgcagattacccatcatttgataaataagtgacttaccaccacccgttggcaacatcgccaatgtatttttaccagcagttaacgcttccaacacctctgcttgacctggcttaaagctggtaaaaccaaacttgtccgtcaatacggcggtcaatgcttccttatccacgagcagccacctccattttggttaagtaaatttcatataaacggaacaagaagaactcacgtggatcatctgaggtccgcaccgttgtaaattcccattcatcaattgggccaaccaatttttcttcaaagtaactcacaacatctggcgttaagtagtttttataaggaaaatcacgaattggtagccaaatagccgccgttaataaatgctcacggattgtcccaactttcaaacgacgactcttcaccatttcgtccattggacgtcctgcgatcacaccgttgtatgacgcttgcacgctgtttggcaacaaaggccggtgggcaactgaatcccacaacaacttcaagggcgtatttgccccacgttgtagttcctcagaccaaatagcatactgatctaattgccagaaataaaaatcttcatccgtccaggttgctgggaaaccaagttgttcaaaattgaaacccggtgtgttgtgaccgacccatgtggcaaccaaacgatcggcatctgcctgtggccgacgctgtaagaagcgctgaattgttaaggcccaagtggcaaccaagcgtggcgaattcatatttgcgtaccattgcttcaccgccagcattgtgcgcggatcgatttgcaaaggataatactttttattttcgtaagcgacctcagaaacgacttggttcgctagccaaaaagcttgcatgaatgtcagcacgtcatacttgagcaaaacagctaagtgctcgggtacataatgcgcagtttggtaggccatttgcgcttcctgaccagctgcggtcaacacgtactggccttctgtcacttcggacaacaacccctctgttaccaacgttgcaatgcgctgatcaaaagttgccttgtccaatcgaggcatcaaacctgagatttgcaataaatcataacgcagaccccaatactccgttgacaccgttgcttgacgcttcaataaaccaaaaatcaccctgtgccggcgaggttcatctgccgaaaacagggtgatcaagaaatcatttgtcaactgcttgaccacctctcactattttctactcagtttaaagaagaaatatcagtcgtgcaagcaatttaggataaagcggacggtcatagcgcaggttctacccaacaacatgaccaaccatcattgaaattaatttaattgagaatgcgtgttcgtgatgacacgtcgcaaagcaacaaagaccagaccagccactgccgttaggatgatgccttcaatcaagttaaacggaattaccatccaaagcaaatatgtccctagaccaatcgttgccttaatatcgaaattagcaaacatcgcatacaacggtaccgcataaacataattcaagatgaccatcgccaacgtcaatccaactgttcccaagattgatcccgcgataaagcgtttaacggtcagctcacgatgtcccaccatcaacataatgaccgtcaataaaacgcccatcgcgacaatgttcattggtagcccaatgtagtcattcacacccgaattatttaagagcaccttcaatagtgagcgtaaaattaaaattgcgtaaccactctttagatcaagcatgagtgcaccaatcaaaaccggcacaaacgaaaaatcaatctttaaaaaagttgcaccaggtattaatgggaattgtggaaataccattaatacaaacgaaatggccgccaataaggcgataaccgttaaccgacgcgtcttgttcatgaaacaaatcctccacctggcatattaaaaggccggtttcttcacgccagggcgacgtaaaaaaaccgaccattaccagtcaatttataagttcttctgcataccagactttactgtcggtcatggaatcacaccatgtcaaccgcattcgcgggtcgcggacttactgcgttgcagcttaccgccggtcgggaatttcaccctgccctgaagatattaaattattggtgtaaccttaccacgcattaaccatctaagtcaaccttgtgacggagcttgtcgtatgtgtgcttttcattattcaacaaatcataaatccgccgaatttgcggtgcaaaccactttagcgtcaaatcttgcgtcccctgcaatgtttgaatttgtaggcgtcctcgaatcaatcctgtatccgggttaatcgtattcacttgatccaaggtcattcgtaatgaatctaaatggaatggtcgccaatgtgcaaaatacaaagttcctgaatcaccgagcgcaaaagcataccacttataacggccggttggttcaccagcatccgtcaagccagccattttagttaaaaaggctaccacaaccgtttcatcatcagccaacgaactctcaatattcttgaaatgcttacgtcctagccaacccattggcttccatagtaatggccagccagcaaccttgtggctttttgcgaaatcatacataccttcgccagtcttcataaaattacgacccgttcttgtatccggtgttgccatggtttatacctccgtctttcgtgcatatcagcattattgatcaaatcgaaatgaccagtttgttatattctatcagacttttaccatcacaaatcttccaaagctctgacgtgaacgaccgcccgtaagaacagccacccacccgaaaccactaagaccatcccacccgtgaccggcggccaaataaaagccagcccggtgccgactaatccaattgcaatcaagccaattcgactacgattcactcgtcgcatccgcttttgaacaactggatttgccaggtgcttcgacacaatgtggctcaagttgaacaacgcgcacaccgataagacataaactaaaccatacgttacgcttggcgcaacactatttggaaattcaccaaaccaggcagtcgttatcggtaccaatgacattggtaacagtgtcaatacattaatccagagcaacccactatcaactttctttaaattgctgataatcagatggtgactaacccaaaaactcgcagtaataataaagctcaccaaataagctaaaaaggtgctcatccaggcatcattcataatcgccgtccaattaccatccgatggtatctttaagtccaataccataatcgtaatgataattgcgaaaaccccatcactaaatgcttctaatcgtcctttttccatcatcctcaactcctacaaaaaaagacggccaaaaccgtcttttttagcttaccaacgtcctgcagactttcggtattgcttgccggccttcaaggcttgcacttcttcataacgtaatgggcggtattcaccaggtgtcaaccccgctaaatcaagcataccgtaacgttcacgggtcagcttcaatacttcgtggccaaccgccttcatcatttccttgacttggtggtacttaccctcatgaatcgtcaacttgacaattgctgtgtgattcttagtattcgtcgacgtgatttcagcacgagctggcgcagccttaaatgttgtataacggccattttgctttgttcgcaccgtcaccccatgacgtaattgttcaagttgttcgttcgttgggatgcccttcacctttgcaacgtagaccttatcgatgcggtaacttgggtgcatcaagcggtttgcgagctcaccgtcattagtcaacagcaaaaccccagtcgtgtcgtaatctaaacggcctactggatagacacgctctggttcatccacaatatccattaccgtttgacggcccttatcatcatttgtcgtcgtaacgaccccacgtggcttattcaataagaaataaaccaacttttctcgtgagtcgattggttcaccgcttacttcgattttatctgatggttctaccttggtacctaactcacgaactgtcttaccgttcactgtcactttaccgtctaaaattaattgttcagacgcacgacgtgaggcaacacccgcttgagccattactttttgcaatcgttctgccataggtattaattatctctttctgctgtttcagctaactcagacaaatcaacgtcaaacgctgattgtccactttcttcagtcattaatggcagcgcaacatcttgctttgcccgtaatgcatctagtgcttctgcggtaacaaggggtggcaattcttctaaatcgcccagaccgaagtaatttaagaagtactccgttgtaccatacagaattggccggcccggttcattagcacgtccacgaccttcaactaggttacgcagcgctaatttttgaatcgttgcttgtgattgcacaccgcgaatctcgtctacttcgactcgcgtaatcggttgtttataagcgataattgcaagcacttctaatgaagcctgtgaaagcgccgtcgttaacggtgccgtaaaataacgatggatcgtatcagctagcaccgtcttcgtgactagttgataccgttcgtcagttttcagcacatctaacgcgctactttcatcagtcgcatacttcgctgccaaatcttcaagcaacccaatcacagccggttttgcaaaaccagtagctgccgccatttccgctacggtgataccttcatccccagccacgaagagcaacccttcaatttgctgtagactattcttcatcgtccagttcctcattctcatcatatggcacgtcacccagttgcaaccggatggtgccgaattcattttcctgtgtaacgaccaaattttgatgacgcacaagttcgagcatcgccaaaaaagtggttacaagtttatcacgactatcatcttcaccaaaaaacgacgtgaacgtacgctgttcgccaggcatcatatctgccatcatgcgtgacatctgctcgcgaattgaccaagtctcaccacgtaacgttcttggccgcacttgctttttcgtccgattagcaaccatctgattgaacgccagctgcaaatcaaagagacccaaaccttcaggtagcggtgccacctcaatatcttccggaatggccatcggcgcccgcgaaaattgtaattgtcggccttcttcacgttctcgcaaatcgtcagctgcctgttgataacgctgatattccaataattgagccatcaacgcttcacgtggatcctcttcatacacaaactccgccagatcctggtcatatgtcaattcttcattcttaggaatcaaatacgtagatttaatcgacatcaaagttgcagccattaccaaaaactcacctgcaatatctaaattgcgttcttcggcttgatgcaaaaaatctaaatattgctctgtgatggccacgattgggatatctaaaatatccatttcatttactttaattagatggagtaataaatcaagtgggccatcgaactcatccaaatgataggttacttcttcagccattcgctaatttccgccattccgttaaaatcggttgggttgcaatggtgcccactagcactttgtctgcataccgcatttgcagcgcttcataaatttcggcaccaacctgattacgttcattttcggcaacttcggggccaaaaaccactaaccgtaatactgcagagtcaaaaattttctcgataccgaccactgccacgtaatgctgggttatcggagactgccacaacaaaatgtctcggcaatcgtcagcttgataccattcaatctcacgttgcaccgatgcaacatcgtgtaggcgtggcaaatatgaaagcaagcccattgcaattttgggttgatcttttcgaacaacgactaacatgttgcctccttaatcaagcgcgcgggtgactcttttgatacacctcagtcaaacgcttatttgaaatatgtgtataaatttgggtcgttgatatgtcagcatgccccagcaattcttgcacaatgcgtaaatctgccccattttccaaaatatgcgtggcaaaagaatgacgcaaggtgtgtggtgacacatctttagtaataccggcagctatcacccactgcttaataagtttccacacaccctgtcgcgtcaattggtgaccatgatcgtttaggaaaatcacctgttcatcctgttgtcggccaagaaaggggcgtccatccgctaaataacgttgtagccagtgcgtcgcaacatcaccaatcggaataatacgttccttatcaccttttccaatcgtttgaatcaaccctaagtcaagatgcaaattatctaaacgtaaatttaccaattcactcacgcgtaagcctgtggcatacatcacttctagcatcgttcgattgcgcaagcctaacgttgtattggtatctgggaccgccaacaacgcttccacttcgctcaatgttaaaacagctggtaaatgctgtgcctttttgggtggatcaacctgggtcatcggatccgttgttgtccagccactatcagttgcaaattggaaaaacttccttaaagtcgacaccatgtgaatgacggagttccgtgatttcccctgtgtctccatttcacctagaaacgccataatcgtaaaacgatcaacttgggtgagtggcaatgatttttccttgtcgattaaataggtaaaaaaatgcgtcaaatcttgccggtatgatgtacgcgtgttggctgacaacccccgctctaccgtcaaatagtgcaggtagtcaaccatattatcttcgtatggacctacctgttttggcatcttactcgccgtcactctcttcgaccaagaacagcccattttcgttttgggtaatcttgcgttgcttgtacaagtttccaaccgcccgcttgaactgtgactttgacataccaaaatacttcttaatttgctttggatctgacttgtctgtaaatggcaggctctttgttgatgaacgctgtaatagcgtcaacaacatcgctgcatcatcagaaatcgcctcatacgcacgtggtcgtaacgacaagttcaagacaccatcatcacggacaccgataacacgcgcatcaacttcctcaccaagacgaggttcgcgttgccgttcatccgggtgaataaagccaaagttatagtccggtgtaatgaccagcgtaccaaccatcttcaaacggtaaaccgtcgctttaacttgcttgttcttcatatctgccttagctggaatacgtactgcttgcaagatgtctgccgaagcaagttcaccccacaaacgatccttcttatcaatacgcaatgtaatcatcagcttgtcaccacgttggggccacaattctttaattgttggcaactcgtccaatgacacaacaacatccttgtttggtaacccaatattgacaaacacgcccaaatcacgtcggatatccgtcacagttccccaagcaaaatgacccaagcgaacgtctggaatattttttgtgatttgcaaattatgcttttcattttcgtaagcaaaccctgaaacaacgccaccaaccttgagtggcttcaacaattccgccttgtcgatttcatacgttaacccatcaacttgtgcgaaatagtacttgtcattttcatctgtcaccttagctgagatgatatcgccaattttgtgtgtcatatttattttctccatatatctctttacatcagctgcatcaaccactcacaggtcgtccgatgccacagcgctggcaaagccgttttcactgacatgcagtcagtaaacctattttctgtctaaactctagtttaccagatgccagtgataatatgtaaactaattctgcatttttgcgcaagttttgttaaaataagtagacattaatttttgaaagcgagatttcccctcatgaaggcagttggaatggaaccccaagtcttgatcgacattcttgtcggtgccaagattggtgttgtttacccctttggaactgatcaccgcggtgatttagttgttacatcatacgcacttaagcaagctggtctaccatcaagtatggccggtgctgttgtgcaattagaagacgttgaagaaacggcacctggtaacttcgtctggaagttcaacccagatgtgacgttgattcgtccttttaaggtccacggtacaatggaattgttcgatgtcgatgatgatttgattcacgctgaaccaacaaactggttcaacgttgaaaaggaaaacgaaggtcacgccaagatcgctgactggatggatagctacgtggctgcccaccctgatatcgatcgtattcctcgcgccgaaattcctgaagaaatcgccgcgttggcgatctcattcgatgaatggcgtgaagcctacttcaacttcttgtttaagccattgaaggcgcaaaagcaagaattgcgtaccaagcgctacgatgttgacccattgtaagcacattaaaaaagctgcctgaatcgcaaagattccaggcagctttttatattcaccgtacttttttgataagtgggcgcatcatcaatggcgcaatcaaagttgatgcaatgattacgacaacaatttcaccaaaaactttaccagatagaataccaccagttgccccgatttgagcaatcaccaacgccatttcaccacgtgacaccataccggcgccaattgcatttccagtgtgcttatcaagtcccgccattcgcgcgccgataccagcaccgtaatatttggtcgccacagcaaataccgtcagcaccaccatcgctatccacgtctttgacagatcatgaaagaccacattaagtccgattgaaccaaaaaagattggaaagaccgtccattgtccaaagatttcgctagcatgcaaaattttatctgatcgagaagattgacgtagcaatacaccaaatgcaaacgcaataattggcataatggtgtttaaaccaagccctgaacccccaataaataatgaatatgctgtgaccagtaacaacgccataatgtcatctagcaccgcagcacctaagataaccgcgcccatttgtgtcccaagtttaccttgttcaccgagcaccgaaatggtaattgagattgatgtcgccgcaaacacaacaccccaaaacaacgcaatttgccattcataaccaaataccaacgcgatgactgggaaaacgaccaacggtgcaataacacccatcaacgctgtaaaattcgctgctttgaaattatcacgtaactgacgagcatccgtttcaagaccggcgttaaccattaacaacaggacgccaaactctgacacaatgtgcatcaaatgcgaaggttcaacccaatgtagcaatgccggccccacaaccacacctgctattaattggccaacaacctttgccatccctaatttggttgctgcccagccaaacgccaaagtaatcgccagcaacaccaccatcaatataatctccataaaacctacctccaaattacaaaaaagcgcgcacttctcatccccctggttacccacccaggaaacttgaagcacacgcccaaccgatatctctattcactttaaacaaattactgattgcgagagaacaagttactaaatggtgactcaccagtgttcgcaacttgcgtcaagaaaatcttaatggccgtttgagttgtcaaaccttgtgacttgaaaatctcatcagccttgtccttgacgttgtcctcaacgcgcaattgaatcaacttctctgccataacattacatcccttcgcaaatgcttaatttgtataaacatattgtagcatatatcggacttacaatactatcaatatcattgcatattactaggggattgtacggctaatctatgatttttatttgacatagcctaaaatcagctatttattatccgtatcaaacacaattgttacgggtccgtcattcacgaggctgactttcatatcagccccgaattcaccagtttcaacgtgaacaccggtcgctgctaattttgtattaaatcggtcatacatcttcttagcaaaatccggggcacctgccgctgtaaaactgggtcgattccccttacgtgtatcagcataaagggtgaattgtgaaatcgataaaatcgcaccagcaacatccgttaagctaaggttcattttaccagcttgatcttcaaacactcttaaattagttatctttcgtaccaaataatccaattcagcgtctgtatcagcatcttgaacaccaaccagtaacataaagccttgctcgatagcgcctagctgattaccggctacggtaacactggcttctgacacgcgttgtagaataaccttcattatttgaatgctcgctttacttcgtagacatctttgacattcttaatcgaatccataatgtgttccaattgatccaagtttcggacaccaacactcattgaaatattaacgttgttgttgtgatcgatgcgcccattaacaaagtttaatgactttgtcgtgttgttgaccgtccgaatcacgtcattcaacaacttgttacggttggttgcagtcactgccaagtccgcctcatattcgttcttggtgtcgccgtctggcttttcccaagcgacgtcaaccaagcgttgaccttctgtctcagcagcgcgcaaattagggcaacctagacggtgaactgatacaccgcggcccttggttacataaccaattacttcatcaccaggtacgggtgtgcagcaacggcctaaccgaaccagcaaattatcaacaccttgaataacaatccgatcttcgccgtgctgtggcttttccttggcacgttttgaatcgttctcaattgtctgatgttcttccaaaatagcccgttgttcagcaacctgacgtgcttcttccagttctgcacgtttctcttcagtaaacttgtttgcgacaccttgcggcttcaaatcaccaaaaccaagtgatgcatacatatcatcaacactcaagaaatgtaacttttcggccgacttcacttcgttttcagctgacatcaattcatcaacatcaaaaccttcctcgttgagccaatcagccaccatcttcttgccggctgcaatgttctctgctttatcttgcttgcggaaatactgcttgattttattacgagcgcgacgtgttgaaaccaaattcatccagtcacggtttggcttagcattttgtgaggtcacaatctcaacaatatcacccgtcttaattgggtaatcaagcggcaccatgcggtcgttaaccttagctcctgttgtgtgattaccaacatttgtgtggatactgtacgccatgtctaatggtcctgcccccttggcaagttcaataacatcgccctttggcgtaaaggcgaacactcggtcagtaaacaaatcaccctttacagactccatgaaatcgtccgcatcgcgagcgtcttcttgtaattccaaaattccttgaatcacattcagcttttgctgatcggcattttgaacatcggcacccgcaaaattaccttctttatacgcccagtgtgcagcaacaccaaattcggcaacttcatgcatctggtacgtacgaatttgaacttcaagtggacgaccacctggtccaatcactgatgtgtgtagcgattgataaccattggcctttggcaacgcgatataatccttaaaacgacctggcatcggcgtccaacgggcgtggatagctcccaaaacagcgtatgtctccggaatcgtatctaccagcacacgaatcgccaacaagtcgtaaatttcgtcgaactttttctttttgtcaaccatcttccgatagattgagtaaatgtgttttggccgaccatacacttcagcatgcttcaaatgtaattcagtaattgcgtgttcaatgtcatcaactgcttggtcaacaatctctaaccgttcttggcgtcgtaattgcattgacttagcaatgtcgtgataggcttctggttctagatagcgcaacgacatatcttccagctcccacttaatcgtcataattcccaaacgatcagcaagtggtgcgtaaatttccaacgtttccgatgcaatccgcttctgcttttcctcacgcaacgcactcaatgtgcgcatattgtgcagacggtccgctaatttcacaatgatgacacgaatgtcatgtgacatcgccaacagtaatttacggtgattttcagctagttgctcccgtgatgatttgtattcaatctttgaaagttttgacaccccatcaacaataatagcaacatcatgaccaaactcacgctcgacatcttctaaagttgcatctgtatcttcaacaacgtcatgcaaatatcccgccactactgtatccggatccatatgtaagtcagccaaaatgcctgctacttggataggatgaatgatgtaaggttcaccagacttacgcttttgttcttgatggagattgcacgcaaaatcataggctttatcaacctttttaacatgctcctcattcatatagccggcaaccaagtcgtgcacttcttgtgcggttaacacttttgcttctgccatagatttatcctctgttttccagaccaacaccgattgggattcatacccgcagcatctaatccgtatttatccacctggatagttattgtctattgtaacgcactttatccggcttttgatagccctttgtattacagcttgacgacagtgttcgtttttagccaaaaaaacgacctatcgtctgataagtcgtccgaattgttcttagtctaactgaaatacaacattattagcccctaaaatctgttgtaaggcatttaaggtgtcatccccatcggttaaccaattttgttggccaagtgctaactttttacccgtcgcctcatagaccgccaaaactggattctggccatgatgtgactgaatcacaacatttaacgcgtcaagcgcgcctgctgcctcagcggctgctgttattttcaaataccaccgcccggttgcccgactagttagcgtttccggctgaccttgactattggcaccactaaagcgtttaatggcttctcccgcatccatcaccgtatttgccacgatttggatgtcgtcacgcccgcgttgctgttcgactttacccgtcacaacgagtactttttccggttccaataatgctgctgatcgcataaacaattgtgggaataacgtgatagaaatcgaacctgttaggtccatcccatcaacaaatgccatttgatccccttttttagtgcgaatctttttgacattttcaacatacacaataatcgttgcctggttcattcctactgccagcgaggcaatatccaaacgcttattctcaggtatcgcgtttaagtacggttcgattgggtgtccactaagataaacgcccaaatactcacgttcataacccaatttttctgccgatggcaattcatcaacttcccgtactttcggcgtcagcgacgcaaagagcgacatcgattcaccggctaaaccaaccgcgtcgatgaacccgcgcaacgatgccagaattgaggcacggttgtaaccaaactcatccaaggcacccgcatacactaacggttccaattgttcagcttttcgatatttactctctaaacgaccaatcaagttacccaaatctttaaacgccccattttcctgacgctcacgcagaattgattcacgaaaatctcggcgcataccactgatcgaagccaagcccatttgtaaggcacccgctttattcatcgagtagccttgccaagagtgattaatacttgggcctagtaaagtcactcccgaagcttttgcctctgcaatgtatgtactgacctttttcttatccgcaatggcatcattcaaaaccgctttatagaaagctgctggataatgcgccttaatataagcaagttgaaaggctaacttcgaataagcaaccgcgtgggagcgattaaacccgtactgtgcaaacgtctcgatataaccgaacacctgctcagcgacctgactatcctgtccttttgcaacagccccattaacgaaatctgtcttcatggccgcaatttttgcgccatccttcttagacatcgcacgacgcaacaaatcggcaccacctagtgagaagcccgcaaattgttcggcaacacgcataacctgctcttggtacacaatgatgccataggttggcgctaaaatatcagccatactttggtcaggtacgtcttgcgcttcttgaccatgtttacgggccacgaaatgcggaatattctgcattggtccaggtctgaaaagcgcattcgcggcgacaatgtcctcaaagcgatcgggctgtagttgccgcaaaatattcttcatcccggccgattcaaattggaagaccccatttgtcattccgtgccggaataatcttaacgtcgcgtcgtcatttaaatcaatcgtcgcaatattgaaattagcactgtcttcttgtttctggatttcacgtagcgcaatgtccaaaatatttaaattcgacaatgccaagaaatccattttcaaaagaccaagcgcttctaccggtccctttggcaattgggtcaccaaccgaccatcttcacccagttgcactggcattgtatcaaccaatggatcggctgacagcacaacacctgctgcgtgcaaagatgaattacgtggcagcccttctagcttacgggctgtctcgtaaagtaactcaccgtccactggcacatcaatgagggcattgcggaacggctgtgattgttcataggctgccgttaaatcagcagcatcccgtggcatcgcctttgagagtgtgtcaatttgactaggatttagtccaaacacacgggcgacgtcacgaataactgcacgttgggccatagtcgagaacgtaataatttgcgctacccgctcatgtccatacttttcatgcagataggcaagcacctcttcacggcggttatctggaatatcaatatcgatatccggcatttgtgcacgttcaggatttaaaaatcgctcaaacaataaatcatacgcaattggatcaacatccgtaatccatagcgtataagcaaccaatgaacccgcggctgatccacgaccaggtcccgtccgaatcgcttgcttatgtgcaaaattaatcacgtcccaaacgattaagaaataatccgcgaaccctaagtcaataataaccgctaactcttcatccaaccgttgccgataaacagacgcatcaacatcaagcccatgcaatcgatttttcaatcccgtttgggctaaagttcgtaaataatcagcggacgtctcaccattcggtgtcgtaaaagcaggcaacgtcacagccgacttcaccaactcaaaatcagagtgttcagcaatccaatcggtattcgcaactgcttcggctagaccagccgtttcaaacgatgcttgccattcactgacagtcggcaaatacgctgtggccggttctctctgtgcctggccaacattcgtaatgacctcaccttgccccaatttttgaatcacctgcgcagcaaattgatcacttgcgtcagcataagttacttccgccatcgctaataaacgggctcccgtggtgtcagccaattgtttcatagcagttaacaattctgggcgcattgttggtgttacacccagaaatacatggtcagctgttgaagcggtaatcaacgtttgaatcattgtcaatgcccgttccggttctgcccctagtacaaccgacaattcaccaacggcaggcaaaatcacatataagcctgataaaaattgtgcaatatccgcaaacgaggtggtgtcatgggtttgtatatagctgctaatcgccaaaaggtggtgataccccgtttggttttcaactaaaaagacaatcggataaggttgtgatgtcacaaggccgtgtaacgtggctgttaagcccaaaatcggcttaatatcggcttccttcgctgcgcgataaaaattatccatgccatacaagacattgttatccgtaattgccacagcggtgtagccctttgccttggcagatttaactaattgggccggcatcattggactttgtaacaaactaaaggctgtctttgtctgtaacggtaccattgtgggctcctttccgaacatgttcgttcaaattcgttttaacttaatttcattatagcgatttgcataacaaaagaccacccgcagaacgtgagtggtctttagagtcgtgtaatcaactgttagtcttcagcgtgagctgcatccttaggcgcagcagactttgaaatagcagcaaatgcaatcgcaccgattgcaccaatcaccatcgcaaatagagacgttgcagttgcgttgtatgaagttccttccaaggcgctaccgatgtaaccgataatttcgccaaggatgaacgtccaaaagaaagttacgacgtacttcattttttctacctcttagccttttctggccaaaatgattttactgtcacagtttacgcctattctaaccatttgtcactttttaaactgttccaaatggctaacatttatcggcgcgtgtatttcacaatccgccaatcataatcattatctgcatcagcgcgtccagaggcaatctcttcggcaatccataccgtttgatccaccggcggcatgagaacatcccccataaaatcagtatctaaataggtgacgtacaagatatcagccactggtaagtagctatcataaatggccttaccgccaataaccgccagtttcatacctttttcatcggcaatctgctccgcttcggccattgtatagactttttcaaaaccggcaggcacatccaacatttcatcatgcgttaacaccatgttgattcgctctggcaaggcacgcccgccaaagctcagcatggtgttgcgacccatcaaagcaacttgatgaatcgtttgttccttaaaaaacttcatatcagctttctgtcgccatggaatcgagccgtttaatgcaattgtgccattattagtctgtgcccaaatcaaaatcttttcagccactatcgcttacccctctacgcgttctgacaattcttcccaacgcatcatcttatcttcgagcgcttggtttgtctcatctaattgtgcctgtaactcactcaacttaccaaaatcagccccattttcgaccatgtcagcctcaatttgactaatcttaccctcaagttcagcaatgtcatcctcaattgtttcccactctttttgctcagaccaggtcaacttctttttcttaggtgcctcgacaaccggtttcttttctgcagtgggcttaaccggctttggcgcatccgtcgtcggcgccccaaattcagctaggtaatcgctaaacatgccccggtaacgcgtaatgcgaccggcaccttggaagataatcaactggtcagctaccttgtccaagaagtaacggtcgtgggaaacggtaatgaccgtccctgcaaacgaacgcaaataatcctccagaaccgtcaacgtaccaatgtctaggtcgttagttggttcgtccaaaagcaacacgtttggttgttgaatcaacaacttcaataggtacaaacgacgcttctcaccacctgacaattggcgaatcaacgtaccgtgcatgaagcttgggaacaagaactgttccaagagttcagcagccgatacaacgttaccgttacggtcagtcacttcttcagcaacttctgttaggtacgccaacatgcgcttgtcctcaggaattggttccgtcacttgtgtgtagtaagccatcttaaccgtctcaccgatttcaatcacaccagaatctagttgctgaacacccgcaattgcattcaacagcgttgactttccagtcccgtttggccccgtaatcccaatgcgttggttcgcttgaatcaattcattgaaatcatccaaaatcacacggccatcaaaggccaaactggcatgttcaatgttgataaccttcttacccaagcgttgctgtcccatgttcacttcaacatcgccttcaacttgacgggtaccttgttgtgctgccaagtcagcaaaggcattttcgcgagccttttgcttcgtagaacgggccttcgcacctgtacgcatccaagccaattccttcttgtaaagttgggcagacttgtgttcagcaactgcttcggcctcaacacgttcggccttagaggtcacatacttctcatagttaccaatgtattcgtacagcttaccaaatgacatttcgaaaatgcggttcgtcacgatatccaagaagtaacgatcgtgggtaaccgtcatcacagcacccttgtaatcagacaagtacttctccaaccactcaatagaatcaaagtccaagtggttagttggctcgtccaacagcaacaagtcaggcgcttgaatcaacacttgtgccaatccaacacgcttacgttgtccaccggacaaagccgacacaggcaaatccaaattaggcaaatgcaattgcgttaaaatcgtcttaacctcagactccgctacccaagcatcctcttgcgtcatttgttgttccaacttcgtgtaacggttcaacaatttctcatcagttggattagctgaatacgcctccaaagcggcctcgtagtctcgaatcaattggaacactggttgtgcaccagcgaaaatagcttccatcactttcttatcgccatcaagtggtggctcttgttgcaaataaccgattgtatagtcatttggtgtattaattgatccactgtcggcaggattcaagcccgaaatggcgttcaataacgtcgtcttgccagttccgtttaccccgacaattccgacacggtcacccgtttcgatcaggaaagaaacttggtcaagcaaggtcttctcaccataaacactctttaaatcagtcgcacgtaattgcttcatcgtttacttcttcgctttctctgccattgtttgcgcctctgccagaagcacatcatgactattgttcaggtcacccgcaaccactttttgctcaagcgttgccagaatcttaccaaataacggccctggctgcatccccaattccttggttaggttaccaccgttaaaggctaactcacccttattttttatcttcaaatcttcatagcgtgacttaagccccgcgacatcaacaaccagttcactcaacttagcaaccgctaacacgttgtcgatggcgttaccagcttcgtacaaatcccaggccgcgacatcacctaatcggagcttattgagcaacttaattgaagccttgattgtcttaaccatatcgttagattgcttccactttttcaagaaaacaaccgcatcttctggtgttaggccaagctcaaataccaatagtgtccacgctgccacgtcattttgaggttgcgcatctgctaatagttccgcataaccaatcaaatcaatatcaaccacctcaaggccgggcatatactgatttaaattcgttgcaatcatttccagcagaccgtagcgagccgccttaccttgtagcaacttggtgaactctacgtttgttcgttcgattgcaatgttcgctaataatggcgcattgtccttgatagcttgcaatgtggctgcttcaattttgaagtctaactgtgctgcaaaacgaactgcccgcatcatacgtagtgcatcttcatgaaaacgctcttccgcttcgccaacggcgcgaagtacgtgattttccatgtctgacaaaccatcaaacatatcaataatttcgccgtccttggtcaacgcaaaggcgttaaccgtgaaatcacggcgctttaaatcttctgccaaggaacgaacaaacgtcacctcatccggacgacgaaaatctgtataggtcaactccgttcggaaagtcgttgtttcatatccttgaccgtgatccagaatcatgactgtgccatgttcgatccccgtatccaccgttcgctcaaacaaagccttcacttcctctggatacgccgatgtggcaatatccacatcgtgaattggcttacccaacaacgtatcgcggactgatccgccgacgaaatacgcttcaaagccagccgcctcaatcgtttctaaaattggcaatgccgcaacgaactctgctggcatattctctaacttcatttcaaaggtcctccttggacttactcgttctttaagtataccaggaatttgttgttaatttggcgtaccgtaaactaaacaaggttcatatcacggttatgacgcaattaaaatcgaaaagactagctgctcacattaagaacagctagccttttcgttaaggtaagaatattaataaggccgatccgtatacaaaatacttatagacgtttttcccacttaattgtaaatatgaaccattacttttaataatataggctgatagtataacgaccagcatgtctaaaattattcctgatacgccgtaatttaatccatctcctataatattaagtatgcgtagtgcaaatagtaagacaatcagcaagtcaatgatgattaataatatcaactgatttttaatagcgtgcattgatttgttccttttcagtttcgtcgtgtttttacgtttatttaaagtgtttgtttattaccgttaatgcaatataccaactcatcaataagtaaagaaaccataatgctgttcgttgttttatagttgttgccaagattgcaaatacgattattagtattaatagtgcgacaatctgggcaattctctttttattaatgtgcatatcgttctaattgcctgcttgttgctgaaaatatttcaaaatccttaattgcgtccatgcctattcctcctcgattacgtcattaattacaatctttgcttagccatacaaacgccttaatccctctaacaattatgtaccatgtttttctctaataaaagcaaggtcggtttacagatgtaaaccgtgttcaatagcctctactcaatgacccataagcaaaggcagccgatttaacaaagtaaaatctgccacctaagtaaggttcaaaaaattaactttcaccagtgttccttgccttggaaccattactggacaaacactttttaatggcaataataattaaattttacttttggtttctaacaagactcccagtgcacccaaagtagctattaaaaccgtaaaataattcaactgccataacgttagtaccaatccaagaaaaagaattaacaattctaaattaattttgttattcctaggatttgcgctgaataatctgagaataacagaaataaatcccagaacgcttagtattgcaacaattattaaaagtattatcttaatcattcgttccctccaaaaaagcatctcctgcttaggatatccccgtgtccaagctgaccataccatttagaaacagttagtgtgccgattgttgcactaccaccctcaatttccgatctaacaaccattttttcatttttaatacctcaaatcggatatgtgaattacctcatctacacattggtagacatttggatcgtgtgtggcaaaaataacgtaagtttcatcgtttgataagctcagtaataaatcaattatttcctgtccagtctcagcatctaacgccccggttggttcatcagcaagaataattttaggtttcttaagtagcaaacgagcaatcgctattctctgtgcctgaccacccgataattcaaaaatcttcctattcaacaaatcgaacggtaaatggacagctgataatacttctaactgctgttctcgattcttattcactaaccccaaattgtaagacactgtttggtcttcaattagtgcataattttgaaatatgtaaccaagcgtttctcgaaagtatttttgctctgacattttccaaatattaatgtcatcagccattatctcaccagacgtaggcttctctaatctcgctattgcattcagcaatgttgtttttcccgaacctgaagaccctactaatgcatatgtccttcccggtaaaaactccaatgataagttatcgtaaatcacgctatttttatattcttttttatagtttttaatctgaattgtcacaattcaaaatcccctttcagaacatttacacttgccttcttaacgtagaatcttacataaccgataattataataattgccatgacgttcaatcctagaacgacattcttcagtaccattgacgacgtcataaaccatgcaacaaccagacccacaaagatagtcaagatatacccaccaaattcctgcagaataacatagtctatgttataacccaatagccttttaacacccatcgtgtacgcttttttcctggcaatattcattagaaattgaaatatagcaaacagctgcatgataaccaatgtcgccatagaaacataagccgccacaattcgcttttgaagacgatttgcctgcatttgaatagaaaggtacggacttgtaatatcttctacctgtccattgatcgaggaatcaacagcgactttttttaaccccggttgcttgaatagaccattcaaaacatttgaatacgtcgcatccttaccaagagaattaaatgcatacgccatattaattacgacaagaattctattcgtatctgtttgaagtctagcatgatcatagacatatagttccgcgccccggtaatcaaacaagaatgttttttcattattctttacaatatgaatttcaaagtctgattttttaacacccgaattttggtaatattctagataaattgcgtttaaaacagattttttgtggtccttaaatttttccggcaaaaacacagtggccggttttttattggcaacctcacccgccaaattctgatgtcctgaaagcttcaatgcgttaagattcatgtaccgaatcctttttgaaacatcagaatcaataccctctctttttaactgactggtcataaattgtgcctgttcctggctaaccatgttagggactttagccgttgaatctagtgagaaaatatattcatcatccttgaaatgatccatgaacctgcgagcaacctttgtgtcagctccggcatcaatttcaccattatttgaatcttcaatactgggcaaagtgacattaactgctttgtatgcgcttaatttttgccacggtttcaaactgtctagttgttgttgtagatttttttgatttaaaacagtttgattcattaacagcgttaatgcggcaagactagctaaaattcctgccatccaaactaagttttgtttcatgttactatctgtttttttcaacgctttagctaagttatcatgctgaataatgatgaaaaaaaccacgttaatcaaaacaacaaagctcatcaatataacaaggtttaaacctaacgttgctaatagcgcatatgatgataatgaacttaaagcgacttgattaaataaaacatatacgccccaaagtacaatcgaaactaccgccattataaataaatctgacgctacacttttagcgagcgtcttcttcacccctcccagcatccgcccgaccagccaatgtttgcgatacaaatttagcgatgcaaaatatgagactaagaaagttaacaccagactccaagtaacgactgctaaaataccatttgcccacatctgacttccgattatgtaccaaggtaattcagtcgacgtaacttggaccccaatttgttgtaacttatcaattaactctccaggaagtttactagcactataatacatgcctttatacgatgtatccttcaaggcagttaactcatggaattcagccacatgatcagcatcggtaccgaaagaaaattttctttcctctccattttcatcaataaatgtgcgatacagcgtgacgtcaaatttatctgacccatcttttaatactttgtaaacagctgaagagtttagggatgtatctgtagatattcgagttgtgtaccgtacaggaaacggaatatcttgtgctgattccatcacttgagttaccccaatcaatccaaaaatcaatatgccggatgcaactaaccatttttttattttcataattttatcaataccaatgcatgtatgatgagcagcatccaccacctagtaattagaaatagtaccaaccccgattgctgctgctgacaacaatacttatctatgtgcgtcaaaacaacagtaaccaatataaactagtcttttgtatataaccacaccgctaaattgacagttgtaaacttgtgagacgtttaagctgaagccaaagccaaacagtatgtggcatttttcaaaaaaatacggaatacacgatgcttgaccggataaattcacagcaaaaaaggagttgcttggccatacggcaatcaactccttgagtaaaaagcccaagacgaaacagacgtcttgggcttcctttttaaactcttattgtacagtgaccgacttggccaagttacgtggacgatcgacatccaagccacggccgagtgacgtgtagtatgccaacaattgtgttggtaccactgacaacaatggcgacaacaactcattcacatcaggcaagatgaaatcatcaccttctttagccaatgattgcgtcacaatcgtgtaagcacgtgagccacgcgcttgcgtttctgccaagttaccacgaaccaggccagctgtctttgcttgtgtaatcaacgcaattactggtgtgccgtcttcaatcaaggccaacgtaccgtgcttcaattcaccagccgcaaatccttcagcttgcacgtatgaaatttctttcaacttcagtgccgcttccagcgaaactgttgagtcaacaccgcgaccaataaagaaggcattccgtgactcaaccaaatattggttagcaacttgttgcaacgtttccttgtcatcaacaattccttgaatacccacggcaatcttagacaaatcttgttccaaatcaaaaccaagcgttgcacggtcagcaatcgcataagccaaaattgcttgcaaagcgacttgcgccacgtaagccttcgttgaggcaaccgcaatttcaggacccgccaacaatggcaatgcataagtcgcttcacgccatagcgttgacttctcaacatttgttagcgtcagtgacttaaagccttgcgcgttaacgttttgaagcacttcacgtgagtcagccgtttcaccagattgcgtcaagaagataaagaatggcttctctgacaataatggttgctcgtaagcaaactctgatgacaagtgaacttcagttggcacacccgcccattgttcgaacaatcgcttacctaccaaaccggcgtgatatgacgtaccagcagcgacaatgtacaaacgatcggctgctttaagatcgttcaaaatggcttgaccgacgtgcacgccaccttcattatctaggtatttctcgatcaagtggcgaatcacaattggctgttcatcaatttccttcaacatgtagaaaggatacgtacccttatcagtttctgaagcatcaatgtccaagtggaatggctcacgggccgtttcgttaccatcagcatcgaagagttgcaccttatctgggtcaataatcgcaatttcaccgtcatgtaactcgataaaatcgtgcgtttgatccaacatggccaccgcatccgacgtcaccacattaaagtcttctccaacaccaattagcaatggtgacttttgcttggcaacgtacatacggtccggttcattacgatccatcaacaggaaaccataggcagagttagtgtctaacaagctgatcaacttacgcaaggcgtcaaatgttgacatgccttcatccgcaaacttaccaattaattggacagcaacttccgtatcagtgtctgaatggaaagtcacatcggctaaatattcttgctttaattctaagtaattttcaatcacaccattgtgaaccaagtaaaaacgaccgtcggctgacaaatgtgggtgcgcattatcaattgatggcacaccgtgagttgcccaccgcgtgtgtgcaataccgcttgttccagtcacattttttgtaccaaccaaggcctcaagttgggcaacacgacccttttctttcactagctgatcagttcccaatgcttggtcagcaacgaacaaacccgcagaatcatacccacggtattcaagcttttccaatcccttcaacaagattggtgctgattgataatttaatcccgtaaatccaacgattccgcaatacatattttgttccccctaatgcactatcataaacaaagtggtatacccctttgtttcttcattgcgttttaatacaatacctataataccgtttaaaaaagcacggtcaactaaattccagtatattttattttaattggtaaaaattggtataggtttacgtatagaccaattccgaatgattagcgctaacgattagctgaaaccgcgtcccacttgcctttaaccaccttaagcagcgaaccaaaaaaggccaggttacacgtcaatgtgcaacctggcctttaacaattaatcatcgcttattgatgcttcttcgcatccttagcggggtgagtgttcgtattcatcttttcgaaggcacgaacagcgcgatcaactttcttattcaacatgctcaaactaaacatatgaaatcccccttttcattttgctattgtaaagaaaccctttacaaacttgtaatatttggtttttaatacattaccgcgaataatacgtattgtcaaccctttatttcgtgaacgttagtgactcaccgtgttgcagcaaatcaacacccgttaactcagccttttcaccgattctgagtggtacgatgaagcctacaattttagcaattgaccaggtcataacgacggaaacagcgattgttaaaacaattccggccaattgcacacccatcaagtgccaattcccttgtaacaatccagttgtacctgccagcgtttttgtagcaaacacacctgttagcagtccaccgaatacaccaccgacaccgtgcaagccaaatgcatccagtgtgtcatcataacccatgcggtatttaatcaccgtcgtcgcaatgtaaacaactaacgacacgaccacacccataatcgctgccgacaccggctcaacgaagccagcacctggtgtaatcgcaaccaatcctgcaatggcccctgacatggccccagcaaccttaacctggtggaagaccaacaagtcgaacatgacccatgtcagcataccggccgaggccgcaatacttgtgttaatgaaggccaacactgccacaccgtttgctgctaaagctgacccggcgttaaaaccgaaccaaccaaaccatagcaagccaccaccaataacaacagacagcatattgtgaactgttaacgtagtagcctgcttacgctttccgatgatcaaggccaaggtaagtcctgatacaccagaagaaatgtgcaccacatcaccgccggcgaaatctaacgcacccatctgagccagcaaaccaccgccccaaaccatgtgagctaatggcacatatactaataacatccatcccagtagaaacaagataaacgctttgaagttcattcgcccgactaccgaaccagcgatgattgccatggtaatcatcggaaacatcccctgaaacaacgcaaacgccccatctgggatacttagacctcgtgagctactagtcatggataccccgtgaaagaaggctgcccgtagatcgccaatgattaaaccgtgtccactaaaagctagcgaataaccaaccgcaaaccacacggtaccaccgatagcaatggcaattagcaccatggctaacgtgttcactgttgagcgcacatctgtgaatccaccatagaacaatgccaatccaggcaccatcaaccaaactaacgcggcactgacaagtacccatgcaatatccgaccccaccatatcgctacctcctgatatctctcatcgacttctaatttataatcagtataggcactcgctcattgcacattcacaattgtgttaggaatgatgacatcggctggtctggaccaatgcaaaagccccagctagtagcactcgtttaagaagctactagctggggcttttgcattaactattatttcagttgcgttttgacgtacgtcgcaaaatcagtatgcgaatcctgcgcggcttgccaatattgttgcaacgtttgattatcgattgatgaagaatcaacgcccgcgttgtaaagcataatacgagcagttgatgcatcaaaagttgtcgttgaagaagtcgccggttgactgactgctgtgctaaaactacttgcaatcgttgcctgttcctcggcgacactactttgtgattcagaagccgtttctaccgacgcactagcattagtcgcctcatgactcatttgcgttgtaacacttgctgtactggtgctcgtctgagctgaactagctgaggttaccttacgggcagaacttgtttggtgtgccgtgtgatgcattcgctgattttgccccaggacatacgcaccaattaacacgccaatgataatcagcatgccaatgacaagaccaacccctttacctgtttgtttttgcatgtatccacctactcaatcgcaaatacgggtgtgccagcatcccaatcatgtgggtcagctgacaaacggccaattaacccatccaccgagttccaaccattgtagaattggtggttgtacggatcaaaaacttctgtattcccatcactatagccgtaagctgcgaccgcgtgaccaatccccacgttaatcaaaaaaataactgggtagccatcacgcaaggcatctttaacttgcgctggcgttgtaaggttgcgtgttgtatgaccgaaactattgaccatacgaactaagtcacgacctgacgcaccatatgacatgcttgcgccacccaaacgattagcaacatcacgtggtgtcgtattgacgccatatgacccattcataatcatcgcgatgcttgaaggaacacacccagttgccccaaacgtgccaccgttaaaccaagtacctgaccaacggccatcccactgtgaaaagtaagttggcttaccaggtacagcccgagaataaaaagtaccatcgttaccaaagtagtacttcttgttattgatcgtctggagtccttgtaccgctcgtccatcacgaccaacataataattcatcccccaagcagtttcccattgcgagttctgccggacaccattctggaaccaatagtaggcacccatgtagaaacggaatcccgtaaagttggccccattagtcacccaacgccaaccactattattcacgggcacataggcatctttaaccttacctcgcaaaaagaatgtcccattgtcaccaaaactgtacaccgtcccattaatcgcttggttaccctggacggcccggccgttatcatccgtataataacgcatgccccaggcatcacgccagccggcattttggcgaacaccattaacaaaccaataatacgtccccatatagtaacggaagcctgtatacggtttcccattttcaagccaattccaaccaccattagccgtagatacttctggcgaataaatataacctgttcgattatctgccgacgccgacgttgttagtagcgaagttgcgcccaaaacacccacagctcctattaaaagagcttttactaccttattcatcacattaactccccaaattcaatcttgttacatatttcactttttataatgcgctatcttgcggttaaaaacaagcatttttacacaaaaaaagagtgcccaaaatagcactcttttcgttattattcagttggtacaccattggcaatcatcacatcagtggaaatattgccaccatataagttacctgtattagctgctggcaagcccaacgccttgcgcaacacattggttgcacgttgttgttcagagcttgaaacgacttcagtagagccagacgtcaaactgtaacccgttccttgaatgtgatcattcttcacgttgttagccgcccctgaatactttgtcgcaattgctaacatatcgttgtagctcaagtcagtttgcattgatgaagaaattgaattcaagaaatctgtattcaacaactttgttggattgctcttcgctgcgtcaacaattccttgcagcaccaatcgctgacgttcctgacgaccgtagtctccctgtggatcatcgtaacgcatccgtgagaaggccaaggcagccttacctgtcatcttggtgtgtgatacaccgttgtatgaccacgttgttgatccttgcgtaaagctgtacaaatcacccgcgtcagcgtgagccgtctcagggttgtacgcaaacgtcaatggtgacgtcaccgtaatgccgccaactttgttaacaaccttttccatgccacccatgttaaccaatgcatagaagtcaattggaatatttagccagtcctgaatcgtcttaattgttgattcggctgatccgtaagcatacgccgcattaattttttgtgggaaggtatcctcatacccatcaatcgcgaccaacgtatcacgtggaattgacataatcgtcgtcttatctgttttaggattaatggtcacaatcatgattgagtcagttcgacctttgtaatcacgtcccaaagcacccgtgtctgtacccaatagcaacaatgacaccggcttaccatctgacaagaccgccgacacatcacgcgccttcttcatcgtcggtgccacgtatgacttatcgatagcactcttagtctgcatatatgcatagccgaataagccagcaattaccaagacaatcaccaataagattgataaaatccaattacggactttatgtgatttctttggaccctgattttttggggctttttgtttttttccgccacgttcattcgctaagcgacttgagcgtgaaacgggttgtgtttgctcgttatccatgagccactccttctcaactgtaatacatacttgtgcatttattgtaaaacgaaactgactgaattgccgtaatttcccgttgatgtttatttttttataaacactcccgtacttgtagtcagtaattcagcttaaaaaggccgttacatgtcctaaagttcgaaaaatctggcgcaaaaaaacggtgaccgaactgttatcgatcaccatctcttaatttcgactagttttcattgatacgagctgcgactaataacgccatccccatcacaccaataaatccaccggctaaaaatgacactaacatcatcatgatttgccctcctctatttcttctctatctcctcatattactaatcgtttatgaatgatttacgaaggttgttctactttttatccagcgatttgaaacttgaacgtcaccgccagatattttacacttatgttcggaggcagttcacaatatgtatatactgggaatcattttagcttttatccttggtggattagttggcgttgttggcatggccatgctagtcgctggtcgccgttcagaaaaagattaatcatcacaaaagcagtcaccggcacaatgtcattggtgactgctttttactacaataatttatttagcacccagaacagcactcttttccgccaaggcaacgagctagcgtctgactgatattgtctggtcatttgtatcaatcgtggcatgtttagccagccgccagattgacggcataagcgtcgactatccatcacgactgtgtccgcaaccttcgcagcacttaatgcaactggcgctatcggtcgtaacgcttctaaaaagcactgactattggccacgatatcaaacgataagcgacgtgtcgttgactgcgctgttggtaggtactgataatagttcgccggtacaaatcgtacgtcggtcgccttttggcaagccgcgacattaaacaacatatcttcacccatgtgcaatgattcattgaacattagattagcacctctaattaattgtgtgcgataaaatttattgaacggctctggccccacaccttcataactcgttaacaccggcaattttaacagtacttgcattaattggaagcgactcgttgcgtttaacaacatgtcatgtgcctggccgtttgtaacaaacaacaccaaatcaatttggagctgctgatctatcaggtgcgtctttataattttattaagcatgacgccattcacttcatcatcagcgtcaacgaatgcgagatacatccccttggccaccgctataccttgatttctggccgatgctgcgccaccatgctgtgcgatgattagtcgaccattctcaaataattttagctgatgtcggattacgtcaagacttctatcagtggatccatcatcaataaaaatcacctccactgcagtgactaaccgcaactgttgcattaaggccggcaacgttttggcattgttatacactggcacgataatactcagtagtggttgccctttaaattcactcatcgtaaatactttctcccagtcatttggcgccacatgattttgcataaatcacgggtctcaatttggcaactgaacgacaagataaaaacaacactatagccaacaacactacccatccccgtaaaaattaagcctagccaccccatttgtggtagccacccatgacatacatagtgcacaccaaccaaacccgctaacgcaacatgataggccgtaaactttactaaagggcatttggcactttgttgaaagccatgtttgaaaaccagccacggctcccgccagaaattaacgactaaattactaacaatattccccagcaacaccgcattgattcccaaatcagtttgcgtgattagccacaaactagttcccaaattcacacccgcttcgactaaagatttatatcgcatggtccaaaacaatcccaacgctgctgcaaaacttaaatttgcttgtcgcaacatcgtaaatcccaaattaatcacgattaaaaagaccgtgaaatcagccagaacatatgctggtccaaatactaaccgaatgaaatcctgcatcacagtaaagcagccccctgctaagaccgtactaactaacgcaattaaacataagttgcgatagtacgcaacttgctgttgcgctacgctttcggttacgccaatgtggccaaaaacgccaacaatcgctgccattacctggccaactaaactacttaacccttggacaattaacgcgtaatttgtataggcacccaaaacacttaatcctagatacttagcaatcaataaattatcggtaccgttaacgacaataacaccaaccttcgctgaaatatttccaaggacgttctctcgtaatttttgtttgatggtttctgggatgcgttgcgatgaacgccaagtcagcattggatactgttgcttagcccgccaattaatcaacaaattagcaagtagcgttcctccaatgtggagcattaagaaggccacatagttttgccaaacaactaggacaacaatttgcacaatgttttgaatgaaccggcatcctacctgattgatattattcacgtacgcgcgttgatcagcaataaacaacgaacgggcatatgagaaaaaataactcaacgccgtgccaataacatacaagtaaaacatgaactgaatatgtggaattgttagacccggctttacaaagaacggtaacccggccgctaataaaaggcccagtaataaaatggtaaatccaatgccaccgtacaaacgtcggtaacaagtcagcagcgcatccactagtcccatgtctcgattcgctaatggtcgatacaacgaaaatgtcatggccgctccgatacctaattccgcaaaggacaaaatattcattaaattattaaaaagaccgtttgcacctaaataattagctgacatcgtctgcacaaaaacgatttgcatcgtaaattgcgatgctagtgtcacaagttgtgctcccgtggctactactgtatttttaaccgttgccgttgcatgatttatcatcgccattcctccttcattacataggttttatctgggaacatggcgttttcatgaatcattggtgcgtacgtattgtgatacttagtgccatagtggtaagtcgcaaagctataggttcctactaaaagccccattatcgctaataagagccacttattccgttgcgttagttgtcctaatatctgcgcgaaaatagcaaaaacaactattagcccatcgattaaaatacgatcaaaattgtaggccaccaaataaagcggcaccatactataaaaaagcaatgccatttgctggcctaacctaattgacgactgtagtggttgattatctgtctgcttgaaaatggcttctagacgccaaaatagcagtaataacacgacagccatcgccacgtctaatatgataatcatacctggctcgaaccgaagcgcgtactgcaacattttcgggccgatcaccggtaaccgtgtggcaattgcctgaacgatcaagacgtaaatatgacgtgtcaccggcacagcaattaacaaagcaccagcactaatgacaccaatgaaccataactgtgcgtttcgcgttcgcaatcgtctcatcggcaacaacaataaaaagaatactgccgctaattgaatgccggcggctagacccaccaacatcacaaaatacatcgtatcaaaccgtttgtcccgccagagataagcgatggcaacgaaaacgacagtggccatcaaataatttcgtagctgtacccccgattcaaagaactgaatggcggtataacataacaaaaccacccgcttattatcgacttgaaagatgtttaacccccaagccatacaactcatttcaatcgtaaaaatgactaatttaaactgttgataggacaatcccaccttagttgccatctgcatgacctgattaaaaaccggttcaaactttgttggtacttctggatgtgtatagtaccagttgtaaacccaattgtcggacacggtaatcggtacataggcaaatataattgctaacagaaccaaaaacactatcgacacccgttgctgacgacttggtgtaagcaataacaggattaattcaatcaggactaaaccataaaacacgccgaccattgcttactcaccacctttagcggaccagcacaagactagcgcgcagccagctaaccaaattagaacgtctttgcactgccggcgccattcgtcatcgaattgccaacctgtttgccaacgccgttttgcctgacatagttggcgcaatacacccaccttatcctttaaggacacctgtcgataacgtaaaacctgaaacatatgactgaacagttgcttattaagcagcatgttaattgccggtacatcttgtggttgcgccacatccgtccggtaatcaactaactgttgcaagaccgccacgacatcgacatgcttcacaacggttgaactttgtgtaatgctgctatcacgcacacaatacttaactaatggggcttccaataccttcacatgactagcccgtaagaacgcaattgccgtaaaagccatatcttcaaaaaaacggcctggcggaaataacaagtccctcactaattgccggcgataaattttattccaagcacctgtgtaaatatgctgtaaattattggtcggtttaaacacttgaataacgttgccctgtcgaattttttggaaaccaaataccactaaatcagtcgtactgtccaatgtttgtaccatttgattaatagctcccggcgtcaattgatcgtcgccatccaaaaaagccagccattcacctgtcgccatccgcatacctgtattccgcacttcactcagaccgcgattaaacgtatgacgatggagaataacgttttcgtgagtagcaaaccggcgacaatgagcccacgttgcatccgtggaagcatcatcgataatgataatctccagttcttgtcgtctttgtgtcaaaactgattgcaacgtcgcagcaatttcatcctgcacattgtaagctgcgataattagtgacagtaccggttgccgattatttctcatagttacttttgtttgcaaaacgtcgctccaaaattttcatagttgccaaagcagcagtttcctgtgcgagtgtcgtaaccgtatcatttagcaccaccatctttgttatttttacccggctacggaataaacgcttcacggcatcaacatcctgaatctctaaataacgaccaaatttatatgatcgcggcttaacacatccagtcaaaatttgataatagcgcatcagccaaactgaaatgtcggttacctgacgttgcttatttgtcaacgccatcttcgttacctccctttcgtaaagtgaataaccattcataaaagaagatttcaaaaatggtatcgcaagatgatgatcgtagaagcgtgtgaaatatggcaatatcgataacaaactcgatagcaaccctattctgacgccgtttctcaaggaaaaggccgcacaccaattagtgaacaaccattctcttttagaaaattcgcggtttattagcgtcatgttattaaccgccgtatgggcaaaatcatctcgtggcattaataaaaattgactcgtcatatcaaccaccttttcaccatctgccgtaaaaaaatcgcttggctagactggatttgtaaacaaaaaatcatcatttaacaagataaagtgttcgtttaaccccggaatacgccagcaatgcagttcaatcacattcgaattataagttggcaaatactcgcttggaataaagctagtatgatctacgacaaccaactgtttactgtctttaataaagctaggccgttgctgatcagtgacaagatatattttgtttacccatggcgcatactgcgcaattgaacgcagcaaatatttcaacgtaccaaaatcacgatatcgttggtccgccgattcgtgctctggtaatgacacgtgttgtgacctgcgttgttgccaagctaaatcactgccatcaacccaggggatgacgatatcaatcggcatcttcgttaactgtttcattggttcatccccaccttatccaccttaagataccgacggtaaatgccggtcatgattgtatcaacacgtgactcatcaaattgcattaagaactcggtatactcgtttaatgctggctgtaatcgtttgtcccgcacacgtttaatcgcatcagctaacgccataacatctagcgggttaattaattgtcctaatttttcgtcaattaagtaatctgccatgccggttcccttagcgccaaccatgtataccccatcaattagtgcattaaagccacccatgccaaatccttctcgtagtgatggcatgacaatcatgtctgcagcgtaatgtaaatcttgtaaattcgcctgatatcccaaaaacgttacttgctgcgacaagccaagttcagttactaaccgtttagttgttgcttcagccgctccaacgccagcaaagaatatctttatctgtggatttgataatgcatgcactgcttgcaagagtgttgcttgatttttgcgagtactaaactcaccaacttgaatgattgcaaaatcatcgctacttaagtcaagacatgcgcgcatccgtttgcgaatcgataatcgtgtcactggcaaaacggctaatgaccgctgcactggcgcaccaatactgggcaaatacgtgactctttgtaccggtaaaaatcggctaacagcctcatcggtgtgattaatgactaacaaatgttgcgtcagccaagccaagaaccactcaatcggaaagactaaccagtttttaagtggtccacctcgaaagaaatgaaacccatgcgccgtataaatgactggacatcccgtaccccacgatgccaaccgcgttaaagctgccccaatcggcgaatggacatgtatcaagtcatactgattttccccaattaaccgacgtaattgtgtcatcacttggtagttcaccatcaaacgcccaagtccacgatcaaaattaatttgatgtaagacaattcccatttccgtcaaatccataatcagttgacaattggtctggtcatccacagtcccaaagttctcaaaatcagctgccacatggacttcagctcctaagttagtcaaaatcgctaaattccgcatattaaattgttgaatcatgttcgccttggcggctaccattaatacctttttcaaacctaatccccactaacctacgccttatcaatatcagactgttgcaggaccttaattaaagtcgccccaacaatactagcatcgtgcgtaaaactgacttgcttggcatacgtaccgtcatactttgctttttgacagtctgaaacgttatttctaccactcacctgtgctaaaccggtgataccaggcaacacccgatctgcgcccagtgctttacgtttctcaataactgccatatcggatgctgctaacggtcgcggtcccacaaagctcatctcaccacgtaagacgttaaagcactgtggtagttcatccaatgatgtacggcgtaaaaatttaccgacagtcgtcacgtaggcatcccgattatgaaaatcctgatgcgaaaccagtggtgctgacccaaccattgttcgaaatttataaacttcaaacggctgactatgacggccgaatctagtttgtttaaagattggattttcgtgtgtgacaagccaaatcgtacctgcaatcacgatcattggtagactaaaaatcaccagtaataaacttgcaaaaatgcaatctaacatgcgtttaatcaatttttgatataaccgttgcccaatcattttttaaacgtttccccataaccataacttgcataacgttgcttctttttatctcggtgtaccacaccaataattggtgtttgactgagcttcataatttcgaccgtgcgtttaatatttgccttttttgtttttcctaaagcaacaaccaacacaacaccatcaacctgtttcattaacatttgggcatccgtcaccgctaaaactggcggtacatcaatgaccaccttgtcataatgcgcattagcccaggtgattattgttgtcatcttttccgatcccagtaattcagccggattaggtggcacgggaccggctgtcaatacatctaaccccgtgatttgtgttttttgcaccgcatctatcggcatttttgctgctgatagcaccgtggttagccctctgtttggcaatactttaaatgtcgcctgagcagtggaacgtcgcaaatcagcatccacatataacaccgactgtcctgactgcgcccatgtgacagctaagttacttgcaactgtggttttaccatccgatatttccgccgatgttaccaggacagttttaaactgtggcaaagtcgcactaacaaattcgatatttgttcggagtgtgcgaaattgttctgataccggattcttcggttcgtgatacgtcactaattgtgccccagagttttgcgtcaaattattatcctgacgttgtttgtcaaataacctcattatattcacctattaaatacgttgtttgatgcgtgagacaccctgttcatttagcattacccgtcgttcttttaaacgaccaatgcctgtgatcgttcctaaattagtgagtcccaactcatccgtcataaaagtctctgttttgattgttcgatcggttaattctcgaatcaccccaatgaccaatcccaacccaacaccggccaccaaaccaaccaacaccattaattgcttattaggtgccgccggttcagttggacgcgtagcccgcgaaacaatcgacacatttgagacagccataatatctagaatttttgcctgaaaagcatctgcaatggcgttcgcaatatcgcgtgccgccgttggatttgaggcatcaacattaattgagaacacttgtgaattcgtcaaactagaaacattcaccattctaacgagctgtttcgccgtcaagtgactatcaacgtacttagaagcgcgccacttatattgcgctggctgagccgcggtaatttcaacagtttgtccaaacgcatcagtcatgtgtttagcaggcaggcgtggcactttctcaactttagttggtaactccaagcgtttgattgcctcattcaagatgattggacgcgtcaagatatccttgtacgtctgaattagctgcacatctgcttgttgatcacctaactgcacaccttgctgtcctgaagtcgtcttacgattaactaacagtgccaccgtcgcccgatattgtggctgcatgacatgcgtcgcaatcccataggcaatgcctccagcagcaatccccaacagcgtcatcaacaacacgttgcgtttaataatttgccataatctacctacatcaatgatgttgtccataattaaatactcctcaagaatgtcatctcaaaaataagtaccgccagtgtagcatttattaaaaagcgacatattaacgcgatgtaacagcaaaaaacgactgatttcgcgtttttaacactgaatcagtcgttttagctgacataatcctgtattgaagaccagcattttgcctatcgatttgttttatgcaaacggtcatagtatatttcagtcccgtatcttaatgccatcattcttgttgcatgtaaccccattaactattactgaattttcgttttgtcacaaaacgttaatgtgttttgtgcgacaaaaaagactgatcatcatgttgatgaccagtctttttaataagctgaaaatagcctttttttcttaattggcactatttgttgccttgaaacgcttgtaccattaattaaggctttcgcattttcgttgaattcagttgctaaacctgtaccataggtagccaccaacttctcgaacactttcgccatattatactgacgcccaggcaactgatgggcatccgaggcaataatctgagctaagccgtgacttataatatcctcactaaatgccatcaccgctttcccaaagacaccaacgtatgaactcgcggtaacctgcgtataagccccctgtgaaaccaggtcgtataacaaacgtggttcctgcatcaacctgtgattccgttcaggatgcacaattaccggcgtaatccctcgttgttgtagctgaaacaatatttcacttgtatataatggcacctcgttggccggtaattcaaccaacagaaacctgccctgcgtgtccgttgttaaaatatcacccgcatccaatgccgttaataattcactagtcaatcgcacttcttgcgctggaaaaaccgttaacgggattgctaatcgatctaattctgtttgaaaaacagccgtcaaattaataacatcagtcgcgtgattaatgaattgaccgtccatgtggtgtggtgtcaccaacgaatgcgtaatcccctctattaccgcgacacgagctaattgtattgatgcttctagcgagcttgacccgtcgtcaatatttggtaataaatgactgtgtacatcaatcatgtgactccccctgttcatttgtaccttatcactatacgggattcacaacagcgacgccactctttaaacaaaaaagcacccaactatcaaagttgagtgctttttgaaaaatcgttagtcgaattaaatcgtcaacaattccttttccttttcagcagcgataccgtcaatattcttaacagcggcatcagtagccttttggatgtcgtcttcaagcttacgtgcttcgtcttctgacatgtcaccgttcttcaatgccttcttggcatcgtccatggcgtcacgacgaacgttacgaaccgcaaccttagccttttctgactcacccttaacttccttagccaatgacttacgagtttcctcagtcaaggcaggaattaccaaacgaatcactgatccgtcattagctggtgtcaatccaagatcagaagcaaaaattgcttgctcgatatccttcaagattgacttgtcaaatggtgtaatcaacaatacacgtgcttcaggcacagtaattgaagccaattggttcaaaggtgttggtgccccataatattctgccgtaacattacgcaaaattgatgggtttgccacaccggcacggatattaccaagctcgcgacgcaaaacgtcagcagccttacccatacgctcgttagctgaatcaagaattggattagccatattagtttacctccacggtcgttccgatattctcgcccaagaccacacgcttaatattaccagccgtgttcatgttaaagattaccaaattgatatcattgtccattgacaacgttgaggccgttgagtccatgaccttcaaaccttgcgcaatgatgtccttgtgcgtcaatgactcgaacataactgcgtcagggttcttacgagggtcatcgttgtaaacaccgtcaacaccgttcttagccatcaaaatagcctcagcgttgatttcagcggcacgcaatgcagccgttgtgtcagttgagaagtatggtgaacccgttccggcaccaaagatcacaacgcgacccttttccaagtggcgaacagccttacgacgaacgtatggttctgccacttgacgcatttcaatcgcagtttgtacacgagttggtacgtcttcagattccaaagcatcttgcaatgccaaggcgttcatcgtcgttcccaacataccaacgtagtcagcttgggcacgttccatgcccaactttgcgccagcttccccgcgccataaattaccaccgccgacaacgatagcaatctcaacgccaagttcgtatacatccttaatttctgccgcgatactcttgacagtttcaggatcaattccgtagccgcgttcaccagccaaggcctcacctgacaacttcaaaagtacgcgcttgtactttacgtctgccattatttaataagcctcagttctgattaaccgatttgagcagcaacttctgcagcaaagtcagtttctgccttttcgataccatcaccaacttcgtagcgaacgaatgacacaaccttgccaccctttgactctacgaacttagcaacagtttccttaccgtcacccttaacgaatggttggtcaaccaatgagatgtcagccaagaacttgttcaaacgaccttcaaccatcttttccttgatgttgtcaggcttaccagccaagtcttctgagttcatttgaacttccttctcgtgtgccaaaacatcagcaggcacttcttcacgtgaaacgtagtgtggtgcaattgcggcaacgtgcatagcaacgtccttggcaacttctgcatcagcaccatccaacaatacaactgaagaaatacgtccacccatgtgtgagtatgcaccgaactcttgtccttcagccttctcaacaacttggaaacgacgcaaagtgatcttctcaccagtgatttgtgtcgtgtggataatcatctcgttcaaagtttggtcttcagaaaccttcaactccaaagcagcctcaacgtcagctggcttgaattcaacgatagcgtttgcaacagcgtgcaacaagtcgttaaactcagcgtttccggcaacgaagtcagtttgtgagttcaattcgatgattgcggcagcgttatccttaacggcaacgtaagtcataccttcggcagcaacagcatcggccttcttagcagcctttgccattcccttttcgcgcaatacgtcgattgccttgtccatgtcaccgtcagtttcaaccaacgccttcttggcgtccatcattccgacaccagtcttttcacgcaattccttaacttgtgaagcagtaatagccattgttatggtctccttgttaatgcaaaatctttatctaaattagtatacacgaaatcttctaatatatctattatatcgcgcaaaattcacggctagatgcattagtatttcatacaaactctattataacgaaaaagaccgcctaacaaaagttaagcggtcttttctatcgacgagatcgaattagttgttaccttcaacgatttcagtcaattcttcgattgaagctgccttgtcagcaccttcagctgcgaagtcttctgcagcaacagcgtcttcaccttggttaccctcgatgatagcatcagccatcttagcagtgatcaaacgaacggcacggatagcgtcatcgtttgatggaatcttcacatcaatttggtcagggtcggcgttcgtgtcaaccatagccacgataggaatgttcaacttgtgtgcttcttgcacagccaattgctccttgtgaggatcaacgatgaacaacaagtcaggaatcttaggcatatctgcgataccacccaagaacttctccaacttttcgcgtgacttgttcaacaaagccacttccttctttggcaaacggtcgaaagttccgtcttctgccatagcacgcaattccttcaaacgtgcaacacgcttttggatcgttgaccagttagtcaacgttccacccaaccaacggtggtttacgtagaacatgtttgcgcgagttgcttcttcagcaattgcatcttgagcttgcttcttagtaccaacgaacaaaaccgttgcaccgttagctgctgcgtcgcgaacgtagttgtaagcttggtcaaccaacttcaccgtcttttgcaagtcgatgatgtagatgccgttacgctccgtaaagatgtattctgacatctttgggttccaacgacgagtttggtgtccgaagtgaacaccagcttcaagcaattgcttcattgagataactgccatgagtatctgcctccaaatgtttttccacctagcctcgcatgtaattccgcgaccccgagggcacccgtagaactattgagtactagtgagtattttattgtggtcaaagaccatctatgtataatacagggtttttctacctcagtcaagcattaatctcgctttgccggcgtaaaatctgtgacaccatgttcccgcagaaaagccactttatctacccgttttaacttcttaaagactgcctcagcatgcaaggcttctcccttagttgcgaatgcttcagcatacaacaatttcaatggatgccgactcgccggacgtgtgtacttagcacccttaccagcttcgtgtgtggcaaaacgtttaccaacatcatccgtaaaaccaccataaaacgtgttatctgccgttaacagcacgtacatataataaggcttatccattgctcttgccttcgtaaatatcccagacagctttcgtataagtatcatcatcattgtgcgtcacaattggtggcaaaattgtggcccccgttaacgcaccgtctttaatcgcatcaatcaagaggacattagctggttcacccgcttttggatacacaaactggatgcgcttcggtgccaaatgatttttctgcaatgattcaagaatctcgaacaagcggtctggccggtgcaccatgaaaaaatgcgctttattcttcaatagtttcttagctgtataagtaaccaaatccaaatctgctttaatttcatgccgcgcaattgcatagtgctcatcttcatgcatgaccgtattttcattgtcgaccgtaaaataaggcgggttggacacgaccatatcggcagatcctggccgaatatccgtaaagatgtcgcgcatatctttgttaataatcgtaattttgtctgtcaaatcattcatttggacagaacgcgttgccatatctgccaaccgttcttgaatttcaaccccaacaatttgacccgcaactttgtgtgccataaacaacgacaccgccccgttgccggcacccaaatcaacattcaacccacgaccatttttacgtggctgtgcgaaattggcgagtaagaccgcatctaacgaaaacgaaaaaacctctttgctttgaataatatggacatcatcgttgtacagcatatcgatgcgttcgtcgggtaatagatcaactttcatgtttgagttctcctgtatgtttgccaacagcccgcttcctgtgggataatgaagcgttattattagggaggaacgaatatgttctacacattcatacgttttgtcgcagctggcgtcgtttggctcattaacgggcgttataagcttaccggccaagacaatctacctgaaggcaattatattttggttggtcctcaccgtacttggtgggatcccatcttctacgctcttgcggcttggccacataaatttagcttcatggctaaaaaagagctcttcaagaatcctattttacgctggattctgattcacgccaatgctttttccgttgatcgtgaaaatcctggtccttcggcgatcaagatcccagtcaacaaccttaagaaaactgacctgggtgtaatcatgttcccatctggtagccggcactcacaagaaatgaagggtggtgctatgatgattgccaaattgtctggtaagccccttgtaccaatggtgtatcaaggacctgttaagttttctggtttgttcaaacgtggtaacgtcaagatggcgttcggtgagccaatctacgttgacaagtgcattaagttaactgacgaaacaatggctgagtttggtaacacgttgcaggcggcatttgataaagttgacgcctcgattgacccaaactgggtatacattgatcccaagcctaagactgaaaaaattgaatcaaactaacaaaaaatcctgagcaaaaattcaaattgctcaggattttttatttacaccaaccgtcgtactacgccgtcaacaatgtcataccatggcacagcgtaagcccgatcgtcacgatcaacaacatcgctcagtcgcgagacgccaaccccacctgttggtgaacttggtgaatcatgaaggaagtattgaccaccaagataaatcccgacgtgcccaatatgatccataaagaatatatcgccacgtcgaatgttcgaccatggcacaccttgacctaagctagtttgtgaataagtcaccgcatcccccacattaccagcgaagacacctgaattagcaaagcaccaacgaacaaacgaagaacaatcaaactgccgggctgcgattgaccagctattacgcccgccaccccacacatatggcgagtggccaacgagtgatgtgccagtgtcaattgcatgctcaatttgccaattaccagttcgcacaacgccaccgccatccgcccaatactcgttaccattttcccaaacggcctcattcgtcgctttcaggtaagtccccggatggaaatagtacaacccattctgccaatatttgtaccctgagacacagcgtccggtctcatcatacatataccaagtgccccatcgagccggttcgtacacattcgtatgcttcaagtaggttcgcgcatcaaacgtataataaccacccgcccatggttgcacatcagttagaatgcgaccgtcagccccaaacaaataccacaatccccattgtgacgccgtataggtattgcgcatcatgcgaccgtcacgcaagttgaacatgtagtacgtgccttggaacttctggacgcccttttgcttcactccattacggaatagatagcgatgtttaccatcactcaggtaaccagttgctcgtttaccattttggtagaaaacgccttttttataacctgtaaatggtttgggtttgaccactttcttagtaactggtttggctgttgtcgaagcagcacgcttcgcaacggttactttagcggttgaaacagtcgcatgcttagtggcttgtggcgctgccttagcagatacgacttgcgccgttgattttggcacttgtttcttcacgactgctgcagactgatgcgtagcttgtgcagaaggtgtcacttcccgagttaatccacgccgactaaccgttgtagatgcagacgtcactgatgacacactacttggcacaatttctgttgctgccgaggattgttgtgaggtggctgacgaaacttctggcgtcgtggccgaactaacgctaccggcattgttcgttccaacactggtgctttcgctcgatagcgcttggccagccgatgccatactacctagcgattcagttgaactgtcagccaactgagaaaagctaccacttgaggcatctgatcccgcacttgtcacactcgtagtatcaactgatgataacgacgtggctggtatgtcagctgatgccgatgccgacgccgagctggcactagtcgtttcatctttttgcaatacaacgacctggtcaggttgtgggactggttcatcagcgaccacacctagttcatccccattgtcatcagctgacacaacagccccaccagtcataacgccaacaattgctaaagttgcagcgacccaaactttacctgctttatacatctttttgcgcatgttcaacctccacttaaagcttaatacttccttaacttatgccaataagtgtagtcgctcacaaacctaaaatcaaaagtcctgctcaaaacaaaaacacaactcagcaaagtgagttgtgtttatctgtcgttattaaattgtgtggtatgccaaaggcgcatcccaaatatcgtgaacgccagttgtcatacctggttgtggcgcatcaatcatcttaccattaccaatgtacataccaacgtggtactcaccaccaactgaaccccagaacaacaagtcccctggttgcgcttgtgacaatggctttggttgtgagccatgtgcacgcaagtatgctgcctgttcgtaagttgtgcgacccaaatcagtcaaatgcgcgtgttgacgcaccaatcgaatgaaacctgagcagtcaacaccatattgcgttgcaccaccccacatgtaaggaattcccaaccagtggtttgcttcttcaatcattcgcgtgccagcatcactatcacgcaggaagaacgtcccatcattaccaaagtaatacgacttaccatcaatgacacgtgtgccttctactgcacgaccaacgttatcaacgtagtacttcatcccccaagcagtcttccacttgttttgctcgcgcaccccattttcaaaccagtaatacgtacccatgtagaaacggaatcccgtaaattgttgcccgttttcgtaccacttccagccttggcctgcatccgtgtaaccagatgtcttaccacgcaggaagaatgtgccattatcaccgaaattgtaggccgtgccatcaataacgtagttgccctgtactgcacgaccctcattgtccgtgtagtacttcatgccccaagcttcacgccaaccagaatcctgacgcaccccatcgatgaaccagtaatacgtacccatgtagaaacggaatcccgtatacttttggccattttcaagccaacgccatccttcgtttgtactaacgtaacccgtttggccagctgctgaagctgagtgatcagcttccatccccatcgcaaacgtgaaactggcaataactgacgcgataaacgccaatgcctttttccctttaaacaatgtcatatttaacattacccctgtctttgatgtttttagagtaacaacccaatatgacatctctattacaacgggcttcttaatattttattaatctattacaacgtgaaataatgcacatcattttcacgctttagtcaaaaacgcattggccagcgtcggtctgtgaatatttttcgaacaatcggtaagccaagggccacataagccatcacaataaccggtgccgtgttcagcaacaccattaatacccatgcgattggtcggccgtaccattgcacccaaaggccaaccgtcgggccataaacaattttaccaagaatcaaaatggcaaaggcgtgcagaaacaataccaccgccgaattttggccaacccaggcaatcccatcacccatttgccaaaggccacgttcaattaactgtgccacaccggccagtgcaaaaatgctaccaaacgctcctaacaacaactgccaaatcggccctgtgaaagttcccgatacgagataaaaagttcctgcctgagaagcccagtaccacactgccaaaccagccacaaacatcgtaaccatgccataaaaaggccacggttgcttcatccaccgttgtgccagatatccgccaagtaggaacacttgactcaagagcaccgcattcaatgaccacggtgtaaccgccggtgctaacaagcctaaaccaaacaaccccaaactgatgacaactaacgtgattattcgccagcggtctggtagtttggcaacaagagcctgaacacagctaaagacaatcgtcgccaggccaagtgcaacaaaaaaccacaccgcccccagtgacatcatccccgctggcatcgtactattattaccacctgcccataaggcgccaagtagcgtgcccgttaatgaccaactggcatgaccaaattttactgctggccattcgtaggctaaaatcagcaacgcgaacacaatatacaataaaatcaaggtattaaaattggttttgatgcgttcgccgagtggcttgggtcgatacaacagaccactaaagaaaaagaaaatcggtaaattacctaaaaacaaaaaattctgacccgcttgaaatgccggttccgagccggacacatggccaacaatcaccattaacattgctaaaccacgcgcaatgtcgatccatttatatctcatcattttccccatcaattacaaaaaaggaccgaaccatcttgttcagtcctttttaacaagccttacttctttgcagaagattgggccttcatttgtgccatcatttggttcaaacgcttttgtgaaggcttttgtcccattgatgtcatcattgacttcatcatctcttctgagataggtgggttgttcttcaagtacgtttgcattgagcgacgtgccaagaagaatccagcaactgcacccaaaacagcagcaaggatgacaatcaaaatccagatactagtattcatcatattactccatcattataattcatatattattgtagcgaacattcgccgttttgactaggttatcccgcgtttcttcgcgaaaacttcattagttgtcacgcaaacccttttcgcgttggatatccttcaccttatctggcgtcacttcattaccgtcatcatcgaatacttggagcatttcaacttgtgaacggaacgcagctcggaagttctcaagaaattcagcccgcaaatccgcgcgttctgcaatttcgtcatctgtcaaaccttctggcgtctttgccttggctgctaattcattaatacgtgtgcgcacggccaacatgcgatctgtttctgccatatcagtcaccacctcattttttatcgttactctattctaccatgaaacaatgtccaacattcacaactcaccgaattactgtaaaatagaagcagatattttacgaggaggataacatgacacaacctgagagcaagcaactcgcaattttgcggtttgtctacgaaaagcaacttgaaaaaggttatccacctactgtccgcgaaatcggtgaaggcgttggcttatcatcttcgtcaactgtccacggccatttgaaccgattgcagaaaaaagggttgttacacaaggatcctgataagccacgtgcactagaagtcacccccgctggtgttgaagccctcggtgtcacaactcgcaaccaaaacatgatgccggtattagatgagcacgaagccattccggccagcaatgaagatagcgactacattgttgattactttccagtgcccgaaaatctcgtccgctttgacggtgatttattcatgctacgcttgcgtggcaatgccatgttaaacattggcatgctcgacggtgactttgtcattgtccgccggcaaaatgacgctgataatggtgatattgttgtggctcgtgatgaagttgggcaaacccatattaaacggctgtttcgtgaggccgatgcgtaccgactccaaccggagaatgataatatgacccccattatcgtccgcgacctaaccatctttggcaaagtcgtcggcttgtaccgggatgccatttattaatacgctcctaaaaacaaaaacgttcgacacgcaatttgcggtcgaacgtttttttacttcactgccaagaactgtttaccaagatagttctttccggcactgaggtcatattgcacatatttcaagtcagttaacaacgcttgttgcttctttgttagttgtttttccttaatcgtcttgccttgctcatctacaaacgtattccgtgtgtaattggcaaaagctggcatctgcttagttatcgccgtttgcaaagcaaagtatggtgaaaccttggtgttcgttgcctcgaatgtcaacgctggaaaatcgcttggcgacgcgactgctcgtgttgccaccggtgtcttccccgccaattttttagccgctggattctgataaacgaagtaatccgtctcgtgagctaccttggcagccgcttgcgcatccacgaatgtaaagacgcccggccagtgatcaccatacaggaccatcgtaattggtcgttcagacgcatctaaccgcttaatcaatttgcctaaggccacatcactgcgatgaaccccttctaaatagctctcaatttgctttttcgtgctttttgagaccgctggggtttttaccttatagtgattattaggatactcacccgctgtataaggcatgtgattttgcatcgtcatgagttgcaagaactgcgactggtttgacttcgcactatcaattttagaggtcaaaaaacgataggcattcgcatcggttggataatcaccatcctttgcagcaccttgatacttctcaggatatggcgtttgcgtgttatccgtcgtgtagaagccatcgatacccatttttttatacgcattcgtacgattatacaaactaccaacaaagggatgcaaaacatctttttgctggaacacgttagtaacgtttggcaccgccttagcgaatggcacaacttgcacatacggtaccgacatctcgggagcgtacgttgccaacggcattcccgtcaacgtcatatactcaatgttagctgtaccaccaccgtagcccgaggacaacattttacctgagaacgttgctgttgccttcaccttgtccatattctttgacacatttttgccgctatacgtcaacgacggtacatcattgggatttgccaatgattcacttaagacataaatgaccgtttgaccagccaaattagcttgccggtttttgttcaattcagtggcataagcggcatactttttttgaatttctgccatcttggcctttgaataaccagctggttcgcgcatgataaccgtcgaaacattcgaaacaaaagtcattagcggcccgttccataaggcgtcatcccctgaactatagacaactcgttcataattaaaccgctgtaaccattcttgattttcatctgcagtagagacaaatggaatggcaagcacaccaccggctactaacacaacaacgattcgtgaccatgtttgttgaaacagggttgccatgacgccttgcgcaaagtgcccggctcgccgtcgacgtaaccaaaactcaagccaaatggcgccaactagtaaaatcagtacggcaacaatggcaccaattaacaagccacggtcaaccatgcctgacaagccgcctgccgcgcctgcctcagacatatcactgaacataattggttcgttacgggccttaactttcataaactcagccacaaacgcgacaatggcaataatgccatacaaagcaatgctaagaaacaaacgatttagcaacgccatgatgaaactataaagcaagaacgtttcaaataccgaaaaccatgcttgtggtttccacataaaattccatgtataaccaagcgccgtaccgaagtcggttgtttgattgtaacggccccattcctgaaagtacatcgcaaactgcaacataaatgtcgtcaagatgctcagtaccaggccaatcaaaattaggcgcataaaattattgagcgatattggttggatcacccgtttcaaaggggcccaaccacttcttttattcgtcatatactatctcacgatcactatttctctctatcactaatgaataagtataccgtattaaaaagacggatttttaacaaatagttaacaggtaaaacaaaaagcagaccatccagtctgctttaagattagtcttcaaaatagatttgccgagcccaatcaatgcgacgggcgccccacgttagtaatcccatcacaattaatgtcacaacaatattcaataaaacatttatcgtatggtcagtagtaatcaaactaatgtacccgcccattttaaataggctcatcaaaatcgtcaaaatgctaatttttaagatgacggcatcccctaatttcgcaaactctgtcgcaaatgcgggtgtccattggattaaacgttgcgcaagatacacaatggtcaaactgcccagaacggcaccaagtgaggtaaacacccagtgtggtgcggctgccataataacatcaaatggccccgaggttgacacacccgtccaaactaagaaacccgctgctgccgtggcgtgcccaacctgccagtcgcccgcaactcgaagttgcttaccaagcatcatcaatggttgcatcactaatgctccttcaatcgaccaaggcatctgaaactgtgaactcaggtaataccctaaccaggctagcaaaattgttaccacccattgataggccacgtgtcccggtagatattgcaccaccttaaacacgattgtggcaacaaacaaggccaaagcaatccaaatcatccccgtgcccaggacttgccagtcgccaacatgcgcggttggccagccattaccgtataaaaacgttgtcacgccgtcacgcatagcaacgaaccgatattgcatccaataagtccaattaaatttaataatgactttactgcctaaaataataatggctgctgtaacagcgaacggcacaacataatgtttaattcccttaagtaacacttctcgccaccgcaaccccgtcgcccagtaaccagccaccataaataaaacgggtacattcacgattgtgagccactgataaagtggctttgcggttgtttgatcaatcagctgtgcaaccacaatcataatgattgcaaatgctgttaccaatcgcgttagtttttgttctttggtcataaaactcctccaactacaacaaaggagaagcacaaaaggcttctccagttatgttagtaattcatcaatgccaagatgtcgtatccttcaagacgatcacgaccatgaagggcatcaagttcaatcaagaaggccaagccaacgacttcaccgcccaaagattcaaccaacttaattgttgcggcaatcgtaccaccagttgccaacaaatcatcagtgataagcaccttatcacctggcttaatggcatccttgtgcaattccaaagctgcctcaccgtattcaagcttgtaactttccttaacggtttcgcgaggtaacttacctggcttgcgtgctggtaccaaaccgatgcccatttcgtgggcgaccggtgcaccgactaagaatccacgtgactcagggccaacgataacgtttaccccgcgtgcttgtgcgaattcagtaatttgatgcgttgcttctgcgtatgccgccccatccgccaacaaaggcgtgatgtcacggaatgtaattccttcttctgggaagttcggaattgaggcaacgtaatcatgcaaatccaacatctgcttagctctcctgcttacttaagttcgtcaacaatgtttcgagttcacttgtcgaactgtaaatcaactgttgttctagttctcgctgtgccacgaaacgctgatatgacggcatttcttccaagaccacttgttgtggcgcaggcacggcgtttaagacgccatcaataattgtaacaaattttgcgtctgaaaacacctgcaatattaaggttaacatatttctatcgatttgtaagtgcgaaacaattgcatcatactgcgttcgcaacgaaacatccgaaaatgatcgagcaaatttgtaaactttcgcgaaatcggccttcgatggcatcttttgtaaatactttggtgacttcgtgtagaatattggggccaagcgacctgccggcacgaatttcagcaaatccgctaactgacttagctcctccggcatatcaacaaaggccattgtcccaacgctcgttcgattaaaagcatcctcccagtaaatagcttcgccgggggcctgaatcgtcggacctaattgttcgtagtgttttttattaaagaaaatataactagccggctctgctaatgtttgtcgcgttaagcgggttgtccgccaatccagcagcgatgaccccgcagcttcaatatccgttagcatcatttgataggtcacatcaccacggaaacgattctcgctcatcgtccccacaattttgattgattcaaaacgacctgctaaatcttcggcaagcgatccacggccaaacgcaatcaccggcaacgagcccacttgtgtgcttgccgtgaaacggaggtgcttgccttcactcatggttttaacattttgtaccccgttcaacgccacagcaaacagcggctctggattaccttcaccaaagggtgctaagacttgcagctgttcataattctgcgcattgaactctttggccgttacttcggctgcaatgcgaatttctggtaaaccagcttccgcaaggccctgtgcatccgcttcagtccgtaaaacgtcgcgaacggcttgcaagttggctgttggaattgtcattcccgcagcactggcgtgaccaccaaatgcggttaacaaatctcggtgaccatccagaccggcgaataagtcaaatgccggcacagaacggcccgaacctttcatctgcccatcttcgtcattgagcacgattgctggcttgcctgtagcctcgactaccttgctggcaacaatgccaagaacaccttcatgccaaccttgaccagcgataaccaacaccgggtcagccgtcaacgtttgtgcctgtgctaacgcctcatcagaaattgttgcaaccaattcctgtcgttcacgattcaacgtttcaatttgaccagctaacacgctcgcttcctctggatcatcggctaacaacagccggacaccatccgttgcatcagctaaacggccaagtgcatttaaacgtggtccgatggtaaaaccaatcgtcattgaatcaatatcggcttgattagtgccagcagtttgtagcaaggctgctaacccagggcgtggatcttccttgagattagccaagcccattgcaacaattgcccggttttcgtcaaccaattccatcacatcagcgaccgctcccaaagcggccaaatccatcacttcatcagctggctcttccaacaaagccgaggcaactttaaaggccacaccggcaccagataagccaccaaatggatatgccccctctgggtgacgtgggtgaaccaccgcaaccgcctctggtaactccgcaggcatctcgtggtgatcagtcacaatgacgtcgaccccgttattcattaaccaagcgacttcatcgcgtcccgacacaccattatcgactgtaatcaataattgcatgccttcaccagctaaacgttgatactgcgctaaattaggcccgtaaccatctttaaaacggttaggcacataataactaacatcggcgcccatcaactccaaagcccatgtcatgatggcggtactggtaatgccgtccacatcatagtccccgtacacgacaatcttttcaccattgtcaatggccgtcatgattcgtgtaatcgcaacatccatatcatgtaataagaacgggtcatataagccttcaataccaggacgcaaaaacgcattagccgtttcaatggtatcatagccacgattaactaaaattttggcaaccaattctgaaacaccaaaggtctcagcgatttctttggctgccgcctcgtttgcaacggccgggaaatcccattgatagtgtggtgaaatcatctgtttgcctccttacttactgttcgtcttcatctaccggcgtcaatttaattggtttgctattactttgctcaccaaacggcacctcaaatacatcaaaatcgttcacaacacgggtattttcaaaaattgttcgcgcttgataagcgagttcattcgctgacttaccggcataacgcgctgaaatgtgcgttagcaataagcgacccacgccagctttttcagcgacttcagccgcctgaatgctcgttgagtggtagtggttacgcgcttgtttaccttcacctttaccataggttgattcgtgcacgaggacatcagcccctgtcgcaagctcaccagcatttggtgtcttacgcgtatcacctaaaataacaactgtccggccttttttagcagggccaatgacatcagcactcctaatttcacggccatcaggcaatgtaatatcattgcctcgcttcaattgtccgtacaagggaccttctggcacttgcatcgcccttaagcgttcgaccaaaagttcaccggcgtgatcatgttcaacaacgcgataaccaaatgacaaaattttgtgatccaacggtaaagctgtcaccgtaaatttgtcagtccgcagcacctcaccaccttcatttggtagttcgacaaacttcaatggatacgttaaatgcgtttgtgccacgcgaagactcgtttccacgaattgcttaatcccatggggaccataaatcaccaattcttcttcgccaccctgaaatgaacgggaagacaacaagcctggtaatccataaatgtgatcaccgtgcaagtgagtgacaaaaatcttatccaccttccgtggacgaatcgttgattgtagcatttgaatttgcgtgccttcaccggcatcaaacaaccaaacggaattaatttcttctagcaagcgaagcgcgatactcgttacattacgaaaacgagctggcacacctgcaccagttcctagaaactcgatttgcatgatattaggaactccttttatctatctctcaaacaaaaaaccgccataatgacggtttaaactaactattagtctatcattttttgacgcatatttatagacccacgcattaaatcagaaggtgacccgaagctttgcagatggcccgaccaagatattgccatgacgatccttgactgttgcaaattgcaaatcaatatcgtttgtagcacccttcggaatgaaaaccgtcacggttgcatcagtgtaacccccggctggaatgccggccacgctcaacttagggtcattgaccaaaccgtttaattcagacatcgttggcttacccttaaacccaattgttgtcacacctggcgtcacaccgaacgttgtactatcattcgtaatccgataggcaatgaccagtgtttcatacccattggctaatttaggtgtattcagaacacgccgcgcattttgcagggcttttgtcgagcgcgcagtatttttgtagcgggcaattcgagtaacctgataaataaaattgtgattttgcaacgttgcattcactgcgttgtctccaatcaacttttctgcaaccccactactcgtgagccgatactgaccgacttgcgtcaaacgaccatttgcgacgaactccttcgacttcaaatcactggcagttggcgtaccggccgatttcttttttcctgttggcaaatcatgattactaggtgtgttcgcttgttcagcaaacgtatgcgctggttttgtcacattgctggtgtgataaaaaaatatcaccacgctcgcaaataccagtaacaaaattgcggtgatcaaccaccctaagcgtttttgcattctcatttctccatcatccaagaaccagggcgtcgtcgacaatccggtatccatacaccggatgtagcgtgaaatcatcatcacgcaccactatctgcaatgaatcaggagtctgcataatcatctccgccaattctgcttgataggccacgtccgttgtcatgactagcaaatcaccatcacgcccaagtaagcgaactggttgcacctggtcatctagtcgcaccgccaacaaacgattcgttggcatgccagatgtcgctgctttaaaatctgctaatagcatgtcttgctctccattggtaatttcttaccgttaatcttaccacacaaaaaaggtgactaaccttaagattagccacctgattaatggtcggtttaaccgaagaagcccttcttgtgctcaccagtcattgctgcttggaatgcctcaagcgccttcttttggtccttattcaacttcttaggcacatcaacgtaaatcgtaacgatgtgatcaccttggccaccgcgcataaatggcgctccttgaccacgaagacggaagtttgcttcagtcggcgtaccggcgggcaccttcaacttcttcaaaccattaaccgtcttcacttcaatttcgccacccaagacagctgttgcataatcgattggcacacgtgagtaaatcgtgccaccatcacgttcaaagccatcctttgacgcttcaacgcggaagaccacaaacaaatctccgtatgggccaccgttataaccagcctcaccctggccagacaagcgcatttgttgaccattctcgacacccgcaggcaccgtcaccttcaactccttgctttcttgaccaccgttatccgttgaacgcgtgtatgaaatcgttgtttctttaccaaaaacagcttcttcaaacgtcaagttcatgcggtattgcaagtcttgccccttgcgtggacgattagggtcttggaagccaccaccaaacatttgactgaaaatatcacccaaatcagagaagtcgccgtattgaccaccgccgaagccaccaaagccgccttggccaccgaagccaccagcttgaccatcagtcgcaccgtattgatcatacatcgcacgcttttgctcatcaccaagggtctcatacgcttcttgtacatccttgtacttctgctcagcaccctcttcgtggttcaaatcagggtggtacttctttgatagcttgcggtaagccttcttaatctcatcttgtgaggcgttcttatccacgcccaaacgttcgtatagctccgtattattcatgaggccaacctccatctttatctcaatatgtatcacaaagcgaggctcgcacctcgctttgtgtctaatctgtaactggtaggaaaatgcacagactaggaatttaattttttagattacttcttgtcgtcagaaacatcttcgaagtcaccatcaaccgtgttgtcatcacttgatgaagcaccgtcagtagcttgggcaccttgctcaggagcagcttgttggtacaacttaacagccaattcttgcgcaaccttttccaaagcttccttcttcgtcttcatgtcgtccaaattgtcggcttccttagcagtcttcaattcagcaacagcgtcttcaactggcttcttgtccgtatcaggcaacttgtcgccaacctcttccaatgtcttttctgattggaagatcaattggtcaacatcgttacgcaagtcaacttcttccttgcgcttcttgtcggcctcttcgttagccttcgcgtcattcatcatacgctcaatttcttcgtctgacaatgaaccagagctttggatcgtaatcttttgctccttgttcgttcccaaatccttagcagaaacagaaacgataccgttacggtcgatgtcaaacttaacttcgatttgtggtacaccacgtggtgcagcaggaatgtcagtcaattggaaacgacccaacgtcttgttatcagcagccattgaacgctcaccttgcaaaacgtggatatcaacagctggttggttatcagcggccgttgagaacacttgtgactttgacgtaggaatcgtcgtgttgcggtcgatcaacttcgtgaacacaccacccatcgtttcgatacccaatgacaatggcgtcacatcaagcaaaaccacgtccttaacgtcaccagtaatcacaccaccttgcacagcggcacccaaagcaaccgcttcgtcagggttaattgagtgatcaggctccttgccagtcaaagccttaacagactcttgcacagcaggaatacgcgttgaaccaccgttcaagataaccttgtcgatgtcgttgattgacaaaccagcatccttcaaagcttgacgaacaggctcttccgcacgctttaccaagtcagccgtcaattggttgaattgggcacgcgtcaaagtcgtttgcaagtgcaatggaccagcttcggttgccgtaataaatggcaaatcgatttgtgcttcagttgctgatgacaacgtcttctttgccgtctctgcagcatccttcaaacgttgcaaggccaacttgtcagccttcaaatcaaccccattttcagccttgaagttatcggccaaccagtcaataaccttttggtcaaagtcgtcaccaccaaggtgtgtgtcaccatttgttgacaaaacttcgaaaacaccatcacccaactcaaggatagaaacgtcaaacgttccaccacccaagtcataaacaaggaccttttcgtcgttttccaacttgtccaaaccgtatgccaaagcagcagccgttggctcgttgatgatacgctcaacttccaagccggcgatcttaccagcatccttagttgcttgacgttgcgcatcattaaagtaagcaggcaccgtgataacagccttatcaaccgtctcaccaaggtaatcttcagcgtacttcttgatgtattgcaagataatggctgaaatttcttgtggcgtgtagtccttgccatcaaccgttaccttgtaaccagcttcacccatgtgtgacttgattgacaaaatcgtgtcagggtttgtgatagcttgacgcttagcagtatcaccgacttgcgtctcgccgttcttaaatgaaacagctgatggcgtcgtgcgaccaccgtttgggttagtgataacctttggttggccaccttccaaaacggcaacagctgagtttgttgttcccaaatcaattccaatgatctttgacataatgtttttacctcttattgatcaatttttatttttaatagtaagtgaatagttgtttagttataaacagctaccatcgctggacgaatcacacgatccgccaagacataacccttttgaagaacctgggcaatcgtatctgctgggtgatcatcatcagccggtacagattggattgcttggtggaagttaggatcaaatggttcaccttcggccccaacggccttgatgtcattatcttccaaggcagatgccaatgtcttatagaccatttcgacacccgtcttaatttgcttagctgcgtcgtcatcagcttctacttgcaacgcacgttccaagttatccaaagcaggcaaaactgactttgccaacttttgactcgcatacttaactgcttgtgcttgttcctttgcaaaacgtgtttgcatgttttgcatctcggcgtgggcacgcaagtacttatcttccgcttctgcaacctttgcttccatcgcaaccattgggtcgatttcgaccgcttcggttgtttcggtgtcaacatccggtgtctcaaccgtttcttcaacttcttcttcaggagtctgcttatcttctgccatgctaacacctcttttctatcggtaatattctaataattgttgtgataacgcggtacgatatacatcaactaattcaaccatatcggcgtacatcatcgatgttggacctagaatggcaactgctcctacaccatgttgtggtacacgataggttgctgataccaaactgtaaggtgacaacaggctattcccattctcatccccaatttgtaccagcacaccatcattcgcgttaccaacgacgtggcgcatagcggtcggtgcatccagtaattgatacaactgcttaacttcttgcaaattagtatcaaccgtaaagtccatcaaattcaaacgaccaccaacgaaaaccttatcacggatagagcgtgccaacacatcaccaaacagttgcaaaaaagcaaccggcgttcgaattgtacgttccatcttcaatggtaaatcgccagacagcgttcgtagcacatcaacaattggttggttaaccaatgtctgattaatgtaacgcaccatgtcatctaagccatgtacatccattccctcgggtagtctaaaactctgactcgttacctgtccatcgtttgttacgataatcgccataatttgctggccatcgacaggcaccaaccggaatcccgacaatcgcgtgtcaactgattccggcttcaatgcaatcaccgtgtaacctgttaggtttgccatttcagtaaccatttgttgcaccagatcatcaatttgttggaagttacggctaaacacccgttccaacgattggtgcacagcttctgacaattgacgtcgtcgcattagtttatcgacataataacgataaccccgttgcgatggcacccggccagaagatgtatgttctttttgtagcaatccttgctcttccaatgaggccatttcatttcggacagtagccgaactaactgccaaccccaattgttcaagcaatgattttgatccaacagctttaccggtttttgcgtaatcttgaattatcgcggctagaattaaccgctgccgttctgttaacatacgctatacctctcttagcactctctatcacttcgtgctaacacatattataatacacaccatgcaaacacttgtcaacacttttagcacttttaattacagagtgctaaaaacgattgtgtacgcatcaaatacgacctagcaaaaaggactgagccatcaaatgactcagtccttttaactgtttatatttattagtaccaaccaattgcttgaatgtgattccaagcaccttgtgggttaccgtaacgattagcaatgtatgccaaaccaaccttggcttgcccttcaactgacatgtcataaatccccgtcgtttggaacaagcccacatattgaccattgcgtgcattgacattccaacctgattcgtagttaatcaacaaatcaaggtagtattgttgcgttgaatcccaaccgtgccaagcttgtgcaaagcccatcatttgatccttaacagaaccagatgaaagcttagttacaacaccgtttgcatcagctgaatagtttgccccattagccgtgaacttcgtgttcttacgcaagaagaacgtcccatcattaccgaagaagtattgcttgccgccaattgtttgcaagccttgcacagcacgaccaacgttatcaacgtaatacgtcatgccccatgcattctcccatgaattttggatacgagccccattttggaaccagtaatatgtgcccatgtagaattggaaacctgtgtaacggtaaccgttttgcatccacaaccaccctgatggtgttgcgacataaccattggccttaccgcgagagaagaacgtaccattgttaccaaaatcgtagttaacgccgttaatttcgttaaccccttgcacagcacgtccatcagccccaacgtagtagctcatgccccaagcgctctcccatgagttttcttgacgcacgccatcttggaaccagtagtaagatcccatgtagaaacggaaacctgtgtagcgttgaccattttcaaaccagtaccagccagtaccatcgttcaaataccctgaaccttgcaccgttgcggcacttgccgtcgtctcaaattgtgttgtgtttgcgattgccaatccggccatcgctgcagttgttgccaatactaatttcgctttattactaatcatatccgaatttaaaccccattcttgtaaacagaccgttctgtattcacgacgcatatctgcgtcggactcgtttttactaattcgactttacttagtgtatcgagttatggtgacagccggttaaagtgaaagtttcaaatccgcgccttttattacttgtatgttacaaaccaaacgagcattacagaattccggattttttggagggattttgtgacgatgccaggatgtttttgcgagaataatgtcactgttttttcacaagcctaaatggattattttgcaaacggatgcaaaactaccttaccgtgaataaactcgcccaaataaatatcttctacgccacccttggtttgcttcgcaacttcttcgcgtaaccagtcgatgtctttatccaaaacttctaatagatcataattggcttgaccatcctggataagtggatacttaatcgtttcctcgccatatttgataatcgtcagttggccattttgctctagaattgctcgacgtactacctgcacctcatcaacgccagcggcgcgtaacttaaacattagctcactagccgacagtcccacccgcatcgttgtggccacatcaacctcaccgttcttaatgaccgtgaccggcgccccatcaatcacccgtttgacccagtaattgtgttctttcaagaacttaagcaacaagactaaaaacgtccaaacaatcaagactaagacaaattgcagtgcagtaatatctgcattataaataacaccaccaataatgccacccaagacataattttgaacttggtccattgctgaaatgggcgccaggttacccttacccaaaatattaatttggataatcaaaccgataatcccaattgccaatttcaaagcaatcgttgtataacttgtgtccattatttcacctcaactaccgtatgctcgtctaataagttcgtcttttccaaagtatagttcgattgatcagcacttaaattcacccgatagaacgtcttcccagctttcacaattaaattattgttcaaattgacactgtttacagccacttgcgctggcttcacatcccgattatgtgccacgtgctttaataacttaacaacctgtgctttttgagccgactggcttttaacttggttcatatcttgatactgcagcccgatgacaaacgctaccaacagtatcatcatcacactcaaatcccggtacttcgattttaaattattacgaaaatacagcaccgcaaaaattgcaaaaataattaccaatacggcgataaccaccgtcgttgccgtttccaaccacgaatgacgctgtgtcaagtaatcaattgtataaaatgtcatgccttcctcctattcttctgtcatgttacgcaaattgttggcggtatacaacctaattaccaaaaaaatccgccaggcaagttacccagcggattttgcaattcaaaataaacttaattaacgtaggaagaaagtatggttcgtaccaaagttgtacgtcttgccatcaatcttaaccttgttaccttcaacagagcggccgtcgttaccgacataatacttcaagccccattctgagacccattgattctgttggcgcacaccgttaatgaagtagtagtaggcacccatgtacatacggaagcctgtgtagcgcttaccattttcaatccacaaccaaccgtctggtgttgacacataaccgcttgccttaccacgcaagaagaatgtgccgtcgtgactgaagttatagtacgtcccgtcgacattataaccgtcgccttgtacggcacgaccttcactgtcaacatagtacttcaagttccaggctgtccgccattggttattgatacgtgcacccttttcgaaccagtagtatgtgcccatgtagaagcggaagccagtgaagacttcaccgttttcataccacaaccaaccattgccggcatcttggtagcctgaaagcttgccacgtaggaagaacgtaccgttgttcccaaagtcatacgcgataccgtcaattaagtggtagccttggactgaacgaccatctgagccaacgtagtacttattaccccattggctgacccactggttttcttggcgcacaccattaatgaagtagtagtaagccccatagtatgaacggaagcccgtgtatggcttccctttttcaaaccagcgccaaccttgatccgtgttcaagtaaccagactgcgtaaagttacgggcatagtacgtcttgtttgacccaaagtcgtaccacttaccgttgaccaacttaataccctcttgcgtcgtaccatcagtcgcgacgtagaaggtcttaccaccggccgttaccaattggttcttgcccttcaacaaaccattgttgcttgggttaaagaagtagccttggccgttaatattcttaaagccactggcaagcacactgtttgtcgcatactcacggttacctgactcatccgtttgccaaccgttactgatgaaatccgtctttgaatcatgttcatttccaggaagattgctgttcttacccgtagacatttcaatcatccattgggccatcaaatcggccatattagcatatgtttcttgtgtaggatgaacttcgtgatccccgagagtttgttgtcggttcgcatccgtaacaactttgtatcccccttcacgccagtccaacaccggaataccaaaactcttgtaaacttccgtcaacgcatcggccaattgattaaacgtataacctgcttggcccttcacgttcaaattatcaccacccatgtatgatgggattggcaagacaccataaatcaccaactttgggttcgcggcacgcattgtccgaatattcttttgtaaacgttgttggacgtaaccgagactattgtcactatagtttaaatcattgactccaatttccaataccaatgactcagcgttcttgaactgcggatcagccgtgacacgctttaagttattggttaggtcgtaagtcttatcaccaggtccgttttggttacctgaaatttgtgagccacttgatgcgtaacccgcatgcattgactctggcttgatgatgcttgccaaaagcgttgggtagttttgcttaaccacttggttcccatcccacccaacggctaatgagtcaccaacgacccatacattttgatcattaaaataattgttttctgattgttctggcgtttcgaccggctgcgtggttgcgttcgtcgctgtgcgctttaccccttcaaccttagccgtcgtttgcgctgattcttttggttgttgtaccacagttgcggcgtgtgttgaaccagccgtcgcccataatccgaaacctaacactgctgaggccagcattaggcgtgctgttgttttactcattgatttgcactcctcccaacaattaactatagcaaacatttgcccggatggcataaaaattcctgaacttcaattgaatataaatataatggtagcacttttgcgaaagttataaaaaaatcgcaacgtttgtaacaaacgttgcgatatcttaattacttatccttagggaattcaatggttggcttaaacttacggccagccttgataccactaatcattgtatcaaaacgcttcttcttgtgatccgtccgcacaaaaatcaaacggaggaagtcccaagcaattttaccatttccgcgcatgtgacggaaaaagtcacgcttgcgcatcgtgtaaacacgattacggtacatgttaaagtaccaaggtaaacgacgttcaatatcgttggtaatatcatcttcagtatttgaacgcatcttgtgcgtgacagaagatgccggcactagataacccggcgcaatccgtccggcacgttccgtatactccaaatcgtcaatccaaataaagaattctgtaattggcaaaccaatttggcgaacaatatcccgtgagaaaaatgatgaaacgaatgtcgcattttcaattcggacaggttctttaaattctgtattcaacgtcgtcttatacgtcccgtattgacgtagtacgttacgaaccgatggcttaccatcactgaacattacctttgaggccaagaaaccaaaattaggattttgttcagcaaatgccgtcaacggttgcaaagaatctggatgcaccatcgtatcatcgtccattacccaaacgtaatcatcatccgtttgttcataaaagtaacgaattccggcgttgaacccaccagcgccaccaaggttctcagacatccgcacatacgtgatgctgtcgcccaatgattctaagtaatcttgtgtgtcttgctcagatttattatcaatcacaattaagtgtgacaattttggctcaacggcttgcaaagcggcaattgcctcttttaacattggcaagcggttgtaggtcacaatcactgcgcttacttttgccataatatctcttatcccttcgccttgttcttagcaaattctacctttggcttgaagaaccaaccggtcgtgacacccttaagcaccatcttcaagcggagcatcttctttggttgtccgttaaagaaaatcatcgctgcttcataggcaatgcgaatgtgtgcacgcaagaagcggacaaagccacgattgcgactgaagtacatccggttacggaaagcgtagaagtaacgtggtacacgatcaattgaatcaagtgatacatttgactccacattttgcgccattttgtgaataacacgtgatgttggcaccatgtaacctgggtagacacgcgcagcacgctctgtatactcaatatcatcaccccagatgaagaattccttcactggtaggccaatcttatccacgacttcacgactaaacatcactgagacgaacgtcgcattacgcaactgttccatttcagtcgcatccaacggaatcttcttaaagcggtcgattgggaatggcaagttcatcttggcgcgtgaattatctgtccaacggacatctgaagacaagaagccaaacttgttgtcaaccttagcggcactgccaacaagttctgtcaaagccgttggcgttgggaccgtatcatcgtccatcaaccaaacgtaatcatcaacagtttcttccatgaagtaacgaatacccttgttaaagccacccgcaccaccaatattttcttccaaacgcacataacggatttgatcacccaaactcgtcaagtactcctgggtatcagcattactcttgttatccacaacaataatgttgtccaccggcgtttctgaggcttgcaaagctgcaataacttccttcaacattggcagacggttgtacgtaacgacgacagcgctaacagtcatatcaatcagtctccaaactaaaattcattcaatatcttttcattgtataaaaacactcctttcagtttaccacatccaggagtgtttcatatatcttattctttctctttataaaatctacgtaattgggcaacgaccgcaccaaaggctaagagtccccagcttattgcggccacgtattgggtggtcggcaaccaacctggcgtttgataacccaggatcaatatgttgcgaccagcctgctgtttgacaatgggtgcaccaatccgactcagcttaacgttatttagcatttgaccatttaacgatagcgttgtctctgcatatttcacaactggcaaagtaacggttgtcgcccgcttagcttgccaagtcaggtgcaattggccatcaacaaccgtgcgtttcattttcggcaagcgatttcccacaatatcacgcaaatatgcttgatctaacccattcttcgtataccaatctttgccagtcaatgatgttgccgttttctttgaaatcggtaaataatctgggtagttttgcgtgccgtctaacatcaaacgacttaagtccgtgcgtcgctcgtcggccactagttgttttaccgtcaacttcggcctggtgtacgccgttaaaccgaccactgttttcagatccgactgtgtcgccatcttatcagtcatcggcgtgaacaacatccccatcgctaagacgcccgtcgccagtgtcgccacctgcatacctgaagacgccgcaattggctgctgttgcaaccacaataacaagccgaacacaatcaaaatcaagcccggaataccaaaacggagcgcaaattggaacgtcgataaccaattatcagcatctttcataatcatacgccatggtagtaattgtgagccggctacaacaagcaacacaccacccaacaacgtccactgggtcgtgaaatccaatcgtggttggcactggttgcgcaacaccaaggctgccaccgcaatgacaatcaatcccatcgcgagtacagataaattgtgcgtcccatcccatgtgaaccctagcgtatccgccggaatatcaccacgtaattcaataaatggtcgcaacaaccggttctccatattcacgtgcaaaaacggcaaccaaacattgactgatagtagcaaggccaagcccgccgccagtagcccattcaggaccattaacactggtcgcttcgcccgtaatactgctggtagcgcgaaccacaccaataccaggagcataaacaaagttgagagcatgtggacttgaatacccaaggccatcacagcgcccatctgccatgggttaatcggccgatttggttgctggagcatccgaataccaatccccacagctagcgcaataaacatggcgccaacgctcataaaggcttgattggcaaaccaacttaggcccggtaaagagccaaccataatcattgatccagccacgctatacaggcggcgtacgtgggtccaacgcaacgccaggtaaccagctaacaggccgccaaatgcaatgatgaaattagaccaaaattgccaacggacccaactacctgctagcaatagcagtagtccatttagataagcgaaccacggcccgtagaccgcatttacaatccgtcctgattgattaaagccaaacaacgacacaaagtaattgaattggcccgttttcagttgcatcgccgcatcgtagaaccgatgtaagtggaaaaacgcgtccacacccaacaccattcggttctgatttaaaatcggcaatgcgaataataatgcaataataacaaaaccaagcactgcttggctatcgcgataagcgccagtttgtcgatattgcgcaaaccttcttctcatcgctctctccctactttactttacgcgcaatataaattggtcgcttcttaacttctagataaatacttgaaatataacgaccgacaatgcccaaactcaatagttgaacgccaccaagcgccaacatgatcacaatcgttgatggccaaccaaaaactgaattttctggatgcaacaatgcccgaacaaatacaatcacagcaccaactagcgccatcacgaaagcaatagtaccgagtactgaaaccaacagtagtggtgccttcgagaaattcacaaaaccatcaattgaatacctgaacaaactccagaaattccaagatgtcgtgccggcaacgcgatccttattctcatactctagatacttttgcttaaagccaacccatgagaagatccccttcgaaaagcggttatattcttgcatactcaagatcgcatcaaccatttgacgggtcattacgcggaaatcgcgtgccccttcaacgatatgggtgtctgataccatattaataatcttataaaacaagcttgaaaaccaagaacgaagctttggctcgccggcacgcgttgtgcggcgggcgccaacggcatcccattcaccagatgagacccccgccaacatttctggcaataactcaggtgggtcttgcaaatccacatccatgactgcgatataatcacctgtcgcgtgttccaaaccagcatacaagccagcttcttttccaaaattacgtgagaatgacaccaaatgtacgttttcatcacgtgcaatcaacgcttcaactgcggtaaccgtcccatcagttgaaccgtcatcgatgtaccaatattcgatatcatattcagcaaaatttttgcgttcaagttcaatcgcatcgtagaagattgctactgtctcttcttcgttaaaaaccggtacgataattgataacttagacatatctgtcctctttcatatatttaatcagcctgttccagtatagcaaaaaagcacccctaattggggtgctttcacaattttataatatctgattttacttgtggagacgtcctttgataaacccttgtacagtcaacacaaagttagctcgcatcaggatgaccataatcacgtatactacgacaccaaccccaatctgtgctacggtgcttgttgggaatggtggcattcgccaagccatcgtcgcaatgactgcaaacataacgacacccgctacgagatacttccacaaaccgtggaacaaaacgcctaattcaagttggtgacgaatgacataaacctggtaaagggttacagcgaattcagcgataatcgtcgcgaccgctgctccatacaaactccaaagcggaataaagataaagttcagcaacacattaacaaccgcaccaaccgtcacggaaattgtgaaatcccgggtccggttaaccggcatcaaatattgcgtgccgataacgttactccaagcgataaacaagacaattggcgacaaaatcgtaattgtccaacccgctggtaagaagtttgggcccatgtaccaaattgacatctttggacccaaggccatcatcccgaacatcaaaggcgcagccatcgctgtcacaaagtccattgacttgtaaatcgcatcattgaccgctttcgtgttaccgttggcataatggttcgccacacgtggcaacataaccgttcccatcgccgtgactagggccaacgacactttgacaatcttatccgcgttttcataaaaggctgacaaactaattgagccactagcaaacaaaggcaacatcgtcttattcaactgcaaataaatttgcgtggcaatcgttggcaaaaataggcctaatgttggtaataagtggtgaccgaagttcaaagtcgacaacttcggcaacttcaccttacctggaatgtagaaccacatcgtgatattaccaatcacttgggtgagtgccaacaatagaatgtagttatcgacatcatcagctgacttaaccaggatgaaaatcaataccaccatggcaatcttaaccaacgaattacggacaaccgtcttcttaaagtcttccaagcccatgaagtaccatgaaatatcgagcagccctgaaacaatcacccaagtctgcaaatacagttggtggttgtttgctgagaactcacctggtacatggcgcatcatgtagacaaagacgacataaatcgcaattgccaacagactgaccattgtgtgcagtccttggatttcccaaaaccgtcgatcacgcaactcacggtcatcacgcacatacgcaatttcacgttggccatacaaagtgatacctaacgtggcaaacagcaagaagtaactcacaatcgagttagtccaagcctggacacccattccatccgcgccaagcacgtgtgacaggtacgtcatcgtaatcaacggtgccaacacagttagcagttgatagaagacgttatacaaataattttttacgacttgcatgtcattctccgactgttttttaaacttatcagtctagtatagcgcaaatttaacgcaaatagaatgtaccattcgtcccgaagttatacaccttattgccaatcttcacatgtgagccctggacagaccggccatcactaccaacgtagtaattcaagccccactctgacacccatcgattatgttggcgaaccccattgatgaagaaatagtatgcgcccatgtacttacggaatccggtgtaacgttggccattttcaatccacaaccacccatccgttgtgttgacgtaaccattcgctttaccgcgcaggaagaatgtgccgtcgtgaccaaagttgtagtaggtcccgttaactttgtagccatctccctgcaccgctcggccctcacgatcaacgtagtattggagattccaagcagaacgccacttattatcaatacgtgaaccattttcgaaccagtagtacgttcccatgtagaaacggaaccccgtaaatttacgaccattttcaaaccagaaccagccattaccatcattgatgtagccagaagcaggttttcccttcaaatagtagctaccattcttatagccatcgttgtctaattgatcaaaatggtacgcttcaatcaaattaatgagcgattgggcatacgttggcgccgttgcataacgcccttgtagcccataagctgcttctttataatttttagcccgcgaacgccatgcacctgcgtaatattctggattccacgacacaccgttcttaagcaacttgccttgcgcatccactgactcatacgccgaaggatacttagcaaactgtgcttgaactgaatatggcttgccacctgaatactcagttgtccacattgtgactgattgtccattgaaagcacctttaacaccgaaataattgttggctttcgtacttaacgtactctgtccccaaccactttccaaggtcgcttgtgccatttgaattgacggatatagcccatatttacttgtatccgctaaaatcgctggcgtcattttattcacaaacgcttgttgttgtgtcgtcattgtcgctgcatcaactggggtggctgttataacgatacccaacgtcataactcccgttgtcaacgcaatctttaaggttttatccatacgctaaccaccattcctaaacactctgtaaaatttaacaaactctctcaagttatattatagcgcagtggacaaaaagaaagagatgtgtaacacctcctcggctttcacacctcttaaacaacttaagtattttatggcaataaacgatttacacctgggattttttgtaatcccagcacaatcgccacactgatgacccataccaccatcggcaacgccaacatatgataataagagctttgatcaaggtgcaataacttctctagcaccgcaatcacaaattcgtgaatgacgtaaacacccaacgacacaccagaaagacgcttcaaccaaaccgttgtctttggacccggttgccaatcgagcgggaagtgcgtttttgcccaagtccagacccccaacggcatcaaaaagccgccgatggtgaaaatactataagcatcgcgcacagtctcatggcgccaggctgagaaaataatcgtcaaactaaacataatgacggaccccaaaacgcttgcgccgtacagcaaatgacgcatgcgtttcgagatatcgaagttatggagataccagccgacaaagaaaatgccaatgcccgtcgacaagaccatcggaatgttgttcaccaactgatctggtgcccggtggaagagcgtgtaggcgtagttaatcacaccaaccccaatgacatacaaggcgatgatatattcaaccactttttgatttgcctttgtcgcaatcaatgataaaaatggtacggccaaataaattggaatgatgaaatagaaaaaccaaaagataggttgaatcgtgtcatattctaacccattccaaaagccaattaacgaccaatcaggattgtgaccgacaaaatgattccaagcataccagacgaacgtccaaaagataaatggaattagcaccttcgcccagcgcttcttaaagaatgtttttgtgtcgtaccgctcgcgataattaaataagttggcgcccgaaatcataaagaaaatcggcaccgcccaaataaaggcaatttgaatcaccaaactcagcacccagcggggtgagtccggcgtatattggaaggctaattctgaggtgtgcaaccacatcactgcaatcgtcgcaatgatattcagaatatccatatagtaaaaccgccggctacgcttcttgaccggggttacaggttgatctgccatgtcacacggctccttttaaattattgcttacaaatcagtataccgaaaaagacacctcacgacgatgcgaaaggtgtctttttaatgtttatttagccttccgtctgtgccaactagtcacaaatagaatcacccaaccaattgcagataacaaccaaacttggtaaatccacttcggtgttgtgtagctgactgtcaaacgatgttcacccgctgtcacgtgcacgccaatcgaaccccgtttcgtttgcttggccgtcacacgatggccatctagcatcacccgttcattgccgtacatcagaattggtacattcaaattccctgattgtggtgcgtcgactttaaatgtcgccgacgtcaaccggtacgtcgccttagccttaattgactgattgcccaaaaaagtttggtgtgcaaggaacgaatagtaattctcgactggccacgcatttttaggtgcatagtcgagcatgccgatataatcgtgacgcgcacccggtttattcagagctgcgagttgcttatcattcgccgtgaaacttgtttcaaacaacgcggtggttgcctcaaaccgttgattcgttaccaatggttgctggtgctggcgcgtataaatcaaattctccgtaaacgccaagtaactacctgcactgaacaataacacaaccaaagtcgtaagcgcttgttgctttggcaaagcaaagactcgcactaactcgcccgacaagtaaacgagcaagaacagtgaactcaaaccaagtaagcggaacggaaattggactaatgcctgtacattctcagagagcgcccgccaagggaaaatcgaagatgccatgataaatagcacgactccaagcccccagattgccaactcacgtgagaaacggcggcgccataattgtaccgcaccaatcacaattgctaaaacaccaaccaatccaatgttttgatttaggccattcagtgaatacactaaactttgacccaagtcatacattttgctaattggtccttgcaccgtcgtaataatcgtcgcttggcgattttggtacaagaacggcaggtatattaccgccgtcatgacgaccgtcatcaccaccgctttaacgaaattcagtacgcgaactttttcaagatgcaaacggcgagtcgctactaataagaccacaatgataacaaacaaagtgagcgtcaagaccgtactcaacatgtgggcgtataagattaaggttaaacctgctgccagtgcccgccacttacgtgcgtcacccaagaagacgttgtataacccaacaaacgccaagggtagaaacgcaaatgccaacatctcaccaaacacaaactgatcatacgctaaataagtgcggtaactagcaaacccatatagtaacgcaaaaataattgaccgcatgcgctgtgattgatactgattcatagccagatatgccacaattaacgtcacaaacatcacaatcgcttcacctaggtaaaaagcgtgaattggattgtgcatcactgcaaacaatccagaccacccgagcatgtagacaaacgggtagaagaaattgctagcactaccaatgttagttagcacattaaagtagcgatatggtatttcatgcgcttgtaccccttgtgtcagtcccgctagccgattaaggtgaaacaataaatcgccttggccataaattgtaccccgattccagtaaggcacaactgacaagcccacaattaccacgaacaacagcatcaccaacaaatgttgtaaaactgcctttttattcataagcccctcttctcgaaaaaagccaatcattcaacaacagaacgatcggcttttttaaatacagattagtgttcttcgtcgtgtgcgaagttgaagcttgaaggaatcttgaattccttacgcacttcattcaaagcagcgttgaagacttggtccatatcgaagtaacggtattgtcccaaacgaccaccgaagataaattgatccttgtgttggcgcgcttccttagcgtattccttgtacaagttcgtgttcttctcgtcgttaactgggtagtaagcttccttcgtacggtcccatgtttgtgggtattccttcgtaatgatcgtcacaccatcgtctgacaaaccatcgaagtgcttccattccatcacacgcgtgtatggcgtctcagcatccgtgtagttgataactgagtttccttggtagttatctgaatcaataacttcgtgctcgaagcgcaatgaacggtactccaactcaccgaacttgtagtcgaagaattggtcgatcattcccgtgtacaaaatacgtgggaactcagcaatgtattcgtccttgtgctcgaagaagtctgagttcaaacgaacatcaatcaaatcgttatccaacatcttctcgaagatttgcgtgtaaccaccgattggaataccttggtaacggtggttgaagtagttgttgtcataaatgaaacgaactggcaaacgcttgatgatgaaggctggcaattcagttgccttacgtccccattgcttttccgtgtaacccttgatcaacttctcgtagatatcagtaccaatcaatgagattgcttgctcttccaagttacgtggctcgcggtcacccaagtcagtcaaagcagcagccttttgctcttcgatcttagccttggcttcagctggcgtcttcgttccccacatctcgtagaatgtgttcatgttgaatggcaagttgtacaacgtacccttgtagttggcaacaacttggttttggtaaccgttaaattcagcgaattgacggatgtagtcccaaacttccttgttgtccgtgtggaaaatgtgagcaccaaagtcgtgcaccgtaataccgtgctccgtgtgtgtgtacatgtttccagcgatgtgtgcgcgcttttcaataatcaatgagcgctttccacgcttagctgcttcataagcaaagattgaaccaaatggtccagcacctacgatcaggtaatcgtagttcttatcattcaaagtcatgatttgtcttccttctgatgatttttgtataaaaaatatcctgaaattactttaccataatttcaggatatttcacactaaaagtgcgagagtaacctggatgttttatcgctttgtatataaaaaccaccaagccgaagcctggtggttcttgatcaatctttagaagtgaaccttcttattggcattcttgaagaacttacgcttcaagaattgcgttcccttgtccaaccaatttgttttctcagttgtaaccagtgggaattccatcacacgcttttgcttggtgttcacccatgtgtccatcaaacgctctgataagaaaccaaagacacgacgttcctgtccttcatattcaagatatggaatgcgctcttctacggccttcaacacatcaaacatgaagtcagtgtactcttgaaaatcagcttggcgcataatgctcatattgaacaagtgcgcttttgtgctgttacccatcgcatcaaacgcagccaagtaatctggatacttttcggcaatcacctcacgcatcacattatacggctcatgattgtgcgcattaaagtagtgattcttttgcgtttcgatgtagtaattacgttgcttaggcaacaacacgtccgcagtttccaaagcgttacggatatccgtttctgtcaaaatgtcagtcaaatcgtgactagctttcttaccaaagtaacggcggtagtgcatcaagccaatcacatcttcatcttgcagattatacttagcccaatacaacgccgttaattcgttgtagaacgggttcatttcagacatgttttgaccagtgttatctggtgtgtaattagctggataaccctcctgtagcgcagccccgaccatgaccggtagatacgtttgatctttaggcatttggtacggcttgtgtacagcaactaaaattttcatttaactaaattccttcgttttgtaattcatcctctgctaagtggaccacccgccagtagaagaacaacatcaatagcatcggccatgacgttgcattagctggcgtaataccggccgtcacaattgtaatcgcgacagtgaccaagaatgacttaatcatcacccgataaaacatcacgtggtcagacgtactttgcttcaaacgaccgagtgttttcactgcccgcgtaatcaaccctagcaacagccagaagccaattagaacaaagataacaccatagcgggctaaccaaccaaacacatcattcaaaattggatatgattgattcttgtaaacatccatatattcagcgttgttttttgaccactctggcaaattctgcacaatatagtgcccttcgtaaccatagccaaccccaaacaatggatgatggagccaagcgccaattaacccaattgtaccgcctagacgattatcggtaccgcccttttggaacaaccactgatttagcatcgcgttaaccgacggtacaaattgataagccgcggcaactgcaattaaggcaatcaccaccccacccgcgataaacaacttttgcttacgtggcgcagcaaaccaataggcaacggcgagcaacccaatcatcaagaaaccagtcgtagtcttggccatgaatagaataacgacaataatggctaacaaagcccatgtcaaccaaaatagccacttgcggtttttgaagtttttcaacggctcctcagcaatcataattaacaatggtgagaacgttaatcccagcagcaatgctaaaaatgacgcttctggttctaacccgttgacacgccacaatgttgccacataactcccattatcatagaaattacgatctagccagtggcgttcaaacaggccagcaatcggattgataatgtgacttaaccagaaagcaccatcaatgaaggcgatttgaggcaaaacaatcaccacaatgtagacaatcaagctaattatcactgacttgacgaatttcacggcatcttcataacgctgaatcgccatcttttggactgtgtacgcaatccagatcacaagaatcatctgaataaacgaaactagtccgtgaagcaaaccatagatttgcttcgtatcaccaaccacaaaggattggtacgccatcaggattaattgcacaaccacaaaagcgccccataaacgaagcgtatttgttttaggtagcaccgtttgtaactgagcaggttgtaaatagattttcaccatgatgtacatcgagaaaatcagaaccgcaagctgagcaaatgaatcaaagaagaaatacgtgtatgtcttcggcaaaagcgcgaatggcattaaccatgcaaccatacgaatctcctttgcttagttcttagcagccgtcacgttcttgtaaacacccacaaagaatgccaagacaaccccgattgccaaaccagcaacggcaccaaacagtgctgccttctttggcgaaccagctaccatcgtatccgtgttggcttcctttgccttcgtcatcaactcaggctttggcatgtccgaaatcaacttaggtgcgttttcggcatatgactcagcaaaagcgttaacgatcttgattgcttgcttaggcttagcaatccccttcgccttggccttcatcagcaacgtcccatctgtaattgacaatgacacttctgagcgcaacgtatcagctgataccttcacaccctcagccttcaaagccttcacagctggcttaatcaccttatcatccttggcaaccgtcttgtatgtcttcaataaccaagagtcagccacgattcgtgaatttggatccttcacgccggtgtttgacttagcaacgtacattgagcgcgtcgcactgtagcttgtcgctgcaggttgcttgttcatcacatacatggcaccaccaccaacaattccaagggcaataatccaccaggcattgcgcaacatgtgcttaaacaaatcagtcactgtaaattgattttccatcacttcgtagttcctttatgtatattaaaatttttgatgctataaatagcaacttcccttaaatgcgaaaaactcgccaatacccagtatacaggagttttggcgagttttatagaactgtcacgatttcttaatcttagaaatcacatcgcaccgtcacccttaaagatggcgaaaacggtcataaataaaattttaaaatcaaaccagagatcagcatggtcaacataactaatctctaggtcagctcgttctgggtattgtatttcgctacgtccactcgcttgccaaagtcccatggcacctggcttcactgataagaacttatcaacacgatcaccgtattcaatcaattctttctcaacaactggtcgtggtccaacaatactcatatcaccaatcaaaatgttgataaattgtggcaactcatcaatcgatgtccgacgaatgaacgccccaaacttggtgatacgtggatcttcttcagtcggtaacttgtagccgttctcaacgaactttgcatacaattctttgttggcatacagcttttcttctgcaccaacaaccattgaacggaacttgtaaattccaaattcacggtgattcataccgatacgacgctgcttataaaagacaggccctcggttttcaccgaaaagataaaaggatgaaatcaccaaaaagattggcgaaaaaacaatcaatgcgaataacgacactgaaatatccaaaaatcgcttagcaaaaatgtaacctgaatgagtcacgtcattgctcccttctgtgtcagtaattttttatagatacttggcgtcaaactcaggatcttgtgatgtcaaaatctttggtccatcatttgtaatcgcaatggtgtgttcatattgcgctgaccatgatccatcttcagttgtcactgtccaaccatcatcttctgatgtttcgaccttccaaccacccatgttaaccatcggctcaatcgtaatcgtcatgcctggcttcaaacgcaaaccgtgtccagcaacaccatagtgtggtacggctggctcttcgtgcatcgttggttgaataccgtgtccgatatattcacggacattaccaaacccattttcatcttcaacgtaagcgttgatagccgcaccgatgtcaccaattcggttgccaacttgagcttgttcaataccgatgtacaaggccttgaacgtcacatccatcaaacgttgtacttctggtgacacctcaccgacagcgtatgaccaagctgaatctgaataataaccatcaaggtcaaccactgtatcaaccttgacgatatcaccttcgtgcaaaatcaattctttgcgagggaaagcgtgggcaacttcattgttcactgacacagtcgttgcaaattcgaagccttcaaaaccaatttgtgcagcgcgtgcaccatggtcttcaatatacttgcgaccgaattcttcgatttcccatgttgaaataccaggcttaatgatatcgcgcaaccctttgtgcatgccggcgataatcgcaccagattggcgcataccttcaatttcacgttctgacttaatagtaatcatgttttctaacctgctttgttttctttttcccctcataactaaatatctattatacgccaaaaatagcgttttatggcaaatttatacgaatttattaagaacacaaaaataacccccgccgttgagcgaaggttatttgctaatgattgttcgtcattatgaatttgctgaagcagatgttgctgatgaatcagcggcatctgacgcagttgatgaacttgctgaaccgaagtgagactcatacgttgcaacaacgggttgttgcgttgatgaagactcacgaatcaattccttcatctcttggtcacccaagattgaatcatccaagtgagcggcttgcaattccttgcgggcatccgcaatcatatcacttgaaatgttcgtaccatcagcagtttggttcggatcgtatgatgccatccccgagttgctggttgctggagcacttgaacttgacgcagcttcgctcgatgccactggtgcagcttctgatgacgccgcactagacgtcgcttctgactcacttgaagcaactgaagaagatgcttctgacgttgcttcacttgatgaacttgctgactcaagcgctgacgtttctgccttttcacttgatgaactgctcttctttgatgaagacgtttcttctgtaccagggtgtgtgttcgtgtttgctgttgcaaagtagaacccaccaccgataagcgccacaacaataacacccaaaatggctactgcactttttttcataattttgtcctccgtagtcttcatgactccctaatatcattatactagatattcatgataatttacgaataattagcgaaggaagaatgtaccgttatcaccgaagtagtactccttaccatcaattgtttgccaaccttgtacggcacgaccatcgttaccaacgtagtaacgcaatccccaagcattttcccatgaattgttttggcgttgtccgttttggaaccagtagtatgagcccatgtagatgcggaaaccagtgaagtatgagccattctcataccacttccaaccagctcccatatccatgaaccctgaccatggtgccaagacaccattaccatcagccttgtacttttctgcttggttacttacgataccattcttacgcaagtagaacgtaccatcagtaccgaagaagtacttcttaccgccgattgaacgcacgccctgtacggcacgtccgttgctatccgtgtagtacttcaagccccaagcttcacgccaaccattatcttgacggattccaccattaccgaaccagtagtacgtacccatgtagaagcggaaaccctcaaatggtacaccattctcataccagcgccagccacgaccaccgtcgtagtatcctgatgccttcttaccgttgacatagtacacatccccacggaaaccggtgaatgaatcacccttcattggtgaaccgtaatcaattgatacgtcaaatacaccgctcacacctgggaacgtcgtatttgagttccattgccaagcaccgtatgaaccgtaccatagatcattcttgtttgggttgtatggatatgaggccatccaaacattgcggttaccaaatgatgacaagttcatacccatttctgatgaatagctggcatatgtgtacaacatttggttgttgtaacccaaatcattcaaacggttacggaaagccaatgcgttgttcgtcacatttccagtcttcgtgctactatcttccaggtcatcaaccatgacaactgactttgacaatcccaagtttgcggcttggttagcaaagtaatttgcttcagtaacggcactaccagaatcagtaaagtgtgcgtagtgataaacgccgatcttcaagccagctgcttgcgcgtttgcaatttgttggcgagcgtatgggttaacgtacgtcgtgtgctccgtcaacttaacgatgacacccgttacgccatactttttcattgtttggaagtctgatactgacaagtttgggttccatgatgagatatcaacgaaatccattcgtggcgccgttgaatcaccagctgtcgttgattcatatgtagccgcgtgcactggtgttgtgacagcaaccataccgattgaggcagcgacaagaccacccattagcaactttgaaaacttcatgttgcaatccccttttataaataaataatttctactttttatgacgtcttctagtttacgcatttaaaatgtcgaaagcgttacagcaagatttgaactcactactttatctttacaacagaacgaattttctatgaattttcaatgtccaaatgagacaaagatagggcgaccaataccagtcgccctatcctgattatcatttttagaagttaaccgtgtaggcttgtgggtcaccccaaacaccacggatacctgttaccgtaccatatgtggctgagtcaatcatctgaccattaccaaggtagatgccgacgtgatactcatttcctgtaccaccccagaacaacaaatctcccggttgagcttgtgaatatgacttaggttggctaccatgtgatcgcaagtaggctgcttggttccaagtaactgaaccaatatctggcaaaccagcttgtgaacgaaccaaggcaacgtaaccagcgcaatccacaccgctccaagtcttaccaccccaagcgtatggcaaaccaagcatcttcttcgcttgatctggcattgcgttcttaattgaacgctcgaagaacgtaccatcgtttccgaaatagtgtgtaccaccagaaacgttcttcacgccttgtgaagcacgaccatcaccatcaacgtaatacttcatgccccaggcattttcccacttgttttgttgacgaacaccgttctcaaaccagtagtacgtacccatgtagaaccggaagcctgtaaacttttgaccaccttcgtaccacttccatccttcacctgcatccgtgtagccagacgtcttaccacgaaggaagaatgtaccattgtcaccaaagttgtaggcaaccccattaatgacacggttaccttggaccgcacggccttggttatccgtgtaatacttcatgccccaagcttcacgccaacctgaatcttgacgaacaccattaatgaaccagtagtacgtacccatgtagaaccggaaccccgtgtaacgttggccattttcaaaccatagccattgtccgtcagcattcaaatagcctgacttatgttgtgattgaatgtttgctagtgtgtcagcgtgtgacacctcttgttgtgcaacaaccgcagtcgtcattgcaacaccagcaagcatcgcagatttaactgcagttttcagatttttgtatttatccattgtcaaaattgattcactttctgcttacttaatacctaataaaccatacttacgatatagtagcagaaaaacgtaacgattcaattacaattcgttagcacaacgttaaaatgcggtaatcaggatatcctgattaccgcatttgcaatatctatctcatataaaaagtgccatttgagccgaaattatagcgtttgccatcaatcacgtgaattccttgcactgatcggccatcattgccgacgtagtaatgcaggccccactgggacacaaattggttgtgttggcgcataccattgcggaagtaatagtaagcccccatgtagaaccggaacccggtgtacatctggccattttctatccagcgccaacctgctggtgtatcaaagtaaccgctccaagcctgcaactcaccagtacttgatgcccggtacttctcttggttatgcgcgacagtttgattagttcgtaaataaaaggtcccatcgttaccaaaatgatatcgctttccaccgatggtacgcaacccttgtacggcacgtccttcaccatcaacgtaatagcgatatccccatgcgctgcgccaagcattgttaatacgcgcaccgttttcgaaccaataatacgttcccatatagaatcggaaccctgtaaacttctggccattttcataccagaaccagccagtaccgtcgttaatatacccaccatccatttcttgaagatgataagtttcgataacacgaatcaacttcgcggcataatcaggtgccgttgcatactttccttgtagcccatacgctgcttctttataattcgaagcctttgatcgccaggcacctgaatagtaattatggttccatgacaatccgtttgccaataggcgcgcattgccttcaagcgattcgcgaacactgttgtactttgcaaatttttcggtcaccgtaatatagtggccattcacatattcctgggttggcatcgcaacatacgcgccactaccaccccacttcacaccgaaatagttatttgccttagttgaaagctgactagtaccccaaccgctctctaaggctgcttgagccatttgaattgatggataaatcccatactcattcgacacagccatcactgcagccctattatttttgataaacgcttgcacttgtgcgttcgttgccccaaaggcttgttgagtcatgaccatcgttgacataaacgtcaacaacgccaataagattcctttgaccgtctttactgcatttccactcatgtaaaccgctcctcacataataaatccagcccttaatataccaaacaaccataaaaaaggctgtgaactatcaatgaatttcattacagttcacagccttttattacaggttcgagtctatttaattgttgttaattgtcggtatccaacattgttgatctaaacacttaaatcatgacgccaatcttagcaaaccaactttttacatgcttcgccgccagattataaccatacccggctaaagcacccaacaagaacaccaccaagacatacccaagcaatgtacccatgaacgcaacatccaatccaaatccggttaagccccaacttggaatgacgtgggcatagagataagttgctgtttgaaaaaagaagtcaaacggtgcgccaacgtgaaaaatgtagataaatagggtcgtgcccgccaacgaattgacactcttacttgaaaatttcaagcgcataaacagcgcaaaaatgattgccgctaatacataccctgggtaaccaataaagaaaccgacggccggcttggcatcaaatgaccaaacgtgcaaaacgcgcgctaagaattcatgagccagcatgtaataagcaatgaacataataattcctgcccacaaataacgtgatttaacgtgttgtagtggattgaatttacgcatatacccacccaataaataaccaacaaaaatcgttgccgcattaatagcgtctcggcccaacgacaggaacaacgtgaatttaaacaagacagaaacaaaaataatgacaataatcaatgccaaaaaagttcggttatctgttaatttatttagaaaacgattcaacggattaatgacaactaacagcaaaaagtaaacactcaagtaccaaaaaccacctaaatagccaaaaatcaaatgactatcatcaaaaatattacgcgtcgtattaattaattcatagaaaactggcccaaccaaacctagcttccgcaccgccatataaatgactgcaataatgacactaatgatgaccccgttataaagcaacatgccagcaaacttcacggctgtagccattgcccgttcaaaaggatttttcttctcacgtgcgctgatcaagaagtacccagaaatcatcgcaaacaaaatgacacctagctggccaaacacataacgcagcatcaacaacacaccgcctaattcaatattgttagaaatatattgtgaatcacgtgtgccaacaaaattaactagactgtgaaagataataatcattgacattgcgacaatccgcaacaactcaaaattactttgcttttcttttttcatgccctactcctacaaaataaaagcgccaataaggcgcttttaaaattcttataaacttgcttctgctaaatgaatcacgcgccaataaaagaaatacatcaataacattggccacgaaaaggcatttatttgtgtaatcatcgcaaccattaacgttaatggcaccataacaaagaatgcacggatgacaatccgatattcaatctgttccggcttgtctgattgtatcaactgacgatagacattcaccgctcgaacaatcaaaccaccaagcaaccaaattgcactaatcacaacaattgcaccaaacctagctaaccaccccaaaaagtcattcaacactggataagcggttttgctataaaaattaatatactcagaattgtgtttactccattctggtaagaattgctcaatgaagttcccttcatttccgaaaccgaccccaaagaatggatggtagataaatgtctgtaacaaaccgatggcgccaccaagacgattgtcagttccctgcttagcaaacaaccatttttcgaaaatatcatggacaaccggtacaaaaaagtacgctgatattaccacagctaacgatacagccccggcaataaacaaccacttacgcgtagaacgtggcgcaaacaataccgtaaacaggccgagtaaagcaaccatcagataaccacttgtcgagcgagccattaagaacaccagactcaaaacgactatcaacacccagacaagtttttgcaggcgtcgtccattctttagacgtttcattggttcttggacaatcgacaccaatatcggcccaaaaacaagtcccagcagcataactaagaacggtgcttcaggctcaaacccgttaatacggtgttgcgtggctacataacttcccgcatcataccaagctcggctatcccaatgacgttcaaacaaacccgccaaaaaatttgtccaaccggtaaatggtagtcggaatgaaaccgccaactgtgggacaataaccacaactagataaaccaccaaagaaataattaatgacgccaaaaatttaaatactgaatctgcatcacgaataaatatcttttgtatcgtgtacgcaaaccaaataacaataattaattgcacgaacgtaaaccaaccgtgaatcaggccatacgtttgatcactatcaccatacgccagcgcatgccaaccgaacagtataaattgcacaacaatcagtgcaccccaaatttgaagcgtacgtcgttctggcaaaatatcttgcactaacgccggtttaaaatttagttgtaccaacaaaaaaatcaaaaacacaggaaatgcaatttgtgcaaaattttcaaacagcgcgctcgtaaacgtttttggcaacaacgcaaacggtagtaaccaaccaaccatgctggctacctcctattgacgctttgaaggacgcaagtttgcaataatacctgtaaacagtgccaagatgataccgatgcctaacccagcaccagcaccaaaaatggcagccttctttggtgaaattggttcagaatcatcagcttttgcagccccctgaattgccaccatcaatcgtggtgctggcatacctggcaccagcttaggcgccttcgtggcgaaagcttgcgcataactgttagccaatgcaattgcttccttttcatttgtcatcaatacacgagcacgcaccgttaaagtaccaggtacttgttgcaacttagcgtactttaccaccgctgcgttatctactttttcaaacccagcaacgcgcatcaagcgcgttgtttcattcacaattgttcgatcataagaaaatgacaagtacgtacgaaccaaatccttgtcagcagacaaggcagactttggatcctgcatcttaacataatttgcatggccaatgtacatcgcgcgtgaagctgagtacgtgccagatgccggtgcgctgtgcttagcagcaaagaacatgccaccagctccaataatcgctaatacgataatccaccacaagttcttaaataggtggcgtaaaaggccagccaacgtcatttgattattcatatgtatactcctgaaaaattaaaacttactcatccattttgcaaatcttgtttgatttgcgttgttgacacttctggtgtcctaggcagataaattacctctacgtcagtttgatcggccagatagtcaaactcaccttgccaatcatcccccataacaaatgtatctacctgataaagagtcatatcagaaactttttgttcccatgattcttcaggaataaccaagtcgacataccgaattgcttcaagtaattgcttccgcttttcaaactcgaaatatgttcgcttatgtttttcctgccagttaaattcatctgtcgacagggcaacaatcaaatagtcgccctgttcttttgcccgtcgaagcaaattgatatgtccgtagtgcaacatatcaaacgtcccatacgtaattacacgtttcatcactttgcacccttcctgcagacctacatttgtttattatacatgaaaatgcctatttgtcggctagttatctaaaaagattaaaaacggcttacgaaaaaagcacatccacgaaagatgcgctttaatttctttatgtgtgctctaggattgacttaaatgcaaacgccgcttcatccccgccgtgaggattaaacctactgttcaatgcctccagagcgtcataatcgtattccgccttgtttaagcaatcgattaattcagcctctgaatacgaaactggcaagccaagcgtttcagccgtgaaatacaatcctcgcttcacttgatattcttccaaatcaggttggaaaagataaactggcttatgatatggtgcaaaatcaaagaatacactcgagaaatctgtaattaacaaatccgataccataaacaacttataaagtgaaaacttatcagccgtaataattgacccagactgcgtcgcacgagagaaataatggccacgatagataaccacatattcctttgccagacgttccaacgttgcgtccgttaacgtcgtttgttctttagcgtcgtaacctcggaaagtaggaacgtaaagcaacacctttttatcgctcttaattcctagctccttcttaatgcgctctacattagttttaccttcgtaccgttcaacaatcttttttcgtagttgccccgtattaacaaatcgctttgttcttgggaatacttccttaaacttatcaagatcgtaatcactatatgtaaacatatagtcaaaagccaccttgtcgtaccaatgctgcactaatggcgccaagccgatttctgtatgtcccaacgccttcattggcacaccatgccagaattgaatatatacattattatcgtgcttaaaaggaattagacgatcaatactcgaattagccacccaatactttgaacgcaataggtgatagaaaaacaatggtgagtttgatgaaattttatttgtaatttccgcctgtttaaaatctgcaggtcggttaaatgcccaaaccaacttgtaatccgcatacgctgggtcttctcggattagattaaatgcctctttcggcgtgtcggaaaattgcctaccactgtatgagataaataatatttgcttttcgttcggcttaataaatagctggagaaatttaacaatcgttacaccaacccaataatatagccaaccaaagagcgttgaattttttataatgttttttatttgttgtgcatgaatcaaaacgctaacctaccttaatatccttatattataacaaagaaaatacggatatgcggttaaccttattaaactcacatctttcagtaatataacggcaacaaaaaaggcacaaaccgagccgtttgtgccttttctttgaccttatctctttattaaaccatatcaataaatcgctcacggaatcgcaagtgaatcattgatccaaccattaacatcagcaacgttaataaccagaagaataatgcgtttgaagccttgtcccagaaccaaacatgatacaagaaagcgtctcggaatgattccaatacataatagaatgggaacatcttaataatcgtcaccagtacaaatggcaaatgcttagcgtccatattaattacaacgcccgaagtaaagaaaatcaaccggaatactgcagacatagccggcttatagtccggaataatcactgttaacgtagaattaatcaagttgtgtgccaaaacagttgcgaacattgcaatgaaagcatacacaaactgtaaccagtgtacatttggcatttcaccaaacactagtaataacaccagcattgccacagtcataacaaaaaagcgacgtagctcttccaacattggcatcacaggagcaactgacatggggaagcggattttagtcaacaatcctagttgtgacttaattgacgtcaaccccttattaaacgacccttgaataaagtaccatggcacaattccagttagcagccataaaatgtatggttgtccattcactgtaccgttatacatacccataccaaaaacaaggaagtatgttccaatatagattgttggttccaagtaatcccaaatagatccaagataattatccgcccaacgtgacttaacattaaatcgcgctaaacggttggcaatcggtgcgtttgaaaagatttcacgcatcacttgcaaaaaatcagtcatgttatttctccctacttcgcactcaaatcatcagccatatgttcaacatttaactcatgaattttctctggtgaccaattcgtaattaaatgcgaaggatgctcaacaatatttttcatacctaagttgagaataaccttatcagcaacgaaaaccgttaacagcaacaaaacaaccaagatagtcttatctactaccgaccaccgctcagctgaatgtcgattgtgcgttgacttataaattgatgtttcgatttcagctggcaaaacatcattgcccgttatcttgcgttcacgcttcaacgacttttcgtataattcatccaagctaaagttctgctgcgcagttcgatattcattacgatacttagtttgttccttaccagataaagccttgtagtcagcaatgaacttatcatatgcgttcataacttcttctgtaggcccgaacattcgcacttcaccatagtgcatccaaagtacccgatcggccatttcacgaacttggcctagcgagtgtgacacaaagaaaatcgtctttccttgttgctggaattccttgatttttgccagtgacttacgattaaacgttgcatctccaaccgacaatgcttcatcaacaatcaaaatgtctggatttgtgtgtacagaaattgaaaaaccaagttttgacttcatacccgatgagtagcttttaacttgttgatcaatgaaatcacccaattcagagaacgcaatgatttcatccattttcgcgtcaatttcttcatttgttaatcctagcataagagccttgagtcgaatgttttcacgtccactcatattccccttcaagccagcattaatcgcaattaacgatgtttcaccgttaatctcaatctcccctgaagttggtggcacaatacccgcaaccatcttcatcagcgttgacttacctgaaccgttgtttccaacgatggcaatcgtttcaccttcaaaggcctcaaaattcactccacgaacagcccaaaacttagggaagttcgtcttgaaaaagagtgacttcatcttatcagactttgtaggagccatttcatattgctttgtgacgtacgatgctcgcaccttcacttgtcgctcttcttcagccacaacattatctccatcgttctaaataattgcacggtctttaaattttttaaaataaaaagaataccgtcaataattatacccctaacctgtataaaaaagaacattcgcttagcagaagcgaatgttcttttggttattcttaaagactacatgtgccagtcgagcacggtcttaccccaattcatcgtcaagtcctcatcaaacgcatctgtaatgtctttgatttcggtaacatgcttgacgttttgcaccaacaattctaaacgttccttaaccgcatgattattcgcgaccaagtcaatcgccgtttggaaatcttcgcgggatgaacgcgtcgttcctgccaacgtaatccccttttccaataccattcgtgtattaatggcaactggattttctgaaacaccagacaagacaattgccccacgtggattgataatatcaataatttgatttgtcgccgcttctgatccacgtccaccaacagcctcaattgcttgatccagtttcaaatcagctggcacttcatcaatttggactgtattggcaaaactgatgaaatccagcttttcttgatgctttccaaacacatataattctgagtctggaaacatttcacgcgcaacaactgccgtcatatacgcgacattgccatcaccccaaataccaattttatcttgtcggttaatcatcgtttcctgcaaacggcgtacagcctgtacagcaacagacacgacctctaaaaaggcattcatcgtcgattgcgcaccagcaggtatctcaatcaaactttctggttcaattgtgacatattcacgcataaaaccatcttccgtagaggaacggaacgttgatgatcgcaaataattatctgcaattaaattatcatggccatgtgcatgcgtgggaatcatgacaactttggtgcctggtgtaaaagtgcctgtattatcacgcaccacttcaccaactgcttcgtgaatcaaagccatcggcaaccgtgcagctaaaacttccttatctcgtgttccggtgtaataacgttcatctgcacggcaaattgacattaacgttggtcgcacaattaccttacccggtgtattcaaatcagttgacgtcgtcacgcgttcaatttggcggacacctgtcaaacggtaaacattattgaacatccaaattctcccgtgcaatgatgttagcaatccgcaaatcgtaaggtcgtgtcactttgatattagactcatcaccagcaacaattccaactttgtgtcccgccagcaacatcaccttagccgaatcagaaagaatgttgcgttcttcttcagtcatattattatattgcgtctcaaaggccgtaatgttaactgtttgtggcgtttgaccctgatacatttcatcacgaactggaatatctgtaatcataccgtccttggcgcgaacaatcgtgtcagttgcgccaatcaccgtatcaaccgccttatacaccttagcagcttcaatattatccatgataatgcgtcgtgagataaacgggcgaacagcatcgtgcataaccaatacatcgtctgcgttcaagccgaagttatctttgatgtagttaatagctcccatcaccgtatcgttacgttcggcaccaccttcaatcacaacaatgcgttggtcatcgatatacttggcaatcaagtcctttgcgtactgcatccactttgggtgaattgacacgataatcttgtcaaattcagcaatcaatgaaaacttctccaacgtatggataataataggcttatctgccaaattcaaaaattgctttggacgctctgtgtgccccattcggctaccgatgccacctgccattacttgtgcataaatcatttatctacctactccttagtaaaaaaccttgcgtgcttattttctgacttaattggcgtttgccaatccccaaaaaattgtgttaaatattgattgaaattttgtgggatatatacttccgcaccctcgaaatttttcatgataagcggggcaaaaatattaccattaaatatttctttcctcccgtacataccattcagcacgccaatagcattagggtcctgaatgccacgaataaaacgattcgacgctttaatttccaattcaacgaaacgatgcgtttgtttataagaaactatttttcttagacctcgctttaacggcacaatttgtgcatcatctgggaaatttcctgtcgacctggcgacgtttcgtaaaacatttaaaactttatgcgccagtaagaaaacctttaacttaatccccatctgcacctgatcaactggaaaaatatcaataaacacaccgtgattaattttataataatctgattgtgcgatagtctccgaatcaactactcgcgcattcggcaccaatgtatcctcgtcttcttcagtcatcaatcgaaatcttgaattagttggttgataatgcttcatcaaccagtcgtagtcctcacgaaataaacccacgtctaaatcatcatcccatggaataaaaccatcatggcgtacaagtccaagcatactgccaccaagcagtaacaaccgccggttattttgtgatacaaagttagcaagatcctgcaacatttcgcgtgtaagtgcttgaacctcgttaatcgtcatttcatgcttaaccatgaaagtaccccatttcaaaattcagtatgtgttaagtatagcaaaagtgttaacaacgtcaattttattatgtaagcaaaaagccgagcacaacgtctcggctttttgcttatcgataaattatcgaaaatcaacaaaattattttctagcgcatcaacaaatcgtttagatgccttgccatctaagtcatcgaagtaatatgccaaaaaattatccaggctttgaggattaaattcattaactcgttcaatctctgtcactaaagaatccgtatccctaacgattggtccgggaacaaattcttgataatccacataaaaatctcgtgaagccgtgtattcttcaaggtccggcgcaaagaatattgtcttcttccgcaacaagctatattcaaatacaaccgacgagtaatcagtaattaatgcatcagaaaccagcagtaagtcattaacttctcggtacgaagatacatcataaaagaagtccgcatattcttcaggaatttgcaccttgtttttcacgaagggatgaatcttaaacaacacgacatacccagctgcagatagcttagtatatagcttttcaaaatcaatccaatcaaagttgtagtacgccgacctttggccattgccacggaaagttggtgcaaaaagcacaacttttttacctttaataaagggtaattcttcttcaagtcgagtaacaaccgactgcttataagtcgtatcgaaaaacatgtctgtacgtggtgcaccaagaggcaacacctttctgtcatctatgccgaaaccctcagcatagaatggtgccacatgcttcgaagaaacaatcgcccaggtataatttttatggttcttggatgttggcttaggcccacctggtaaccccattcgactaaacccaaatgttttgaaggcacccactgcgtgccaaacctgaattaaattcacgttatttcgaattttcaacggatacactagcggataaaaatcatccagcagcacgtgttgactagttgcgattagccaagcaattttcgtgtactcactaaacgtttttttagctgagtttgtttttttaagcatatagctaattttcaagtcggtttgacgtgacttgatttctcgatcgatatactcaaaatttccagttagattcgatcgcgaatccgataaaaatgctactgcatctttatgaattggcaataatgtgaataccttatacacaattcgaaaatatgcttttttagatttattcagatactttttcagtttctttttaatcttcttttttaacttagaaatcatctaaaagagtcactttcattacttagtcaaacgcttaacaattcccttaacagcctttttgcgaagcgctgtcattttaggatcaatcgaaacataattcttatttgcagtaatatatccatttgccgtttttagtcgaggagttccgttctttgtccattcaacagccaaaacatcaatcttttgaccacgtttagcctgctcatcaattctatctggtcgaccaaacgccaccgttcgataataataggttggtgtaactaccgttacttgcttcacatcctcataaatgtactggtcaatatcatcgcgaagagtagcaacgtaatttacgtgagcggtgatatatccaaatcgagttcgcagacgtggcactccggttgcggtccattccacagaactaacctctagaatagtgaacgcgcttaactcctcctgctttttagaattcttattccaccccacactagcgtacgcaaattgatctttgaggagtacaacttgtgcaggaagtttctttggaacaacataatttgataaatcgttcttagggaataaggcatctcttggctttagctttttgacaggtaatttttcgattttctgccggatttcaaacgcttgtcgagcttcatctgttgacctacttaatgatatctcaagattcttagtcatctgtttcaactctgcaatcgaattactcaaaactacatcagctgacaatgcaggagcaaattcttgtgtatccccgtacattgaaacattatctttataatttgcaaaaacatcagtaataaactggtcttgtggattatcaaagtaatactgatatactgtctccgcaacgtatctttgaattgtatcgtttccagaaaatcctaacttagaaaactcggccgcaaactgttgaatgcctgccgaaatagcttcattatattcattccactgtgattcaaagactggctccactttgccgttttcgccatagtagtatccaggaatactcttataaggtgttgttgcaaaaatagactcgaaatccgtgaaattaacaggcatctgcgtaaaccgatgacgaattgaacgtccataatctggtgtgtaatttcttacataataaaacggattgtccacttctttgcccgccgcgtctatcaacaatcttgtgaatgtatcctgtgtgtaccctcgtccccagaactcaataaatgcaaacttttcatcaaaattaatggtttgttgtaaatattctcgtacaatgcctcgtttttcagctgcaatattcagcaagcgttccttgtactcatctgaattttcaaatagttgtcgaattccaactgcaatatccccacgaagagttggctcatttttataaccttctaaatctgggattaaatcaagtaattctttttcactaagttggctagcttttactaagtcttcaaacgtgtccatattgctgaacattccaaagggcgtaaatgatgctggatccacttcattgataaacgatggaacacgccacgcctttctagacccataaacgaattcagacttaatattaagattatttttatcaatcagcacatccgcaatttgtttcaagtaataaccatcacgcgaaatgaagtaaacagtttggtatccacgacgaatagcatcattaattgcccagtcaacatatggcaccaaaatagatccaacatatgcaaatgcgaaatactttgatgaatcaaatgtcatttcctcatcatcgacatgtgaccaccgataacgatgcatcgcagttgccagtttgaacatatcatatttaatgtcatttggcgccttattaatcaacgtttcttcaaacggcaaaaatgaatccatatcatggttcacagtgttaataccgattctgcggggtactgtgccatcagctctcttattatccccgtggtgaatccattctgcgtactcatatttcttatcaaagaaaatgtatgtgaataaacgtcccgttgatttttgatacccaatttctgaagatacatacaatgggatattaacaagtgattcgtcagcctgagctatcatctttttgatgacatctttaggcaaatacatatcacttaccagatagacatctgctccctcggcctgtaatgcatgcaactcatcaatcctagattgaattggttctacggcttcaatttcagcttcaacttcagcattataaagaagttgaacctgttgatcatccaaatcaaaattgttttttaaacgatctaaaatttgcgctaaagtaacttctattttatcagtatcacgttcaaacgtggttttccggaatacatctcttaagtcaaattcaacctgatgacgaatcacgggataattctcaacaagatagttactaaaactattgccagagtacgttgccatcttcttttgaactaaataaaagataccttcaggctcgacggtattccgtcggattaaagtgtcaaatatatcaaacgtgtgtaacgttttgtactctttcttatttagaactgcattgtcaattttttcgattaaagcatcaactgaagaacccgcatcatactcaaaaaagtgatttaacaagtctgctttttttgttataactggtagatttgaacccaataagtcgatgaattctgcgaaagaatatgcatcaacgccatccgtcagttcaaaataatctccaactaattctagatcattgacatactgatcataatcagggatatagcggataaaccgttcgacaccgctttcgagcatatcgtaaaagattgacgaatagtcaattaccccaactgtaatcttattgaaaatttcgtatacatcgtatttgtcatcccagaaataaacattttcatcatcttcatattcttccaaggctgccaaatactctggatcttcaagcataaacggatgtagcttaatgataaagagcgaattgctgtcggccattttttgcgcaacagccccaagattaggcaaaagctttttaaacgacccatttacattcgtaaagcggtacgttggcgcaaacaaataaacgtcgtcatatttttcaataaagtctaatgcgccgttatcagtacgcatattctcaaattggtacacttgatttcgcggataaccaccacgaataatttgtgactcatctaatggcatatcttcgataaaatggtcttccatagctttcgaagtagccaagaatttgaggttgtttttatacaattcgaagtttcgcacgtactttcgcacgatgctttctgcaagagcagactcagcccctaaagcaagttcgatgtgcttaagtccaaccccatgccacagattaataattttgatatcagggttcatttctgtgggatatttttcacggaaattttctgttatatacacatccgcgttactaaataagccccgtgccttcttactatttgacacaaccgcgtgataccctaggctagacacaagcgctgcatcctgctctgaatcagcaacccaccaaacttcatgcgttttggcagaatgctccgccatatacatcatcaaagctttggggttaccttgccatttataagatccaaataaccaaagtttcatttacttactccatactatttctaaaagccctatcccaaactagagcacgtaagaagaattatacactacactagtcattcctttaacacactatacaatttttttaaactatcacaaacatcgtcgtaattttttggcgtttaattatttttgtttagttgatgtaaaaataaaaagggcggactcaaatatcgattttgatccaaaagcaaaacaacatttcaacaaaactaaccacaatgtaactgccacagtcacttgaaaccttcttctaacgtacactactaattacgaaaaatgtggcacttcaatgttaacaacagtaccaaaacggttatccgtaaaggaccacgcatcgcattcaacattcaagtttcaaagctttagaatccgcaaacaaaaatttctatgcaagaagtgcggacgcacgtccattacgtagctcagcgacattcaaccaaacaaccacatcgttgataaggttaaagttgtagtatcaatggtaatgagtgaaaccgttagtcgaaagcacatcaccttatacaacaacgtatcaacgcaaaccgtaatgtgcgtagccgaaggcttattcatttacaacacaacagatttccattacctgccccaaaacatcgcgttcgatgacgtcaaatcatgcaagttcgcaactagaagaatgagcatgctgtttattgattcagttaaccaccgtattctagatatcagtaaggatcgtggtgctgaccagctgtgactttttcaatcaatacgctccagcagctgttaaaaccataacggttgacttatttacctcttgccgagccatgagcagggatttatttccaaacgcaaacatcgtggctgatatatttcacgtagtaactcaagcacactgtgaaccccaggctgttctataccctacaaaaaatgatgcccaatactgctcattgccaaaggcaatgaagaaggctcgtcgcacgcactatccgtaaacacttcgacgaaataataaacagctttttctgcggattctcaaatggaccaattgaatattcaaacactaaaatcaaagcaattaagcacacggcgtacgggctccgtagttcaaaaacttccgtctacgtattatcatctcattcaagcatagtttttactgaatgaactataggcaaaaggcagctgatctcaacaatatgaaaatcagctgcctaagcaaggttcaaaatattaaattttaccggccatcagtaccacttgactttgaaccgttttttaatccctatcactatcaacggaataatctcttattaacagttaaatacagataaacaatcatcaaactcacccctgttaacaaactaactaaaagtgcagatttataaaaccagctaacagtgtaaccaacaaccaggttattaactcccggcttactacttaaataaattgttccaataacgcttcgattaatcctattgtttaaaacagtcttcccattaaacaatagttcagtattcttatacgcaacaactggaacattcatattctttgaactatttgacttattaacccaggttagcgtcattgtcgcgtctcgatgatttacagtgtgccgaaaattacgccagtttttagacacatacttcaaatattcatcgtaagttttctgatttgtttcatttttttgattaacgggaatgtaatccggtgtcgttctgtcaacactgttaattagcgctcccaaatcacccgtatgaaatttactttgaaatgctgcaattgtttttatggtaggtgaatttaaatttttatcgatagtacccaatccagttgctatagaagtctttggattttgaacgaaatctacactactgtttactttttgagtaattagaaccaccgaaactatagcaagtgcagtatacaagaatctattcatcgactctctatttcccaaaattttagttaccaacaaaggaatactcaaaatcaaaaaaggtgtcccaatccaagttattcttctcggcatttgtaaaaatgaacttaaacccggaaaaatacttgcaatattattccatggaacaaatcctgttccaattacaatgtatacaagcgcagttatgccaaacatctttgtaaacgtatcataccttgaccaacctgcaaaaataagtatcaatcccgtaaatgccaaaatagacatcacgatatctgcaccagaattagcatttaggtacgttggttgaaatattaagctggcctgatgagctaaattcatagatacaggtgaaaccaacttgttatttgtaaacacctcaatcatcggaacaataacatttaaactcaacataattgttaataacgctgctataaaaacattacgtaataaaataagtttatttttcgagaaaaagtaacctcgcacaaaaaatggaactaaaaatggtaataccaatactaaagttaaaatttgaaattgagcaattatcgcaattgataaactagtataaatgattgttttttttgttaacttgccctcataaaaatatagtgctattggtacaagaagtggcagaaatgcaaacgcccacgacctccaagttacaccaaaaataaatccagttattgccgacgaagccgaaaaaatgatccctaataacaatgaaacttcgttagagaatttcattttttttgctgcataatacatacttatcaaagcaatcaaatgcagcagaaacaaagacactacttgaaatttaaaccatgtacccgtaattaaaagtattacaccaaaaaaatatgtcatcagtggactatacaactgattaacaactctaccactttgctggaaactatatagatttaaaaagttaaaattcaaattttttatttgcatagctgcttcatatatccgactatattgaaagtacccatcaacgcccaacagagcggtgctgtttagaattatgggacttacaataaccaaaacagatagcaaagcaataagaaacccttttgtatattttttgtacaacataaaactactcctattttttgttcacactatttacaatcacatcccatgtataatccaactacgtgctaaatatattcattttctaaaattgtatttctgcgatcaaacggatataataataccataattattttaatattcattgaataattcaagtgttcaaaaaaatggcgataaactttagtatgaaagtttatcgccattttttgtttatttcaaagttttccaaacgtaaatatactcaaatcaaaaccttcattaacaaaatatcgttacccacgattaatctataaaaattagtcttaaaactcactcacgaagattcttttcaatcaacattttttcatatacataaaaacaactattaccgaaattccaatccatgtagtgatactaaagcatattcctaacatcgtcattaaggatgtttcataactaatcactaacttattgcttcccttccggacatagacgtataaagcaccaactttattccgtttcagcacatttacgtttagagattgtccgttaagcactagttttgtatgcttgtaagcaacaaccggaattagtctctttttgttagcaacattgcttttccactgtaatgtcatcgtcccatccccattaacaatgtgttggtagggacgccattgctttgaaaatgagttcatgtaggcatcataggttggctggtgcgtttcagttgtcgaatcaaccggcacataatccggtgtcgtacgatcaacatgataaatcaacttacccatatcaccatcatggaatagcggttgaagctgcacaaacgtatgaatgtctggcgagtacacattgcgaggcgttgcctgcaatcccgcgtacagtggtgtcttctcgttttgaacatagtagacattgttcgcaaccttctgagtcagaagtagcacagatactactgcaagaattaccggcgtaaggtgacgcacaacgttattatccggacgtacttccataaacaccttaccaactacagcaatagttagcgcatatcccgtcaagctaattcgacgcggcatctgcaagaatgatcgtaatcctgggtaattagtttccaacaagtgccacggtacaagtgaagtccccaccaccaaataaacaatggcgacaatagccataaatcgagttaccacactcaattttttccaaaaagcaattgtcatacctagcaatagaaaggccatgacagaaatcacgatgtcactatttgaattaacccccgtatacattggctgaaaaattgggcttgtttgtggcaccatgttcatcgccacaggtgaaatcaaagtatttcgatatacctcagctaacggcataatcgtgttcaaacttaacacaatcgccaacatcgcagctaatactatacgccctaaaaatcgcaacttagcttgcgcgacccagacaccatgagcaaaaaacggtaacaacattggtaagacaatcgctactgttaacacttggaattgtgccaacaaagcgacgacgacacctaaatacaccgttcgtctccaattaaaacggccttcaaacaagtgcactaaacttgggataaccaatggcacaattgctaaagcaattgacttccatgttgctccaaaaacaaaaccatacacagcagcagacgatgtatatacgacacctaaacttaacgcccaacgttttgttaatccgacctttgtggccgaaaaatacatcgtcaatattcccaatgcgtagacaatatataacgttaaaatttgaaatttataccaagtgcctgcgaccaacagcaacgcgccgaagaaataagttacaagcggactataaacttggtttacaatacgaccagcttgttgaaatgtatataaattcaaaaaactcaaattacgatctcgcagctgcattgctgcttcaaaaatacgattatagtgaaaataaccatctacacctaatagtgccgtgccattaaataaaatgggactcataatcaccaatggcacaatcaataccacaagtattaactgccaattaacctttttaaacataacccctactcctaatgccttattgacccttcattaactctgcaccacgattaacaactaagtacgattgatgcgtcggactccagtccattgcttcaaattcgcgtgtaccaccatcttgcgtcgcataaacacccatatcaaaatctggataagttaaactgccaactagccattttgtcattggaatggccaagtaagcaccatctgtaatgtaatacagtttctggtccttttcattaaacgacaagaactgtgtataatacccaggcttgctacgaataactgtcggcgttatcgaaaacttgggcttgccgtcaaccatcctaccgtgatacagcatcacatccccattctgtagattagtatctttttttgtcttatttgtgacgacagaaacaatatacatatttcccgtgttatcaatcgcaaaattacgttcactatttattttgtcatgcgatcgtggatcagtaaatgaaaaatctgcactttctacaggcgcaagtgttttcaaatcaacttgtgtcaatgactgcttataggcgtcgtccccttcagccattaaccataatcgcttagatttggcatcaaacgatagcgcctgtccatggcctgtataaaattcaggtccgacctgaactgaattaagcgcctgcaacatcttcgttgatacaaacctttgaccattaactagcttttctaattcacgcaatctatttttgccgccaccaattacgcctgctctgcccaatttttttaagtcaaacatcacaacacggccatacttctttttggtgttactctcgtaaacaatatataatttatcgccatgaatcatactaccttgcggattagcccaattcaccaaattcgttgttacggttggtaacaacaaattggtttcaaactttgtaattggtcgaatcgaattaggccgagcggtaataacatttgtttcgtcattatcagaacgattcatttgcattggcaacgtcgtttggtatgcaattttgtttgtaaacgacaagcctgtcttaggtgtatttacaattttgaaattcttaatatcaagccgactattaccaaatgatatgtcaccaaagttcttttttaatggttgcgatactgatgtcagaacgtgccatgctgcaagctgaaaatcactcgatttatttaaaatgtttccatgtcgatctaataattcaaactttattcgagcatccttatttagtttctcaggtaaattaaacttgaaattctgattgatacggatgctgtgcttaaaaataagtcgttcagtattaaaaactgccaaatcaactggtgagtccaaatgatagcccttcgcaccaattgcacccgaaataacgttgctattatttttcattgttacattgtcataactcacagcggtatattcaggcgttgcttcaagcctaatgtaggtaatccgcatatccggtagaattttcacctgatcaggtgctgttactttccccgcaaaaaacacgtttaataataccaaccagataaccgtcattaaggcagcgataatgccctctattttgcggtccatagttcctccgttccagattaaataaaaaagcaaggcaatcggccttgctttaccgtttattagcgtctatcaaatatttttcgattcgattcagttgttgcttcatctcagcaacttcttcttggagtgcctcattctcttcctggaaataactggtaattgaagatgtcagcacaccaaacattccaacgccaccaagcgccatcaaaatggacaataatttgccgagcgtcgtatgcgcggaaacgtcaccgtatccaacggttgacacggtaataattgcccaataaaaactattcatatagctttgatgctcaacgaaatggaaggacaccgccaccgcgataacaatcgcagcaacgacataaaaaacgtttgcaatattagttttccggaaaatcttgtttaagatattgccaatcaacgttagcactttcaataaacgaagcaccttcaaaaatcgtaatgatttgaacggcgtcagtgcaatcaaatcgattagatgtgttgcaaaataacgtttcttgtcacgtgcccgctgcatacctcgaatataaacaataccaaagtacacccacaaaatatggtcaatccagaacacccaggccggcacatgcatgatcatctcaaaaatagtcactgcaatataggtcgtactcaacacaatatttagataaaacgttgtcttttgtggcaaccaagtcggccgtaccatctgtctcactctcccatttcgaatagctagacatatagtacacttatttttcgtgcgtttcaacggaagttactacctacattcatactcgaaatgaaatttctagacatataacacttacatataaaaaacggacgtgaaacccatcttgagattctcgtccgttctatttagatacccgataattaccaagctaatccacttgctgcgatttcatttcttgatgcatattggccgtttgctcgatgccaacgtgctgtgtaatcctttgaaaaacgtagatagaacgtattgttgttaccaaagtaatacgtcgaactaccgataacttgtgcaccttggaccgtacgtccatctgcgccgacatagtagcgcatgccccaagcattttcccacttattttgttgacgcttaccattttggaaccagtagtaagcacccatatagttgcggaatccagtgaagcgttgtccaccttcgtaccacaaccagccttggccagcatctagatatcctgatgacttaccacgtaaaaagaatgtcccattattaccaaagttatatgcaacaccattgatttcgcggttaccttgaacggcacgtccttggttgtccgtgtaatacgtcatgccccaagcattacgccatcctgaatcttgacggacaccattaataaaccagtagtacgtgcccatgtagtaacggaatcccgtatacttttgcccattttcgaaccagaaccacccttgtggcgtacccaagtagcccgacttgtgttgcgcttgaatcgtttgcaattcatctgcatgcgtttgttgtaccgtaccagatgcaacgttaaacccaacgacagctgccactgtaagcatcactgtcttaaaaaatttacccataccacgtctcctagtgtaaaaatacgtacaaaaaattaatacatgttcattatagacacatttccttggatagtcatcttccatttcagaatagaatcatattccaaataaatagcgaggacatcttcttagatagcctcgccatttcatttaaatatttacttaaccatcatcatttcaacaacgtggtacttctggttataattaccagtcaatgttgaaaaaccagtcactttaaattctgagtgatccttcaccaagtattctgattccaaaccatattcttttgacaacggtgcaatataggcaccgtgacccgtaccagctggaattgtcatttgcaagacataactatctgatggatccttagcaaaatcaaacgcaacacccttgtcaaaagacgtactcataaaagcattgtcgctgtataatgcgccgacttgcaatggtgcattgtgcaatgaaatctgcagtccctttgcactaaccccacgataaactactgtagtctttgggttgttgtaggtcgtcaccgcatcgtgaatggccgccgttgcagccgttgtctgtgcatctgcagttttcgtaatcccacgcaagtagtcattaatctttacatagccatcatttccagcataccacgtaatcgcagctgtacttgcagctggaaccgttgtcttccaggtttgcgaaacctttgcgaaagctggttcatcgaccgacatccaagggtttgcattaacttttgtagccggcgttacagtcgctggctttttgacaaccgtcgtactcgttgccggcttcacacttgatgcggcgtgattaacaacgctcgtctttgcaacagaagactttgcggccgaaacctttacagaagaagccttcactgacacaacttttttaggtgcaacggacaccttgtgtgcctgaactgccttttttgtagttgctttcttaacaacttgcttagacacaatcttcttgtgcgttgtcttcttgacagtcttctttgctgaaacatgatcatgttgtgccgtttgtgctgcagagacttctactgatgaacctgccaagctacctaacacagcaactgttgctaatacagaacccaacttaaacatcataaccacctctaagatatgtttcaattaatttacaaatgttatcttaacatgtcatttgaaacgtggttagaaaaagggaacataaaaacagcagtctgactacgcgtgtcaaactgctgtttgcggatttgttttattcactatgccgccgcaattttatttgccgcatccccgctcgttaattcaaccaaaaatgacgcagaagtgccgaaaccgtatccaatataactagtgtgtgtttccaacaaactcgcatcttcagcatccattgtaaaggtcaatgtataaaaagccttatcagcagtccatatttcgtcactatctgatgaaaacatcacctttggaccattattaataacaaagttaccatcctgcataatgaccttacttgagtcagactgcgttgtagcattccgagcaaacactaccttaactatcgcttcatccgggtcaccatctataccgaactgcacatcataattagccaaatgccctagattagacacttgcgtaccctgctgatcaatatgaatcgatgactcgtatgtatacttctcaccattacggacatcatccgtcgttaataaatcactcttcacccaagcaccttgcttagttgtctgattgactacccagaaatagtcacctgccgcaaagtacgcggtataagtatcatcaacaccatcaaccattgtggcgtccgttgccccgatttccgtaccagcaataaggtcatccgaatcatacgaatctacaactcgcatcgcttggccacccaattctgtaagggtcatgctgctaatggtttattgcgctgcttgataagctgacaatgacttagcttgcgaataatctgacttatacgcagcgagcgccgccttagcttgatcttgattatccacactagcaattaatctatcgtatgcttcatcttgattagtctgatcaacttggtataacaacgttactgtgccagcctcatcaaccatttgtgaagctggcgttacgtaccctgagtgcgcagctggtgtgacctgtacgcttttccctgcctgtccttgcattgagcgggttgccaaaactgtcccatcagcagctttttcaacgacattaaccgtataaaacttcggatacgttaatgtcaccatcatgtctttagttggtgcaactttttggctgattggtgttgcgtaaccaggatacgctttaggtgtgactgtcaccgactttccctgttgcactgcctgattggtagatcctaatttggcaccatcagaaccaactgaattgattgtcacattatacaaccgttggtagttaaacgtggctgttgtatctttattaacctgaatcttttgcacaggcggcgtcacgtaatctgcgactaactttggcgttaacgtaactgtttgaccccgttttacagtctgactactcgtaccaagtgactttttagtatccatagcgaccatattttgcgtcaacttaaacaatttgtcatacgtaaacgttactgtgctatctaacttaacatttgccaacttcttagttgctgtactggttacttggtagccagaaacacttactggtgtaaacgatgctgtcttaccaaccggcaccatcttggttgtggccgttttaattgttgcattgttatagcgatcaacgtacttaatcgttgccttacgatacgtcgcctttacttttaacgtgattgtacttgcttttgttaccttataagacaacttcgccggtgttgcatagtatttaatcgccaccggcttgtaagtataagttttattctttgaaccagttgttttaactgtcttcaacgttttattcgtcgttgcatcgacatatttaaaagtggttgtataacttgcagtcgctgcatgcgcttgaccaacggttaccaaaccaaatgacgttgctgccaacaacgtcaggaccatagtcttcctcatctcattctccattatttctctttacagaaaataagtatactcgtatttaggactaatttgtatgagatttgtggtgtttatcggccattcccagaatcgagacaaaaagccagacaaattcacttgcctggcacacttcattatccaattctatttaatacctattacttggccatccaaggaaatgacaataacttttgtaccattaaaactatcggaagtcgcccacacctgccgagttattcttccactgtctggtgcatagattactttagttattcgtgcattgttcaaccttgggtattcttttttcaaagcaagcagagcgatacttttgaaatcctgatcggttgttggacgaggtgaccgattataaccagaataattaccgtcactcataccagatgttgcattagaactatcgctaaacaaagtaccataaatattgatttgtccatccggctggtttcgtccttgataatcaataccataatgaatagttgcaccatgtaacaatattgaatctgcttcatcgtcagttactacatatagataactcaccgtcccatttgtaaataactcttgtttcatggcattgacaggcgttagcgattgcccatcgctaatttcaagtcgaggagtgttcatcaaataatccgtaccgttcgattctccgttagcactgaaattcaaacgaaccatagcctttttatccccagggttaatggcaactagctctttaagcccagatataccaacattatggaacaagtctatcgaatccaatgaagcttgactagaatgttcatcataaaaaatttgactcaagttttttgtgattttatcggagtaaacaaaattggtcttaaatcgagaactagagtccccattttcgagtgagtcaattccacctacattgagcaaattctcggctacccagccaccagtttgggtgcgttggttgactacccaataataatctcctctgtcagtcttagcttcaagatatgctatgtaattagcatccaggccattaggaaaataagctgtacctgaattgtcagctgaatcactatatttcaaattataattctgtataccatgatccgaattataatttttcgcatacaatgaacgtggttcccaatattccgataatttcaaatttgtcaattcagattcaattgtatgataatccgaaacagtgcttgcccgatcaatctttgacttatacgctttcatagcttgctcaaatatatctttattcgtcacttgatcataatcattattatataggcttaaagctttagtcttatcgattgaataattgaacgaaatttcactggatttaactattgtcatcgtctttgatttaggcattgtatatccatcaaaatttttgggctttatcacagttggtacgccacggcgcacagactgtttgaccacacccaacgttctagcatcagttcctgtcgtcatatactttactgtcaccggaataagctgatcgtatttaaaaataacgctcgtatccttactaaccctcgaaagtttaattgaatttgaactattacttaaactataacctttagctgccgccactggtgcaatcaatggcgtcgtcccaactttcaccatctttgtattattctgaataacccgatgatcaaaagcatcaatcgatttaatcgttacttttcgatacgtagccacataattaactttaatagttcctgttcgtcgaaccgtatacttaacagcttttggggttgcgtaatactgaatcttatttggtaggaacgtatacgtccggtttttaacgccagatatcttgatggtccgcaacgttttacccgtcgtcttatcaaccaatttaaacgttgtcgtatatcgtgtgttggctgcttccacggaattcgtcacacctaaagcacctgcgacagcgcttatcatgaccaccccaccaacaattgcaatctttctcataccctgctcctaacttaaaataaccttatgattataggctaaaaaacaggacaacaactaaaattccatgttttcagaggaatccgtcaataaacgccctaaatacaggcaaaagccagacacttacgcatctggcttcaacaaattatttagttcagtggcatagacttttgtccatatcccttatatgcgtattgtggcaaccaccaataagttgcattggcaatatcagcatctgtgtattggcccggaattacaaaccaacttgcccaatcaccgttttcagttgctgaccaactatctttcaccatcaagtcattatagtaacggccatctaattgaagttgcgtatttgatgactgcagaaccttcatacgtgttgcattagcaccaagaacatttggcgtcccgacgctcttatatgtcatgtacacaatattattacccgatccaaacacattatgataaatcgtgtaacctgcaatataggcgtggaaaccactatcagatgccaacatcttttggcgcgtggttaagtcaaccgttgtcttagactcgtacgcaatcatcgacgttgcctgcaaagcatgcattgacgtatccgcatctgtaattgaagttgagaccggcacattttcaaccgtaccctcagtaattttggctggatcaatccaccctgaaccagccttagcaccgcttacccatactttacgatttgcaccattgtacatcagccaagcatgtaactgtgtctgccacaaattagattgtgtaaattggttatcattcgtcactgacttagccaacgttacccgatcagaaaattgtggtcgcccgtcactttcacgagcttccatatcatacacgttcaaattcatcaccgtgacatgttgcatcacatcattaaagttgttccaagctttcttaagggctgatgcactcgtagctgacttcatctgcgtgtaataaatattggtagccgcctgcaactgcgtcgtgtgcgttgcatcaaaatgcttgttcgtaatcgcttgattgtacttgttcaaataaccctgcttattcaactgatagttcaaaacgattgtccggttgcccgttacagtgatgtcttgtgctgctggcataatgtaatcaccattctgaactggcgcaatatgtaactgtttaccaatcacactcgtataagtcttcgcattcgcaatatccgtccactttggattcaactgcgttccttcgttcgcctggtacttcaccgtaatcgtagcagccttgcgataggtcattgacatggtttgatccaagttaacccgcttcgcatacttggcggctgaataagcttggtaccccttcacggttcccggcttaaccagtggcgtcgtgccaaccttaaccatcttcgtctgcgttgaaattaacttaccggtatcgaaatcgtagttcttgatggtcaatttacgataagttgccttgtagtaaattttgaaagtccgattactattcagcttataattaacgcgcttcgagccttgcaactgatagtatttgtacccattacctggctcaaaccaccacttttccgcagctggggacttcacatgccaatccgcaccaatcttctttttggtcgtggcatcgatgtgttgcaccgtcgccgtgaaatactttcctaaagcttcatcctttgaccgataaaaaatcgttgtgcctttaccttcgcctgctaacaatttcaatgtcgtaaagttaccgttcaaccctaaatacattgactggaatgataaattgccgacacctaaataatagccgtgctcaccggcgttccaaaatgccgtaaactttggattcaaattaaacgtatgagtccgcccgtaatctgtatatcccgtacccgtcacatgattctttgtcacgttaacatggtaccaacgcccattttggtgcgcataccaattaccttgatattgtgtcttgattgcatctgctgaaactgatgcattactttgcccaaaagcaattgcacccgccatcgtcaaacccatcatcgctaacttactcaaacgactcttcaaccttcttcatctcccataaaatatttaacttaaaaagtttacgcctatttttttgataagtggttagtaaaagttctaacacacaaaaatatttgttgcgaaagtgcaacaaaaaagcacgagcgaaccattctctcgtgctttttaaaactatttcaattcaaacaacgcccaattcttgggcttacccgccaacaattgatagccagtatcaatcaatcggtaatttttcaccaatggtgccttgttgtacgggtgaaccccgttcaaagcattccgcatatcaatcgccaatggctgattaccaggtacaaataccacaacatattggacacgtcgatgcgtcattgtatctgaaaatgaattatacatttcagggaactcatcatacgtcatgttcattaagtggaagtatcgcgtcactggatgagtatcggcagctaagaagaacccggaatctaatgaattaaccatcaagatacttgggtgctttgattttttatgcatatccgctgcaaaacgttcttgtacgctttgatcagtcggctgaccatggcgtgccaaaaatggctgatgggcatcgcgcggagttgccgttttaatataagaatttccataaaacggtatgacaaaaatgccaatcataaccaacaacataaccggtcgtaataattctttctgccaattaatcaaccaggcaaatagttggaataacgcaaccacaaagaatggcatcaacaataggacgtagtactctcgcacaaaatgcgttaagactaacatcgccaccgtaccgaaaaacatcataaacaacatgcttcgttggcgaccaatctttgtcagaaccaagccaactgctgtaatcgctgtaatgagccagtgttgattaatcggttccgcaaacaagcccagcgaattcaccaactgtgagatcatgccattttgattttcgccatacgccatcatattcattttgaaatatacatcaatcaacgattgcaaggcatggtgttggtaaaagacacccagcatcaccgccgatggcacaaggaagccaattaacgacagaccaactgccgtgagtaggccacgccaatttcgatcagctaataaaccaaagcctacgtataggaagaaaataatcaatgcacctatcatggcgtacttgacccaaaagacataaaacaaaccaaaaccggcaatcaggtacagccatgggcgcaattgcttgttttggcgttgccataagaacgctaaataaatgaagcccatgataaccgggaaggcaaactcttcgggagcgccacctaattcaaaggcgtgcgtacccaccatcacccctggtcctaacaagcccagtacgctagcaacgttcttattatcaaaataaaacgcagcgattttgcttgcaaagaagtacacgatcaaagcgttaatcacttcgataacaaacacgccgataaagctcgtctttgaaataaatgacgcgatagcaaacaaaccaaacatcaacggaccacgttgctcgacaatgtcgcgatacggcaccatccccgaagccaacgcccggcccattgaaaacattgcattcgtatccacccactgattggtacgatacagtggcgaagccgacatcgtcaccaatgccaagccaatcaccaacattatcatcaccacaatcagaatgatacgtccgatttttttagtcacgtttctcttctctcctgaataaaactaactctaaaattttgcactttcactgagatttagtcaactgattgtgacacttgggcaaaaatcgcactactattgcgcattaaaaaaactccggaagatcaatttccggagccttaacctattaaatttttacttaccacccaaataatagtagccgaatgcgccacccttaaatcctgttgatagatatgacaacggtacatatccagtaaccagctttgtttttgttattttataatgttcatcactagtctggaagatcacggttgtcttaaagtaaatcttgccatggaacttaattggcgccgctgtatgctcagtctgaattgtgccaccagtggcttgccaggtgccgtattgattcgactgatacttagcatgccaattaatcgacttctggccagccttaattttaatcgtgtcaattccgtatttaccatgttttgcggcaatcgtgacatgagtctttcgttgcgtttttaaattgttaataacatcgaattgaaccgatcggtcatcaaccgccattaagtacagatcatgcactggtgcctctggataataaaatgttgaaacaacattcggtccaaactctccagactttttcagacctgtgtaaccattttccgcataacccaatcgcttacccgccgttgtcgttactaacacgccatgttgcgaaccataatagatgattactgacgtaccggccttcaaagtaccgattcgcttgcctgccgcattggttagtacggtatttttaactggaaatgccttacgactaaccagcgtcaatttctggccagcttcgtacatgctcttgtggtacgtaccagtaaacaaactgccattacggaacagctttgatgcatagttaacggtagcaaaatgataacccgcatacttccggccagccttatagagtttattattcaagactcccgaaaacgcctcgccactcttgtagtacacgccattgcgcgtacccgtgaacaagtggccatccttgaacagtgctgtcacattttggaatttcgctgtatggtaacccgtgtagcgacgaccgttgtgatacagcacatcactcatcaccccggagaaaggcttacctgctttgtaataaattccgccacgagtaccagtcaacttcaacccatctttgtaggcaacgcctttcaaactacccgtgaacagcgtgcccatttcgtaatggcgaccgttcatatcaccagaaaacgaaacaccatttttgaaataattgccatcacggctcttaccggtcaacttaaccccgtttgcatagtaataaccgttgaagtacctaccgtccaccaaggcaccgtgttcgtcgtattgcttaccttcataaacaccttgcgacaattttccaccaacgtaatacttgccattcactaactgcttatttgcgacaatccctgcaacatacatcaattttttctgagtgccattaaatggcttaccatctgtaccgtatactactcctcggtatgtacccgctgctggcttatcgttcaaataatacacacccgccacgaccacattatttttgaccggtgcaacttttgttggcgtcgttgcagccggcttagacgatacggttgcagttgcacttaccgaactaaccgacgtatcttgcttggcggtcacttgctcagacgaactactctgactcgttgaagtagtctgtacacgatcacttgtcgatgctgactggctacttgttgtcacctgttcgctgaccgttgcactctcatcagctgacgtaaccggtactacagcgattagcccagctaaaacacttactgcaatcaaccacgattgctttttcataactcattacctctctcttgtggctaactaaaaatacaacaaaacagtatagtcctatttttcatttccgtggtgaaatatcccttatatacgacaaaacggcatcgccgcaaaattggatgccgttttgtttgctatttaaatttagcttggtcctaattgataaaaattggttaactagttatcccaataagccgtccctggtattggatgaccgttttcatcataatcaaattgcagatccgttacaggctgcatgaaccgacgcggatcatcacctgggtttgcactcccaccatcaaagcaacggagatagaaggtgttatcatcactaaaatttaaggcttgaccgtcaattgtttgttcaccttgcaatgcccgaccatccttaccggtatagtaagcgaagccccacgcaaagtgccaaccattgtccgcgcgtacaccattttcaaaccagtagtacgtgcccatataatgacggaagccactgaacatctgaccattatttacccagcgccaacctgaatcttgacggacgccattaatgaaccagtagtacgttcccatgtaatgacggaaacctgtataacgttgaccattttcgaaccacagccattgaccatccgcattaagataacctgatttgtgttgcttttgaatggctttgacagtatcagcgtggacagcctctgaattaacggcaaaggcagtcgcactaatcactgctactaacattaaaagtgctaattttaattttttcatgacttactcccgattaaaagaacagttgttcatttatccaaccacgcgacgcacgatattatctgaaatatttcgccaagaatccttgtacactaagttccaacgatcgacaacatcatctagattagatacgccaacaccacccgttggtgaattgggagaatcgtgcaagaaatacccgccaccgaggtagataccaacgtggtcaacgttatccatgaagaagatatccccacgcttaatgttgttccaattaattccccggcctaaattcacttctgagtacgtaacggccgtacgataatctcctagctcaacgcctgcacttgcatatgcccagtgcacaaatgatgagcaatcaaattgacgtagcgcaattgattgcggtgtgcggccaccaccccagttatacggtgacttaccaataatggttgaaccggtcgcaatcgccgtttcaatttgggcattacctgatgtcacgacgccatttttatcggcccagtaacggttaccattttcataaacgtactggttcgttgctttctcgtacgtccccggcttgaagtagtacaactgaccataccaatacttgtaaccactaaaaaccttaccatccccaccaaacatgtaccatgtgccccaacgcaacttatcatacgtgttcttgtgcatcaaatacgttttgtgatcgaaatagtagtaggtaccattcattttaacaacgtcagtgccgatttttccgtcagccccaaagaagtagtagttgccccattgtgacttaacgtacttgttcttgaccatcgccccactgtttaaattaaacatgtagtacgtgccattgaccttttggacacccttttgcttagtcccgttatggaacagatacgttgtctgaccaaccgtcatcttaccgttggcttttcggcccttcgcgtagtatgtcgcaccaacataccccgtcttcacaccgccgttcttatacaacacgcccttgtatgaacccgagaatttttgaccatttcggtaaatcttaccgcccatttgcccattaaatttcttgccaccggtatagtagcgctttgcttgccagccattaaatgcctggccatttttatagaggcgaccagccagcgtgcggttcgccaatttcccatgatcatacattttaccggccttcatcccactgaacacgatgccgtttttatatagtgtgcctttaactgtcgtgttagctagcttacccgctacataagtcttcttattggtgggattttgccctgtaaacgcaacgccgtttttatagagcaccccattcactgttgcattcgctaatttaccagccacataggttttcttgctctgcttatcaacgccattcagcacgataccgttttggtagcgcacgccttgcacacttgtattggccaacttaccggcgacgtacattttcttgttcgttttattcacacctgaaaatgccagcccattttgatacaagacaccgtttaccgtcgtgtttgccggcacgcctttgacataagtcttgttagttttactatcaaagccggtcaccggcttaccatcttgaccgtacagcacattttgaaataacccagcggacggtttgccatcagtgtaatgaacaccgttgtcaacaccattcaatccactctgattggctggggctggttgtgccacaatagcttgatctgatgcaggctgttgtgcatcagctgaagtactagcagctacttcagccaatgcatacgccttatttttcgtaccatctggtttaacttcatctgtcactttcacagcgtcagatggcacttgcgcgttactagcatcacttgacttaacgcttacggatgacgtgactgatgaactggcatctgctacaacacttgaactgacgatagacgccgatgtagacgtagatgcactcgccacgctactcgtgccaaccaagttacttgattcagatgtgatagtcagggtcgaactgctggccaccgatacggattcactcacgacactagccgatgtggccacactgtcgccttcactactggccatcacattcgtatactcatcttggctgatcgttgccaccgaagcaactggtgtttgactaattgacgtgaccgcttctgcttcaacttgctcagtcgtaacagctggcacgacatcaccatcggccgaagcaacggtagttaatccagctgtcatgccaaaaaaggcaatccccgcaaccacccaatgtttaccggacttatacaactttttacgtaatttcgctttctgctcactcataattcctactcgtctctctatttcttgttcttattaattgtaaacgaatttcaaaccaaaagggccagcgtccaagataccagacaccagcccttttactactatttatggtaaccaatttccataacggcgattgtcgtgccgttagctgtcttggcatagccaaaaccaaccttgtttgccaatggcgacacttcagttaagtagtggccatagccttgtgacccatcctgtaactcacttgcccacatgctaattgggttttgcgtgctacctgaccaactagccagtgcttcaggtccattaatgtaacttcccattacataatctggtgatgcgaataagccaccatcaacctgatcgccattcaccgcccaagttggcgcaccattcttcatgttcgtgtgtgaaattgacccctgcgcagccaattcttcagcacgcgtttgcgcccactttgttaactcagcatcctgcgttaatgcagcaagtgacttaccttcatcgctgccaacatcattcttatttgccaccatatcagccgtcaatggcgtacgttccttcgcacgcaatgcattcaaatcattcaaccattggctagtaacagctgaactgtcggatgcacttgaagaagcgactgaacttgatgacgtcactgatgaactagccactgagcttgaagatacacttgaagacgtcactgaacttgaagataccgcagacgaactacttgatggcttcacactagcactcgacgctactgatgaacttgctacactgctgtggctagatgacacattatattgtgactcccaagctgcctgacttgatgtaacgtagctactgtacgctgactgtgtctttttggcttggttagaagctgatgatgccaacgacttaaactgtgaacgctgggttgccgtgtatgacatgtacgaatttgtcgccgcatcagacataactgacgcgaagcccgtttcagcttcaatttcagctcgataagcatctgacttcgttgcaccataccacaagtacccttgtgaaccggcacttgcgactgtagtaattgtattatttgtctgccctataccacctcgtgaataaaccccgttactagttggcaacttaacgtctaccttcttatacagaccattcgtcgttggcaaatagataatatccatcgtcgaagcgcccttggtatagttgaagtaaacagtattcttctgcgtactcaaatctaactggttattatacttcacaacagtaaagtatcctgccttcgctggtatcgtgaagttaagccgatctgcataatacagtgacttcttcacatctgcaccagccgacttgccatttgcatacatgtatcgaatcgttaccgggtactttttcgcgttggctaataatgactttaccttgctgacagcagtggttgtctgcgtcttcgaagcgctaattgcttttgtatagcttgaaatattttgtccattctttttagccattgaaaccgcataggtatagtctgtgtttttaccagtcaaactattcgcatatgacgtatagctatctgcccaagcaccataacttgcagggtgctcaccgttcttcacagcgctcgaaacatacgacaccattgaagtagctgccttcgcatagctagccgcttgtgactgcatatacgacatggttgtattaaccgattcttttgcaactgttttggaagttttcaataccagcttggaacttggtaccaatgcgtacttataaacattccccgttttgtatgtcaaaccataatatgcctctaattgccattttcctttagcaattggcgtgtagtactttccaactgcattcgcataaacagctggcgacttcccgtatacataagaatatgaccgataagttttaccagcaaaaccagttagtttacttgcaacaccaccattgtatgaattataaattgtcgcattcttggcactagctttaacagtcagcgtgctttcgttcaaacgccattgaccactgcgatctgttgcatcgtagtatgcgccttgcttgtaagccaatgcactaagcgtcttaatatttggcttcgtggtagtcatttgaccattgataacgactaacttgccgttatatccctttgtaacaccgcgatacacagctaccttcttgccagccaccgttacataaccacgttgaacatacactttgtggccatttgcatctgttcgtgatgcgacattgctaaaggtcacattaatatatttacttcctgtggtcttgtatgtcttttgattatagatcgacaaatacatccgactaccagcgtattggaaagtgtcatacttaccgtcctgttgcaatgacacgctagtattacctactgtccaatgtgtgttcgggaaaatcatcggtccaaccgaagcatcagcgctctgtgggacagccaacaaggcaccacctgctaccaaagctgccgcaacccacatcttgccggacttatacaactttttgtgaactttaacttgatcacccatattaaaactcctcttacttgttataacctactcgtgatacgtgatgattttagcaaagtaacccgctaattcaggatttcgtcttaaaattgagtaattcagcatagttttcgacaaaaagtaagtaaaaatcgcaaaagtatgcctgttcagctcattattgggaataatcttgctttccggataaaaaaatagcgtgaccacgatgttaaacatcacggacacgctatctgacaatttaattcatttttcgtattacacccgatttgacacatatctaagactcctgcttctctttagcaaaataattataaacctcgctccgtaaaggatcgccagaccacacgatttgttcgccatgttcacgtagaaacgatgcgaaagttcgaccaaaaacaacaatcgtttgcgcatcattttcgttatcgttaacattgttagccgtggcttttactgccatgggccaagttcgaaaacgttcaggtacttttgaatgcaattcgtgttgatgaatatcagcgtgatatagctccagttcattggctaagtactccacactatgttcctctgcaatcagatgtccaacttgaaccacatgttcaaaatacgccgtccaaaaatcgccaatttcatttttaataaatcgttgaatggctgtattcgcaaccgcggtccaatatggattaaactcctcttgaccatgggacgatgttgtatagattcccgttaacatgcgtaccggtccttcagtgagggttaatgataaccccacaaaccatcgaaacgactcacctgagcgtaaaacaatggtatcaacaccaattttagggccataactgccaatccgaaacgacattttaaaattttgatagccttccgctagcaagtcctgtacaacggctaccgctttatcaatgatcatttttgctcctattctatttccagcaagagacatacccttgttattctacatcatcattattgcgacataaaaacattccaaaaagcgtccgatttacaggatacaaaaaaacactttgtgcgccgcatacaatcgatcacaaagtgcttttcaaggactagtcgccccaactatctgccatggcattgaaagcgtattgcaataccattgccgtcaacattttttctaactgtttctctgttttaacgttcttggcggctggcatcgtcaccgtttgacctgcttgtcgcgtaccaacaactgtggctcggacataatttgcttgatccgaagtagcacgcaaagacaatttatgggcatccttcgcgacagtgacgattacttccggctttttcatgtcattgatttcatcacggagtttgtcccaaccgtcagcctttaactgtttagcagtttccgtctgaccaacaactgtcaccaaacgcttcaagtctgcccgattgagtttaacttgataaccagcaccaacttcgctgaacttttgcccatctaagtcggtaaaccacttggcaatttgcttagcatcagtctgaacttgttccggttcaacttttgcatagcctttgtcatctgccttcatccacacattttggagtgttgttgaaaaatcaggcacgtccttgacatcggccgattggaacatatcactcaagaagcctgctgacacataggtcgttttgccattcttcttaatgtcatatgttaatttgttatcgtcatcagcgacggtggttgttaacatcactttttgacgatccttggcatctaatttcgccaatccgttaatccgatactgactgttgcctggcgtcgatgcggtatattgataacgattatcgtctgatttgaccatcgccaataaatgcgtcccaaattgggcctttggcgtgtgcaatacggcataaccaacaccgccagccacgacaaccgctgctgcgacgcccccaacaattactttcttattcatccccgtcaccttcctttgcttccagtgtatcatagccacgcacagaaaaaccgtggccaacattgaccacggttatcagaagctaatagcccatattcacttgccattctagctgtgttcgatactctccaggttgatttgtgctgccatcaacatgcaagcgcaaaccttcattttgttgccaaaccacgtctgtcagggtttgaccatctgtcgtctttgcaatctcaacgccttgggttaccgcatctgctgcactaccgtgatagaacaaaagatgtgctggtaactgggcggtgctattatcaatttctcggaaaggttccaccgctttcaccgttaccgacactggcgtcttcgttcgccgttcatcagaaatctttacaaccgcatttggtgccgttgtctcagcagtccggtcaagcaccatccctgcttgcaacgttggatgcgcaccaaagttaatatcctgcggcgtaaacgaaatcgtatcgtctgccacaaccatcgtcaatggatccccggtcgcagtatacgcgctctggtcagtatcattgccgacgattttcggagtggtcgtataccgatcgaacgtcactttcttcggtaatgtcaaattcactttaattgccagtgtgtcgccacttatcaaatcaatatcagtgatgccgatttgctgaccattagccgttgctttgttctcataccatcccgccggaattggcatatcattcaccaccagtgaattaattgtcgcatccttgggtacatcgaacgttaatttaccgcccgtaaactttgattgtgccgcggtgttggcaacggtaatcgtataatcaattttgtcgccaccggcaacatcatcaacctccgtctgcgtcgcattatgactgtctggataagtctcatcaacaatctgatcggtcatcgttaacttaaccggctttgtgaattcggtcttcttaacattcaccctgacatcatttgacggcaaagtcaccgggttcacataataattcgatcccgtcgcttcagctgtgttgattagcgtcgtatcctcatttttatcaacgcggaccttaaccgtcttcgtcacggtaccatccaccccgacatccccgaccggtatcttaatcgtctggctaccatcctccgcaagcagcccttccggtaaggcgtctttaattgagacatcctgccaagtgttaccgatgccgttaaccttactattggctactgtgaacttgaattctaactcatcaccagcttccgcgtcggtataatctgtatatgccgtttcacccttcgttaggttacggacttgcttttcaagcgttggttgctgaatcacttgggtataagccaccgctccaagcatctgctcggcaccagtggaccccgtgaagccccaatacacatcggaattaccgaaacgagacagtggcaccgtgtggtcaccaacttctgcaccgtcaaattccgtagaaatggtgcctgtctggtcagttaagttgggctgccaggtcacaataacttggtgccactttttgtcatccaaattcgtgtgaaagaagttataatgcttcaattttagatggggggcaaactcccattgaaacggcaccgactcatctgggtgaatgtatgccaagtggtcaccgttagcttgcgtatattgattgttgtaatccgtatcactatagtcataatttaaatacgtatcaaattctaagctcaaggcatttttaatataaccaccgtaactattatgttcatcgcgcacatttccgtacgccccaagtgcctcacctgcaaaacctttcgcatttggaccttggccttgcaaagtgaacgttagcccgtctgctgttccatccatataaatataaaactttgtttggaacggccgcttaatattaaccggattcttgtaccacatcgtttccatgacactagctgtgccatcagaaactgtttgcatattacggtaattcggattttgctttggcgtgtaaccattaatataaaaattcccctcaacttgtggaccgctttcggggggcgctggaattgtcccacctgaatttgcggacaccacgttacttccaccaacaatggccgccaaaagcgtcgccattaccaggaagatgcgttttgtattccccattatgccatccccttacatcatttatttttcgatcgcgtgagccaaacaattacaaccgccatcagcccagctataccagataatatgagcacaataaacaggaatgctagactatgatggttcttttgtttgtgagtcacaattgttggatgcggaatcgtcgttgttttgaccgtgtcgtctgtctgtgtgtgcaatgtcaccgttactttctgtggcttaattgcttgcccctgatctggcacaaaaatagtcgtctgcccataggcaagaaagctgactgtctttctttgagaaacctggtgtttagcaccaccagttaataccaccttagttgccacatgctgcacgattttgggggcctcgattctgaagcacaatgttataacctaacttgccatactgactagcccgttgtacccgttgcacggtcaaatacttaacgtgcgtcgtctcaatcgtttggttagccagcaagacactcgttacgaacgagacatcatttcggagtaggccagtatctgcctgatcatattcagtcaccttcaagcccccgaaatacgttgtcgtcgtggtacgtctaggcgtacgtaattgaaaatgaacatgacgctcttcatttggtttcaagaccacgctttgtttcgtttgatgactaaactggcggatgccaacctttgtctgcgtcgtttgatacctataagtaccattgtcccccaccgttgcatctaacaattgcgcatctaatttatgcgtttgacttgtcaaattttgcaaatcaacagcaacatcgtaggttgtttcaggttgatattgaaaggcaaaaactgtcttatcatcagctacctgtaagtcgtgtcgtggtgcaatatggatgcttgtataacggcctttcagcgtggccgcatccacaatctgcggcccgttattattagtggcaaatatgcaacttaccccgacacaccagaaaattttccatgctgatcgtctcatcagttactcccgctgcatctacgcatattttgaatttttttacgttcaattttggttagttcctcttttaaatgactgacctcatccttagttggcaacgtccgccacacaacccccttcacatcctgtcgcaaaaccacatttgaaatataaaaatctgtccgtttcacaaattgattggtgacatgaatataaaggccaggtagattcattaaaatttgggcaatgtacttttgaagcgccggtaaatcagccatatccaacgttaccgtaaccactggcaatgtttcactaacctcaaaattcataatcgttgctgtcagatactccgtcaaaattttgtcgaacaaattatcgcaatcgataaaaacggtttgtagttcaagtgcgacggtagtgacgaattgataatgaataggaaattctttggcgtattgctgcttattaattggttgtccaatcccacttgtaccgaaatacaataagcgaaagtgcaacggaaacaggactttttcaagattttcaagaatgctgggttggatagctcgatgaaaagttttgacataagcatttgcaatcgcgagttgaatgtcatcgaatttcgccgtcattgctggtgttaaatcttcagctgagtgatcaatttcgccaaatgcataaatcgcggccagcaccgaccttagctccatggttttaatcgccggtttggccggaaacatcggtgcaataatgttatccagcaagcgcagtcgcttctgcatcatcgacgataacatggcttccggcttcagcggatcctgaatattctcagtcaggtaatgtccatgactgacccggacacaccataccgcataggcgtaacgaatggcatgtttcatcgtcagttgtgtattggcggtgcgtcgcaatattaattccacttgaatcgctttctgacgcactaggctgttgaatggaaattggtcatcaacatagctggtataaaaaatattaaagaaaaataatcgaattgtccgttcattaccgacaatcttgtaatccttgctaattgataacccaatggtttccaacttccgatttaagtcatttttcatttgccgaatcgtgttcttactggacgcataccgttgggcgattccctcattcgaggtgactcgttcaaagaaaatgtcgatcaaaatactcaccgctaacgaccgtttaaacaaatacgccattaaatctgtatactgcaccttttgcaaattcgcgatattaagaatattgccttctgacagcaacacgccactataaagcgccgtcatactatgataaatatcactgacatccgttaagacccgattaaccatatacggcgtccaacctgtctggctcatgacatcatttaaaccaatatacgtgttgtcagctttccaaataattttgaacagctgcaacggttgctgtagttgtttctctaaaacccactccttgtcatccccgaaagtttattacatataaatatctatatattcgattaatatgttaaaactaatgcgaaatttaattacacggtgtttttcacggaataaaaaattttaattttcatctaaatgcttgtcttgccaaattgtgtaaccgagccagccagtaacacctaatagtatgccacccaatatcgtgacccatttctgcggatttaacccggtatcaggcaactgatcctcagccacaaccactattggtgccgagtcttcttcatcagcagtctcactaatgtcattcgccgattgcgctggtttttgacgactaccattctccgttgtcgcctgatcagcttgatcatgatggtgtgccggctcactgagtggtttgaccgcaactgtcgcatccgaatgctgataggtttccgagaatacataatggttacacataaaaaccgttaaaatcgacaacccaattagaaaaagaatgatcattcctttattcttcatagctaatcttccttcgttagttgacgcgcaaatcttttctcttgttctcgcttcagccgcttataaataatgaccgcaatcataatgatcaacaacagtaccaaaataccgataatcacatatgatagccatggattatagtgttgattcataacgaaagacccggccacgccaaccttaaagtttttgtcaaattgccaatgttgcccatttgcggccgtaatcgttgcgtggtaatgatagctgccgggtttgattttgtgtacatgccaattattagcgtagttaaacgctgaatttggtgcgacactcataccagtatcagctgtctttcccatcacttgaccagtttgtcgattagtaattttggcatgcagggtcatatcactaatgatggccggtttatcatttttatagacggtcttaatcttaatgtcattgccaacgattttaggttgtatcttacccagcgttaacttcggcacagctgtctgatcagactccttcaagacaacgcccatggcataggcaaacttatttttaactgagacccctttctttgcaaagggtgatgcttggtcatcactcttcaccagtaccccaccgacaacaatcccatcgaaggccttaccgggcaccttgattggcatctcgaccatggtaatttcaccagccggtacagtcacgacctgtttccgatcacgtttcgcgaccagcctgcgaaaatccacctggcgagacttatttttaggtaccgtcacatgatccaatgccatcgttccagcatcgttggtgtaggccgtagtcggttgcacaatcagtttttgggtctcgtgagaaagattcgcaatctttagttttagcgtttccgcctggcctggttgcactttcaagtcaaaaatgccgtttgcggtaatttgattgtcgggatataccggcgaaataccaatattcgatgttgccgccgcgctgactgggccgccgcttagtgctactgtcactaatccggcaccaatcacactcccaaaaaagtgcttaccaatcttcatttttcattcctctcaacgaaaaaggagccccttgcaaggctccaaaaacagtatcgtttttagtttactgatgcatcaggagtcgcattcaacgtccacgtaattggtgctgagtacttaccttctggcacattagcgcccatatctagggcagcgtctttagccttgctgtaataaactgttgtgctaccgtagcccgtaccttgtgctgattgcatcactcggtgttgtgtgttgtcgcctgacatcaacttaggttggtaaatcgctggcatgtgaccatctgtgttctttccactagtttggttcaagtgaattgcccaatcctttgaagaagttaacgtggcaccatcagttgatgaaaaatcacccaatgtggccgtcaattgccaaggcatcgtcgttgtttcggcagccattggcgtcttattatcatcgtttgacgctgcagccgtacgtgaatcagtcacctttaacaagcctgaatcgttaccattgtcgtcaatcaaaccggcgttattaatcaaaggcaagttttcgttagctgtctttgtttgtgcggccatcccaaaattcatgtctggcacagcatctagagtcaagtaaccttgctcaacttgcacaatcgcatctgaaacccctgatacagacccgcttgcgctgttttctgttgtgctagttgctgcaggcaacgttacgttgtcagcactaactgccattgctggcatcccaatccccaccatcgttgccaacacggcaacactacttagaagtgacttcgtcttcattactcatacctcatgaaaaatattttattttcacatccctgtgaacatttactattattaggtagttcaaccttatgagcggtcaaaacattttgctatttcaaaatttaaggttcaccggcaacacactgagcagaaaaaaataagtttcccctttttaaacggctctatactttctggtgttggtggaagaaattccatcaacacctttttgtgtttaattcttaattgcaaaaagaaaaacaccagtttcctgatgtagactaaagtcgccaaaccaaatctaaaggaactgatgcatatgaataatactatcttacgttacgtcggattaacagacccaaattttaaatttatcgtgaactctgacggtgaatataaccgttatgagcatcgtggcagggatcaccacaaagcgttgattacacataccactctcgagagtgacatcatgcgttgccctgactgtggtttcttagagcacgtcactaagtacggctataccgatgacatcgagatttaactgccaactacgaacggctatgacaatcgactcatcgtgaagaagcaacgattccactgcgataactgcaatacgaagttcaatgcgaagtcacacgatttactcgacaattctaaattttctcgtccgttggtgaatcagattatcgcgatgtcacaagatgatatctctcaaaaatcaattgcgcgtgcattgcgtgtatcgacgagcagcgtccatagagttatcaactcagatcaaacatactattacgatttccagcgccaattgccttcggtcttatgctttgatgaagtccgcacttcagcgcacaacatgtcctttgtgtacgccgacggcgaagcacatcagttaattgagattcttcctgaccgcctatctaagaacatcaaagaacactttttaggctactctcttcagaatcgtcgacaagtcgaatatgtcatcatcgatttaaatgcgaactatggccaatttgtccgtggtttatttcctaatgccaaaattattatcgatcgcttttacatcgttcagcgcgtagcgcaagctctcacgggacaacgcgtggctgaccagcgcagcattgaggataagcggtattctcgcgaatacgccatcatgaagagtcagtggcgtttgtttatgaagtcatacgacaagctgaacaaaaacactcgtgtctatttagctggcgtaaaagaattgatgactgaagaagaagcattggaccttgttttccgatcattcccaacacttcacgcaacttggctcacataccaggccgttttagaagcgatgcacgagcaaaatatacaaaaattctctgatattcttgtcggctattcaccactgagaaacgccatggacactgcaatatcaacattcagcaagaatttagccggtgtgttggaaagtctgcggtccccttggtcaagcggtgtcatcgaaggtatcaatcgtaaaatcaagcaaatcagccgcactgcctatggttaccgcaatcaactcaacttcttccgtcgcatccgcacgcaattggttcacccaagaatcattcccgcttaaaaagaaaaaaacctggattgtgtaggcgactggctattgccaatcacccacacaatccaggttataaaaactcaataatcaacgattttagtcagaattttcttcgaccaacaccatttgacaaagagccttttaaacgccacaataaaaccctcagtatgacagtttcatcacactgagggtttctctcactcttaaccactactactcactttgttaaccaggtcttatcatgaagcacccaattacctgcttcatcatattgataaaatcttaaaaccaccgtcgcatgtgccaaatgccaggtttgtgttcgacgggaaatcgtatttgatcggcccattttaatgcgctcatctttcaccaaatccggttgaacaattgttgctgcaatattgtcatactgctcatcaaacgctgcatcccaatccagcgtttgaaggccatcaaaatcttgtttcgtccattgtcgatgtcctgtgctggtatgcatcgtgcgagcttgcggattaattgaaaagccgccgccctgaccaatgattagcacggttccccagacaactacaatcacaccaagcaaagaccccatccaaattaacacctttttcatgtcacactacctcaatcaatgttcatcaagatgtatgaccgtgttggtccttcactaacttctaatttttccaacataacatgcgccccaattagttcggggtgaacacgtaatcgttgaaaaatttcggtcgcaaaattttcaacggtcggattaatctgatcgaatggtgggacatcatttaaaacctggccgtcgtattgcgccagaaaggtaccaatcttcttttcatagtctgtaaagggcacctcttcatccgttaagcaagaaaagtcactcacgatttcccaggtatgcgggtgcaccgcgccatcatgaccttgccaacgaataaagtggtacgcattgatatagaattttaatcgataacgtgcttcaatcatttcgtttcctttccgaaaaacaaccaaacgctttgctgtccaagtcgattcaatgcctgccacgcaatatcagcggtgctccctgccaacaaaaagaacagtggcaaaaattgaatcacataccggctgcggccaccctcgaataagagcaaatacataaatgcgccaatcagcccgagttgcagtaatcgttgccaatcggtctggcgtcgcaacccaacgcagattattaacagtaaaaacaaccaccaaatttgcgccaaaaattgaaaatcttttagatgacgcccgcttggcgtcaaccatgccgcaacaccgcgccaaggctgtacatcattcgggtttgcaaaaaaatgaccctctcgcaaccaggcgaacgaaccgtcagcggtatttaacccttgcttacgaactaagaatgctacataccctaaaaccccacgttggcgcaaacgcttcaacaactgtgccttcgaataagcgactttatcagttcgcttgggtagtgtggccatttttaatgcatcccgttcattgtaaccaccatccccagcaacacccatactcataaaatgaatcggtggaattgccaagcctttattaacccgaatgattgtttgctgatcaatttggtgttggccccactgtacagttcccacaacggttgcaacgcagacaattgccaacaatagcccttgtcccatttttcgccaatcacgccaaagttgcgtttgaacaattcttcgcataatcattaagaccactgcaatcgctggtatcatagctgatggtttgatgaaataagctaacacacccgccaagaccagcgcaagggcccagatagcccgcaaagaccaacggcgactatttaataacccagccgctgctaatagcaaaagggccaccactggcatcacaaccgtgtcggtgtatgggactaaaatccatgggaagacagtcataaatactgtttctaaccagagtagccgtcgccaattatcgcgttgcaccagtgtcatcgtgccgacgttgatcagtaaagcgagatcgacacatacaatgctcacgacatcaaagaagaaccaactcttcgtgtgaaataagccggctagtgaatcaaaaagcatcaagattggcaaattgttaatgttctgactaaaataaccgatcaagttaatgtcatctgcatgacgtaatgcatcgtgaaccgcaccagcatcgaacccaattgctggatgaaactgatacgcaacaacggcttggccgacaatcgccgcaataaacaggctccagctgacaaccaactggcgcgcacccggtgagagccacaaattagtttgcgtcagcacgtatgacccgcccccgatcagcaatacacccactgaccaaagcgtgacatccgttaatttcaaattgacagataaccccgctgaaatgacagtaatcccaaataataggctgaatagcaccaggacactccgatcaacgccagttaaaattttttgtctcatgatttctcccgttttaacgtcgcccgtaactttcgcgcatccgcggcgaccagctgacgaaactttgccagttcatcacttaagccccgtccctgccattttcgttcagtcggcctatttaacaaagcaaacaacaacacccacgacaacacaaacttataggcgggcatcagtaacgtgatgtaccaggttttcacatacatgcgataagcaggtcggaaaggctttaaatacacctgtgccaacaagaaaaacaaaccgctgacaaacacgtacaacccgtacatggccaggtaaatcaagcccagcatctgccaggagaatcctttcgcaaccaatacgagtggcgcaaaaaaccaaattaggcgtggaaacaaaaatgtatggtcaactaataaacggcgaatcataaaattgctaagtaagtggcgcattgagagcatcgcttgcttctcaaaaatgtgcacaacttccatttccccaatttgccaccgctgacgttgccgatacaacgtattaaaatcagtgattggttcaacgtagaaaatggcattacgggctaatttgacttggcctttggcacgcatttgaaaggtcatatgtgtatcttcaccaactgtctcactactgaacataaaggtgtctgctagctgggcacgtcggaagcctgagaaggcccctgacatggtgaacatgttattggcaccagcttcggcgttccggccaaccaaaaaggctgctgcatactcgtggtactctagcaattgcagcagccgcaaccgccatgattgggcgatttgactgatttgcgtcaaaataatccccgtcaacgcaactgtttgtggttctgcctcgaattgttgcaccatattcagcaacgcattttcatcgagcaaaccatcactgtcaatatgcacaaaatatttattagatgtattgtaaagggccatattaagggcgttcgattttccctgggcagcctccaaccagttgatacgcgctgtcggaaattcatgttggagcttttgaaagatttgaaagctctgatccgtactttcgttattcaccaacgtaatcatgattttttcaagtggatacgtcccggtgatgactgaggtcacacactgggccaacgtatctgcggaattatacacgggaattacaacgtcaatcatgggcaaaaaagcctgattagttagttggcttcgacgatgaaaatgtcgctttaaccagttgatgacaattttaaaactcagcttgacataaactgcaaaaatgggaatcacttccactaaaatcggcaataacagccatacgccaataaatagaaactggtttgcaatcgctgttaacaaacctcgcatcaagcacctccagtcttgaaatcaaatcggccaattttaatatgtagcacttgcgaacgggtaaacacataaaaataaaggatgatggtcaatacataaaatattaaacgcccaacaattacatgcgcccaaatcaatgatggcaatcctaagaaatgaataatcaaggcagttactgtcaagcgcaacatattcgccagtaacaaataaatcaccccgaaccctaacaactttaagcgctgttgcaaatttttaaagaaaggaaaaaacagtacaagcgcgatgtaagctgctaattcgattagtgctgaacattcgtaggtgatgaaaagattaatagcactttgaccgctcacaatgtgaataatacctaacgtcggcgcgacggtgtaaaaaccagttaacatgccaacaacgcccgccccgcttgtattgagacgcattaaaaaactaatgacgttattattcgccaacgaaataatgataaaaaatgttcccacaacacctagcaccacgtatgctgccgaccagccaattcttttgaggacacttagcacataaagccacgcacccccgaatagtactattaaccaaaacatatgacttaccttctatgtgattggaaaattagaattccaagcactaacacaattacaccgccgagcgctgccgcaaccattggtgcagttgatgcccccgatacaactaccgattgatcacctaaattcgcatttgttaatttaatatcaccaactaacgccgggttactcaccatatccgcaattggtatttcaatcatcaaaatctgggtcgtattattattaggtgcgtcacggaccacaattttaccagtcacttggttcgtgctgttggtattggcgttatataaattaaacgttactgaagcagattcgcccagctttgttggggctgaattaccaggcgccatatccatgtaaacatcctgattcgccaattggaaatggtaccccgaaccttggaaaccatacccttgcccggtaccctttggattcatattcaacacgagcgcgattttatcgtcatccatgaccataccccattgatgaacattaaattcatcatatgaaaagcgcaactcgcttaatggaatactatcaaaatcaacggttgcatatgcctgttggttaatcccaacccccaaccaaattagcacggctgatattgccattaatagccacttcttaatcattaatctctcctaccttttttcggttgattaacggtcaacctgtctttcccttgtcgctttgattcatacaaactttgatcagcccgtttcaaaacatcgtcaacgttcgcatcagttggacacattgatgccaccccaacggaaatagtaaccgtcaaataatggtttccaaactcaaaactattatcgcgaatcacctccattaccgttgctaagtgctccgctgcaacgtcggctgttaccccgcgaaaaacaattacgaactcttcccccccatagcggaaaacctgtccgtcagcatttcgctgttgcaacgtatcgttcaccagatttgcaacgcgggttagcacataatcgcccatatcatgaccgtacgtgtcattaaattgtttgaacgaatcaatgtcgaacattcccaatgtcaacggcaactgcttaactcggaaataaggcaccacttcattcagcaccttatccaacaaacgacgatttttcatattcgttaacggatctgtatttacttcaatttcgtaattgttaaagcgggtcaccaactcgcgcacaaagacgttaccgtaatgcacaattgtcattaaaatcatgaactttaagacaaacgcaagtgcaaatccatgtggcatatcgcggcgtactgctaaaacgattaaccaagctgccgcactaaacacaaatgtcgcaacttcatattcaacaaacgtgtcaatgatgcggtggcgatttttactcagataataactcacacacaaaaatataattgtgccgatgattaacaaaccaattcgaacattaaaatgactcgatactaataacaccgcatcgaataacaacgtgctaatcgtaattggaataatcgtataacgttgggtatcaatcatgacaaaataaaatatgatgattaaaatcaacgagacatcattcacgtagggattaatcaccactacgtcctgtaaatcattaaacacaattttggcaatcactaaccaggccacgaaattcaaggtatacgtaaccagatacattgtttggttattcataaaacgtcgttgcaaaccaaattgcatgataaaaatgacgccaataatcgaaggtaaacatagtaatttggcaatcatatgctcaccaataaattcgtaaattaacgtttccaaatgctcagtccctccgaattagaatgtaatcggttcaacgtttaccggacttgagtaatagaaagattgttgccgccatgacgttggcaaatcttttatcaaatcactatcttcaactccttcaataacgacctctaaggccatatcatcgatggctgtcacaatcaaattaataatgtcgatgatggtatcgatcggtaagaaacgcttgagatgcaagacagaaatcttaattcgactaatcaggtgtggcacctcaaacaaaccagccaacgaattgacgcccgctaagaaatcgtcaagcaccaactgatagccaagcgcggataatcgttctagctgtactttgggtaagaattcgtcgtatgcattcgtccgattcagcggtaaccgttctgtgagttcaagctttaatcgtgaccgcagcgctggatcaatctgttcaaatagcgtaaaggtttcctcataaaacaattcctgataatccaaattaaatgaaaatgtatagttgggattatgactcaaaacctttggcagaatgactgcaagctctgtaacatattgcttatgctggtcatgatctgtcatcgttgtgataaattcttgataaggaaatcttgccaccccatcaatatcgcggcgcatcaatagctcatattctttacttgtctttccttccaaggcaataatttgctgtccttggaaatataacttactttgtactttgtcagtcatacatgactcctttattgttgtcattcaagtatgcctgtatttcggaatactaaccggctcatttttacgttagccttgttgcgaactcgcaacttggtttttcgaaaaaaatagtcagccccttaaacgtacaaaaggcagtcacctcgctgtgtgactgccaatttacccggtatttatatttactattaactcgtcgccacatcacgtgcctgcaagtcagtggttaatcgttgcaattgcgcggttagcgccggtactatgacggccgtcttcagccgcatatatgacacaagcagcggtaagatttcagcaggtacccgcggattcaaatccgttaattgggcaattttgtctagccgatattggactgttcgccgatgaacatgcaaggtgtcacttaattcactcattgaatgacctaacgtgccgtacagccacaaggtaacctggacttcctcatcgacccgatcctttaagaattgttcgacctgcggataggcgacaccagcttccacaacttgcgccaaatcaactacgtcttcgtaaaagacaattttcatttcctcaattaccggactggttaatgctaacgcaaacaccgcctctttgatgctttttgttaaatcaaggtgtggccgactaacccccgctaaggcatgttccggcaacgttgccaaaaattcatgtacccccgtcaacggaaaaatataaacccgtcgtaagtgatccaagtcaaaagctaagcgctgatttggcaaatgattgcggttcccctcgaccacaattgccacatattgttcactaaaatccacaccgtacgcccgtgctttctgaacaaaccgatcatcaacagtgtaatcataatctgacatgattaaccattgttgtataaatgtctcaagcatagttgtgccctccatagattttctttgacctgtcactgcttaccattaagtctacattgttaacaaaaattaagctgactaaaaattaagcgcttacatgaaaatcagtttgttgggtggctggcagtcgtatcatcgctacaccaattccctgacaacggcggccaagatagtctatcgttggtttatattcattcctgacaaacacccaaaacatcaaaaaaagaggctgggacagaacagttccagctgaaaatgaaaaaggagaagaaaatccggtggatttacttctccttctttcttttttatccaaaataaacgggatgttatcccgccatgatggccatattcatggccatcataaccagtccggtttctattttcacctttcgcagaccgcgaaccatgaatctgcccacgccaaaatgagccttcattcgaccgaaaactggctcgttatcaatcttacgacgtgcgtagattgaagcgttgatttcgtcagagaggctttctcgcatgcgtgctttctgatacccccatgaggggttaatattgatttggcgaacgtttccaccctttgtatataccgctggaatatcttggttattttcgtccttttcttccgcgcgataaacttggaaatcgcgggccttgccattcttatccgtgcgatgactataattgcgccatttgaaaacgacgccgtcgttatccgtatactcatcagctttttcatcgtcagaccagttcatgaccctgctgtcatcactacgccacttacgactagcttcgcgaagcattgtgttgtagggaatgagtgctgttacttctggcatttcatcttcgaagaatcgatagttagcttcggatacataacccatgtcagctacgacaactgaacccagtgttcctgcgttattcattttcttgactagtggaataagcgttcttgcatcagtcagattttggaatacaacatatccaataaccatttgattgctgacagcagattgtacattataggccggcttaagctggccattcatcatcggatcttcctttacgcgcataaacgtggcgtcggtatctgttttagaatagctgttacgattaccgaacgtatccatttaattttcgtattgctcattcttatcgcgtatttctttcagcttgcgagtttgagatttcatagtacgccgttcttgcttagctggatttggtgatacctttttggttttttcgacagcttggtttagctcatcaatgtgcatctctaaccgtgcaataacatcatccatataatcaaacgacaattcggtttcttcatgaaagaaatccgcttatgatgctttgatttcttcgagaagcgcaactgctttggctttgttcagttcgctaaaacgaagggtgttcttacgccaaacaaacgagtacttgttagcgttggccagaatcttcgtcccatcgataaacaagacattatcaatgacgcctgcggcgactagttgctcacgcaactttgtaaacatctctaatatgatttgctccatacgaccatcagctctaaaacgattaattgttcgatatgatggaacttgtccttgagttaatcacatggctaccttattttcatccgcaaatcgttctatcatacgaccatatcgaattccacgagtatacgcaaaaagaaccaacttaagtaatagacgtgggtgataaggatatcgtcccgtcgtgtactcatccgtaaaatccaatgattctacaagctggttaatctgatatgctgggtggttttcttcaggttcatatgcagttgggatatccaacattagctgattcatgctataattgttatacattgtttggttcagtccttccgagacagaaatcgtagacgttgagtggccgctcaacgtctttttctttgcctttattactactattataccaaaaagcaggcgcaagcccttgatagacatggttttgcgcctgctttttattcaaaatattcagctaagttttgtcccagcctctcttatatacttatatcttgccggtcaatgcttggaaacgctgcacagttaattcgattaacttttcatgcaacgctttttcttccgggttttctgggaatgaccgccaggcaaatcccggcacttggctatcgagttgcacatcagaaatgtataggtccgtttctgatgtaaattcggtggtgatattaaggttaactgattgccattttgcaagccgctcaataataatttgttcgagtgccggcatatcaatcatatcgacggtgacattaatcaccggcaagatttcactattattcaatacaagcacaaatgtattcagatactcattaaagatggccgttgatacttctgcttctgataagccaaagtgtggtgcaatatgggcaacgactcgttctgtaaatgccgtatgaattggaaacgtactcatcgagaattgacgattaattgggtgcgtaatgccattttgtctgaagaacagcatccggaaattcaacgagaagagtgctttttgaattaactctaattctggttgtgataacgacaagccaaaaaaatcttgataaacttcgcaaacgtcatcataaatttcctggaatttccggcggacatccggtaccaggttggcaactcggtatgaacctgaaccgatgcctagtgaataaatcgatcctaagccaaaacgtaactcttcgtcaaaccacggcgcctgattatcaaaggaaagcgtaatcacctcacgcaatttatcgataatcatccgcgcatgtcgtgacaagtccgcatctggcttaaagagttgatggttataatcaccaataacgtgaccgtgcttcaagcgagtataccaaataccaaaaaagatgcggaatgctttcttcacagtcgtccggatgtgcgtttgttcttcaataatcgcctcaaccttatcagttgctgcttgcacatccgctggaaacggcgttggctgatcggcataggcagtatacaatgcctcaaacagcagaattcgaatatttcgttcatccccaactaattgataatcgtcagaaatttggataccagacttttcaagttcctcaccaacttcgaccttagtcacacgggcaaccgttgtactcgatgagtgacgcaaggcaatcatttcattagactgcgccacttctaagaaaatatccattagcacatcgaattgtaatgaatttcgaatgtactcccctaataaagctgtatcactaattgtttgtaactgatcaacttgtaatgcccggtttgaatcaactagtcggagatacacaatgttcccgtccccaacttgttggtaatcaacacgcaatgtttccacgttttgcaagaccatataccgtgaccaccctaaatcagccatgatgtctttaattaggacagcatggcttgacttgctcgtcaaatatcgatgtaatgctaaacgttcttgatctttcttaggtaatagccactccataatcgcattctctcacttctatcttcgttcaatatgcttagtttagtcggttattgttttttgatttcgcgggattattttttcgtatgaaaaatattagttaacagtgccatttattcaatctcacaaaaagagcgattcatccgaatcgctcacaaaccaatctcatatataccataggggttactgatggtacaagcttatcttaccgaagtgattggcaatatgccgacgtaacatttttctatttttaataatttagctaaactccaaagtttccaactagttttcattatatcaaatgtttaacggtatttgcaaatatcggctcataatcgtctgcgacaactcaaccgatgcgctaaacgcttgctgactgctcaacgttgtcccgaaaacaacccccaccactgccaatctaaaaaactttttcatgactttacctcaacatattgctattttctccacgtgacaaattctatcatgtgaaaaaacgcacagttgacgaaaatttttgcctgtaaaaaaattcaaatagggttattcggacgctaacggtattgttgccacagagcatcataccgtctttgatagtactgaactagcgggccatcacccaggaggacggcataattattgtagagcccttttaattggcgaatcgtttccaatggattagctgcaaactgttcgtatagccgatatgattcaacccgccaacgccaagcagtatagcgtaacgtattcgttaatgacggattattcgttaaagccagtcggacaagctgacggacacggtcgaaatctcccttgaagagtgcgccgaaaatcgcatactctaccgcatcaatttggcggtcggtataaacccgtgtcgcccggttatcccggtgatcttgtcgcattcgccgaaaccacatcgccaactcatcctcatttgtcaccaccattaaaccaactttaacgagccgatattccttttcatgccactcatctagctcacgtagcaggttggccaccgccgtcgcgacctgtgtggcgcgttctgtgccaaaccaagtcacgtccgctcgtacagcggcgtagacttcgttctcgtaacaatcttcaatgtcagtagcgctttgccgtacgacggctggtgagaccacactgtgtgacgcaccgtataaatttgtgcgtgcattttgttcgtccaatgggaaccacatgagcaccgcgacaatgtccccagtctcaaacccaataatgcgcatcaaatctaacatctcatcaatcatcagggtgcccacatcttcaaatacccggtacaacttcgactttgaaaaacccagggcttccaaactccgtacccggatatgcttgtctttcaaacgccggcgtaacgcctcgccaaatgattgacttcgcggttgtagcgtcaaatcagtgatgatagctggcaacgtctcggccattttttgcgcatgcaattgttgcttacttaattgtagccgtgtccaaaccgccaccagggatgtttggacggtgttcatcgtcatttcgcgcacgcccatttgttgcgcagccatcaaaaagacgccaatttcagccgcgaccacttctgaatccatggttaaataggtgcgtagcaacccggtaaatcgttgcagtagcaaaatttctacatttgaacggcgtgctggctgacgcataataccttctaaggtcagccagacgtccgtcacgtttaattttttaggccaaataactgcctgattaagcgcagtcatatgaatcattaaacttgtttcaaacaaattaccaggcatataatcgcggaaaacttggacatcatgagcgaattttcgatagagtttaaaaaaacgttttggtgttagatccgttgcaattaatgaaaagacacgcatttcaaaaatcgtgaatgcctgaatgctattcagtcgatcatataaacgttgtgttttgtcacgataatcaaccccacagcggcgatcgatgatgatgtcaatcacaattgccaccatttcagccgttggataaccaaccgatgcagcagtttgtgcaatttccgcctgtttttgacgtaattcagtttccgtacattttgctaagtcgccaatactcagctgatacggatcagcaattacacccgcaaacaattctgaaaacgacactgctaataactttaataagcgagataaatccactactgagatttgtgtctcaccacgtacaaaccgatagtatcgtgaccttgaaatgccggctctttcaatatcttcaaccgttatatttttttcatcccggagcgcattaatccgctctgctaatagtacctgtgacattttcaatccccgtttttctctgtcaggctacttactaataattcattatattagaaaaatacaacaatttatggaaacggtttcaaacatttagcgtaaaagcatttagccgacttgttgcgatttcatgaacaacaccccttacctattttgtattccaaatttttcaggtaaaatgagaacatcttaataaacaacggggtgcaacagatgacactagaaaattttgatttgttatcacaaaagtacgctgacttaattacgtcagttggggttaatgtccaaaagggacaagatattgtcatctatgcggatgtcgcacaggtgcctttggtgcacaaaattgtggactcggcctacaaacgtggcgcaaacaacgtcatgattgaatggcaggacattcatgtgcaacgtgaatttttgcaacacgccaacaacgattctttgacgaacatccccacttgggtatctgttcgcgctgaagaattgatggcgaagcatacgacgcgcatttcactgatttctgccgatccagatggtcttggtgctgttgatggcgatcgcgtttcggcctaccaacaagcctaccaacgcgctaatcaagccgttcgcaaggccacgatgaataatgatgtgtcatggttagttgttgccgcggctggtgaagcctgggctgaaaaagttttccctgatttaaagggtgaagctgcaactgaccgtctttgggaagaaatcttcaagatcactcgcgttggggttgcaaacgacgtcatcgctgactggatggcccatgtgaatactttgaaagaaaaggcgcaatggctcaacgatttgaacttcaaggagttacactacagctcacccatcacggatttaacagttgggttagccgaggatcacgtgtgggaagctgctgactcaattgacaaggctggtaacatgttcgtcgctaacatgccaactgaggaagtcttcacctcccctgactaccgcaacattcacggtaccgtaacgtcaacaaagccattatcatacgcaggcgttttgattaatgatatcaagctagcgttcgttgatggccacgtcacggaagcgcatgcctcaaccggcgaagcagtcctacaacaattgatcaagactgacgaaggtgcttcatctttgggtgaggtatcattggtaccagatccgtcaccaatttcacaatcaggcattgttttctacaacactttgattgatgaaaatgcttctgaccacttggcacttggtgcagcatacccattcaatttgaagggtggcacccaaatggacgtcgctgcgcgtcaagcaaagggccagaacgagtcattggttcacgttgacttcatgatgggatcagccgatatggatatcgacggtatcacgtatgacggtcaagtcatccccgtcttccgcaatggtgactgggcataatcgcacacaaaaagaaaagcatctggtatttgcaaacaccagatgctttttaattatcattaatttgcttcaccaacgatgacattgccaacaatcgcaatcccaacacgtgagtagcccgcattcatttcccaatcacggtgaccagttgtaccaaccggcatcatgttcgtctcattaaaccaagcgtttacaaccgacgtacccggggcataatcaatcgctacgacttcaccagcggtgctgtagtgatcactcgcaacaccacccaagttagccatttgttgggcccgtgcctgtgcacgcgctgccaaatcgttatcaaacgtcaatggcgccaacccctgtgactgacgcaacgcattcaaggcattaaatgtcgacatatccgcgctgccaaccgtggctaccgtcgcctcagtctgaacttgtgactcagccgttacttgtgcttggacggtactagctgcagcttgttgtgatgatgcttgctcagccgccacctgagcggctacggcggctgaagaagcagctgcaagtgcagccgatgccgtttgttgcgcagcagcttcagaagcggccgtcgcttgtgactccgcggccgccattgatgcagcgtcagcttgtgactgtgctacgctaactgcgtatgacgctgctgccgcctgactagcagcaattgaagctgcttcactcgctgcttcagaggccgctacttgactggcagcaactgaatcagcaacctgactcgctacgactgcctctgacgttggtgtcgcagtgctggtcgcaacagcatcttgctcagtcgttgcggtttgctctgtaacagcttgcggttgtacagtcgcaccagtagtcgtttgcgccataaaactttcatttgcaaacaacacatccggatttgcaataccgaattggttaacaaacgtatccaagttctcaccattcgctaaagctaatgcccaaacagtatccccatactgcacgttgtaatttgccaaaccacccgcttgtgccaactgattggttacttgttggacaccattcgcttgccaaacgtcagctgacgccttgtcatttgctgtgatggccacgccagcaaccgttgctaccgtcgccaacgctacccactgcttgcctgatttgtacatcttcttacgagaaaccgtgttcatatttaataaatccccttgataatcatattcaaacccgttttctctttctctaacaaatattaagtttagcaactcgtcttaacaaattcattacaaacataaatgttttttatatattaaccttaaaaagcgcctaacctctcagtgagaagttaagcgctttttaggggcctactgttgtaggcgttgaatcgtttcgcacaaccgtgcaacatcgacatcataatcttcaaatttcgtcttcatatataaggaagcatcgcgcttgtcgagtcgaacatcagtccctttcaactgcgtttttacatcattcaactccgaacgtgttaactcgccacgaccttctgccaaagctagatcttccgtcacatagccaccatctgaaatccgcaactgcgatccaaaaagacttgattcctcatacacataaagcgtaattggcaatccttcgacatccaagtacgacgtctcaatttttacaatatctgctgtcatcttttcaaacctcggttttggaccattttcgctacgccacgcattctctagttgcgtgatatcaatcatattgacctgtccaaaattttctctcttacagaagtatagcacaatccggaatatatgaaaaactttgcattctcaacaccgtacacggattattttcgcagattacgcggaaatgtcggcggtaaaggcgctccaactgacttcacatcgttagtaaacggaattggtagttgaatcgctgccgcatgcagtaataagccatctgaataattactgtctgggttatacagcggatcaccaactaacgggtagccgaggtgcttcatgtgtaaacgaatctggtgtgtacgtcccgtcgctaatgcaagccttacgagcgtattttggtagaccgtatgaaccttgtgccaataggtaactgccggacgcgcattaggcccgttgaccgtccgtgtgcgtgaatctactggattatcgccaattggtgcatcaatagtgccacttgttgcggtaatgttgccacatacccacgccaggtacgttcgcttgatagtcttgtcacgcaacatttggtttaacatcggcacaacataaggatttttagctataattaacgcccctgtcgtgtcgccatccaaccgatgcaccatatacgccgatttgccctgctctgctaaataagcctgcgcaaaattcatcatggtgccatcttcacctggcgaattcggatgggttttgacaccctttcgtttattcacaacaattaaatcatcattttcaaacaatacatctaatggctgactagcatctgggacgtaatgcgaatccgccacttcaaaatccgccggcaaccaggtcatatcgaggacgtcacccggctttaaacgcgttgaggtcggttggtaaacgccatttaataagatacgccgccccattctaaaattgcctctgatgcgtcgtggcacttgccaagccgttaactgttctttaattgaaattgccggttgatctgctggtaaaacaacacgcttcgtccacactgtcattacacccactgctccttttaaaactgcaaacaaaaaggcaacctgatgattaccaggttgcctttaagccgttattacaacttagtaacgttagcagcttgcaagccacggtcaccttgttgaacttcgaatgatacagcttgtccttcttccaatgacttgaagccgtcaccttggatagctgagaagtgaacgaatacatcgtcacctgactcacgtgaaaggaaaccgaatcccttgtctgcgttaaaccactttactgttccttgttccatgtctgaaacctcctggcaattattgccgaattttttaataatctaaatatgacgatgccagatatttctgtgaaacataaaacaaaatcctttaaactatgtacataagtataacacgcttatccaaagaaagatacccaaagttttaaattaaatattttaatcttatccaaaaaagccgtcggtctatgattggtataaattttgaaacaaaaacggacattctgactgtgtcaggatgtccgtttcgtttactttagcatcgccttcattgcctcagccgttagttcagccgtcacctttgtggtgtacgccttaacttcgtcttgtgaagcctttgggttagcttgcatgaacgcagcaatctttgcagaagccgcagcctttagttgttcttgttgtgcttgcgcagcagcaggattagccgcagccgccttttgcttcgcttgtacagcctttgattgtgccggcgtcataaccacccacgtatccttaggcaacttaacaactgtttgttgcttatacaatgagtggccttcaccaccaaacccaaacatcaacttaaagaaatcgttttgccactcccaacgagtcgtcttagtcgtgaccgttgccttatcagcatcgatcaacttataagtcgccgtcttcttaaccgcctctacaatgtgattcttgttaggcacaaagtgagccgttggcttagcgttttctttatcggcgtaaatcataacatagttgtttgactttgtccccaatgcttgggcaatcatcataccagctggaaccttagaaccaccggcagaataaattgtcttggtttccgtcttagtaaccttctccataccgaaatggttgttgaagttcgctaccaacatcaaaactgtcgccagtagtaatccacctgaaatcaagccagatgttacacgagcagggacattttcaatcttaatccaagaaataaacgtcaaaatggcgaagactgccaaaaggataataaccatcttattcagcctccttcatttgtgggtcaaccggcttgtggtttgaataaccggctgccttaatggccccacccttcaagaacatcgcaacgacgataccaacgatggcaaatcccaaaccgatggcaaatgatacgtggaatcccttcattgaagcgtccaagtaatccgccccgtactggagtgggttcgtctttgacaatgccttagcaggctcattatttgaaatcacattttgtgttactgatgacagcaaggccacaacaacggctgacgcaacttggcgggccgtgttgttagcagctgttgcgtgtggtgcctcagctggtggcaatactgacatggccatcgccgtcaacggcatcattgccatggcgataccaaacatacgaaccgcgtacaaagcggtaatgaagtgtgctggtgttgacgccgtcaagaataggaacggtactgttccaatggccaagattgagaaaccagtcaaggccaaacgcttagccccgatcttatcgtaggctgaaccagcgattggcgccatgatacccatcatcaaagccccaggcaacaacgtcaatcctgattccaatggtgacatggtgtgaacgttttgcaagtacgttggcaacatcatttcgacacccatcatcgccatcattgccatcataactgacacagtcgtcaacgcgaattggtggttcttaaagaccttcacgtcaacaaatggttcatccaacttcaattggcgtacgacgaacaaaacgatgaacaacaaaccaacaatcattggcaagataacgttcttaaagtcgccccaaccatcagtcgccacattagtaaatgaccacaagaagattccgaacccaagcgttgagataatcaatgatggcacatccaacttcatcttacggttaggaataacattcttaataaagaatggtgatgcgataattaccaatgccaaaacaaacattggcaagtagaaaatcgtccgccaagagtcagaaatcgtcagacccaagaagtggtgattcttttccaaaatccatccagacaacgttggtccaatggcaggtgccaaaccaatgacaataccattaattcccatggctgccccacgctcttcggctgggaagatgttcaccattaccacctgcatcaacggcatagtcacacccaccgcgatggccaccaggatacgtcccagcaagaacatccaccacatatcgtggtgtgcgggtgtaaaggccgtcgttgccataccggcaaacaacatcaagtacgcgaaaatgtacaagaccttagatggaatacgcgttgataggtacgcagaaactggcatcataataccattagctaacaagaaccatgtcgttgcttgttgggccgtggctaacgtgatatcaaaatcgcgcatcaaagttgggattgcggtacccaacgaagtttgcattaacacaccagcgaaagtaccgatcaagagcactgccaccatggcagagcgactaaatgggtttccgttgatgtccatagcaacacttttattttttgccatgtcatcctccaattgttctatttaattataagtgcatcaatttgacaagaattaattgtaaagctacttaacaaactttgcaagtatttttgtcaacttttttgacaaagattgccgattgtttcacaaagaagtgccgtaataagacacaaaaagtgctcggccaccaaagggccaagcacttttttaataatctatttaaatggggtaaatcttaccaccaaccgttagcggcacggaattgtacggcaccgtcaactgaaccgtaacgtgaaacggcgtagttaaccaaaccattagtttgcgtggcaacgtcacccgttccccagccttccttagtttgacccaatcccatgtaaccgtttggtgaaacggcgttagggttaccacctgattcaggcattacgatgttttgccacaaggcatcagtaccaccgttagcaatgaattggtcataaactgaaccaccagcggctggtgcggctgcaggagcagcttgttgtgcaactggctcagcttgctcagcaacggcagtatcttgtgcaactggttgtgcttgaactgaagcagcagcggcttctgactcagcagcctttgaggcagcagcttctgaagcggcaactgatgatgcaacggcctctgaagcagcggcagatgatgcggcagcttctgatgcagcagtcattgaagcaacagcttctgacattgctgatgaagcagcatctgatgcagcgctgttagctgatgatgcagcagtcgtgttcaacgcattttcattaagctcttcttgcgttggcacttcgatttgttgatcagcaaaaatcatgtttgcgtcagtaatcttgttagtcttaaccaagtcttcaacagtcaagttaaacttgtctgccaattctgacaacgtgtcgcccttttgaaccgtgtatgttgaagcggcgtttgcaacagtttggcctgcaaccaatactgaagccaaaccggcgatcgtcaatgctgtttctttcatcttactcataatcagttaaacactcctaaggattgtatctatgtcgtgcgaaccctattgctcaagcacgttctcttatatgaggcttcttccttgcctcaaccacaagacatagtttaccaagcttagcaggcttaaaattacacattcattacataacatgtctagaaacaatattatgacccctttttgtgtcatattaacgttacataaggtgtgttacacgtgtaaaccattgatatataggcatttcccgccatttaattaaccggttaaataacatgttttttgtaacttaaattgataaataaaagccggaaaacgttgatttcctggcttttgtctttttttgtcacattcatgacacgttgaaaagtaatgaaatcagaatttacgtaaccaaatttcgttaattccgtgtcccatcgccttatgaagaattaaatcagctcgttcacgcgttggtaaaatgtagtccgttaggttcggtaagttaaccgtttcccagacgcgacgcgcaccagctaccgcttcagctactggaatttgcgtataaggaaagaagaaattcgttggatctgcctcttcctttgcctgttgcagcaacgcctcaaatcgatcaatgtaccaatgctcaattaatgatgtctctgcatccacatataacgacaaatcaaagaagtctgacaagtagactggcgaattaggcgccgcttgtaacgtattaataccctcgacaataaaaatctctgggcgcttaaacgtgtcgaattcattcactaagacatctgatatgtcgtgcgaatagcgtggtgaccgaacgacttcatcaccatctttaacgttattcataaattcaagcagcgctggcatatcgtatgattctgggaaacccttccgatcaaaaataccttgtgcttgcaattcttcattaggcaacaagaaaccatccgttgtcgttaaggcaacgttttgttcaccatactccgcttgcaacatgtattggagcaaccgggctgtggttgatttaccaacagccaccgaaccagcaatgccaataacaaacgggcttggcttaattgcgcgacctaaaaagcgctcacgttcttcacgatcacgcaaatactgtgcatggcgcaacttaatgtaatggaccaatggatcataaacatcggcgacatcactcattgaaatttggtcattaaacgctttaatttctcccaatacctttggtgtgacgtgagatgtatctcggtcagctgcaggcacgactaattcgtgccattcatcacgctgaaataccgcataattaaacggtgcctcactcatggttcttaccccttttcgtacaaacgctcgtcaacttcggccagcaatggcgtcaatgatgttacagctaagaccgttaactggtgcatagcacgtgatgcaattgtgtagaccaactgacgttcatcatcgccgtggtaaacgccttctgaagcatcccacataatgacagcgtcaaattcaagtcccttagccaagtaggctggcacgataattgtgccaggtaccagacgttgattctcggtccgaataatggtcacgtcagcgcgttcacggagtgcctcgtacgcaacttccgcatctgccagtgtcttggtaatgattgccgttgtttcgtcagcttcatcattagcgaccaattgcatcaaggttgcttcaaccatcttatcttgtgatggcaaaatcttaacaactggcttgtcaccctcacgttcaaaggcatcaatttgggcaccgttaatcaaaatggcctttgagtaatcggtaatttgttgggttgaacgatacgtttgcgttaattgcacgtattctgacttttctggatcaaacaaacgtgacaattcatcctgcaaactgacggcgttttccttcgtgaaaatggcttggttcaaatcacccaacatcgtaaagcgagcacgtgggaaactaaacttcaaaaaggccaattggaatggtgtgtagtcttggatttcatcaataaagacaaagcgaatgtcacgctcaccgcgactacccttaatcaagtcgaataacagcataaatggtgtcatgtcggccattggtaattcaccgttcttcatcttattcactgtgtattcaaccgacttggtccaatccgcttccgtaatatcgtaggccgccaagttaaccaactttggcacagaacgcaagaaatgaataaattgattgttaatattgataaaacgatttcggttgacacccttggcgattggcgccagggcattcgtcacaatgattttagccaaatacttggtttcttcttcatcagacttaaactcacgcgggttatcacccaacatggtgtcatactgttctttcgtcaagttttgaatttcagcttcgacccaatcagcttgcatctcattaccaattcgaccttgcaaaatcttcattagtcgttctttcgtcccttgaagacggttacccagcttatagttctcattgaatgaataataaatgtcgacaatcttttccttagaaatgatttcttgcccacggaacttaattgggcggaccttaatatcagccttgttcaagccatcagcatagcgttgcatggcatcgaagtagacacttgtacccttcaagtcaatgatacgcttttgagcgccggctggttgcgcctcaaaacgttcttgtaacgtttcaagttgcaactttggcaaacggcgtgatgcgtattggtaatatgtcatttgaaccatgttttgctcacccaattcaggcaaaacttggtcgatataatcgttaaatagttgatttggtgagaacatgaccacttgaccagacgtcaaatgaccacgataacggtaaagtaggtatgccacacgttgcaaaacagctgaagtcttaccagaacccgccgctccttgtacgaacagcaattcagcggccgtgtttcggataatcttattttgttccttttgaatcgtcgtcacgattgacttcatcttagttgttgattcaccagacaaagcattcaacaacatttgatcacccacagcttcgtcggtgtcgaaaatcgtcacaatcgtgccatcttcaatttggaattgacgcttcaggtgaacatttgcttcctgcttgccatctggtgtttcgtaggtcacattgcccaaacccgcatcataataaatagaagaaattggtgcgcgccagtcgtaaaccaagaaattatctggtgaatcagagaacgatgccaagccgatataaattggttcaaccgtctctgaaccagcttcttgcacatcaatacgcgcaaagtatggtcgcgcttgtaaacggtccaagacaaccgcttggtgctcaactgaattcatcgccaattcacgttcttgtaacatctgttgctgttgacgtacagacatcgccgtttcgaacaagctgccgtacgttgatgacctaaagcggacatcgttccacccattatcgacgtcagcctgtttttgttcagcattttttcgatctaaatcattttgtaccttcgcgtcttgaatcttctccaagacggtatccaagcgttgctgctcggcttcatatggttccataaacaggggtccccctacgtaaatttagtgattccatggtactacaatttgggtttaattactactctttttcaagtagtcgttttttacctaacaacaaatcccagccttacgacctaatgagtcgacaaagctgggatttgttagtttttattgggcgagccactgtcttgcccagcgtattaatcttcttgagcgtaatctgtcacgataaggtgttctaggaaatcacgtgcgtcagtttcatcagtcgtgcctgcagcgatttcagcttccactgctgcgtgaatcttagccgtaactgcttcactctctgcatctgcggcaataacgtgcacgcggtggaattggtctgaccagtaaacctcagtaggtccccaagtgttcaaatccaacttctttacccaatcttgtacttcttgtctagtgtatgccatgatgactacctccaactgctttcgcagtgattaacttccttttccttttttattacatgattagtatagaacaactattttgttgtggcgataaaaggcctattatcgcgaataaatcgcggcattcaacgtcccaattatgacataacttaataacctgaaaatcggcatcaaaaaactcgtactacactacatcgctgtaccataatacgagtttccaaaagttacttagttttcatcaatttcgagttcaatatcatccacgttatcagctgacgtgtcgttatcatcagctgaaccatcggcgccatcatggctaccgatgtaggcttcacgaacttggttatagacatcatcgtaaatcgccttgtgttctgggtcttccaaccaacgaataacattgacctttccttgaccaatcttctcaccattatatgagaaccatgaccctgacttaacgataatatctttatcagccgccaagtcaatcatttcaccagtcttagaaattcccttaccaaacaagatttcaacttccacttcacggaatggcgccgcaaccttgttcttaacaaccttaatacgtgtcaaattaccaaccgacttgatatcatccccatcagccttcgtcgcatcaataccacccttacgacggacatccaaacgtactgatgagtagaacttcaacgcacgtccaccaggcgttgtttctgggttaccaaacatgataccgatcttttcacgtaattggttaatgaagatggctgttgtaccagtcttcaaaatagcacctgacatcttacgcaaagcttgtgacatcatacgtgcttgcaaaccaaccgttgaatcaccgatttcaccgtcaatttcagcctttggcgtcaatgcggcaacagagtcaataacgaccatgtcgattgcacctgatgtaatcaaggcatccgcaattgccaatccttgttcaccagtatctggttgtgacaacagcaactcatcaacgtcaacgcccaatgccttagcatactcaacgtccatcgcgttttcggcgtcgatataagcgacaattccgccattacgttgggcctcagcaactgcgtgcaaagccaacgttgtcttacctgatgattcaggtccatagatttcaatgatacgacccttagggtagccaccaatgccaagagccacgtccaacttcaatgaaccagttgacgttgattgcaccttcgtaaattggctatcacctagcttcataacagatcccttaccaaaagacttttcaatcttcttcaaggcttcgttcaaggcattttgacgttccttagggtctgcaatctttccttccaacttcttatttgggttaatgttttttcctgatgccatttttatcggcctccacttgttaacttaaacttaatataaatatagtgtaacctaatcgctacaataattcaaatgttttcccaactattttgccaactcggcgagttttgttgcaatcgctgcaaaaccagctgcgacacttgcttcccgcacggcttgccgatcaccagtaaaatggtgctccgtggcgactactgatccatccggtgccgcgacaccaatgaacaccgtgccagccggatgcccttccagcgcgtcaggtccggccacgccggtgaagctaatcccccacgccgtctgcaacgttgctttcgcacccgttgccatcgccttagcaacctctgccgacaccacgccatacgtcgcaatcatgtccgctggtacaccgacgagttgcgtcttggcagctgcagcatatgtcacaaatgcccctggcaaaacggctgaaataccactaacaccagccagcgtactaacaaacatccccgccgttaaggattctgccgacgtaatcgtctcacctcgtgcaatcaacgcccggccaacttcttcattcgtcatctgcagcctccaatttcatgtgttatccaatatagacgatatcatggtccatttgtccattttctgtcactacttattctaatacaaaaggaggcaggctaacacatcaggtgtcaccctacctcctaattatgatttacttaaaaccatccgagaaaacatcgcggttcttatagaaataatcaattcctgaataaatcgttgctaacaacgcaatccagatcataatcatggcaaatggaatattggccattgcaaacacgatatcatgtagcaagaaaaatgaaatagcaaccatttgagaagccgtcttaatcttgcctggcatcgcagcagccaataccttaccgttgttttcaacaatcagcgtgcgcaacccggtaatcgccaattcgcgaataacgataatggcaaccatccaagcaggtacccaaccaaattgcacaaagaaaatcaatgcggtcattaccaatagcttatctgctaaaggatcggcaaacttaccaaagttcgtcactagcttatacttgcgagcaatcttaccatccgccaagtcagttaatgacgccacaatgaagataatcgcggcaaccaagtgtgtcactggcaattgtgcgcccgcaacttgcaatgttccccaatccaatggcaatgccaatactagcataaacactggaatcaaaatcatacggaacaccgtaagcttgttaggtaaattcatgactgttaacgctccttactatcttttagcgggcaaacgtcattgcaaggttccagaccgttgcattgtttgccatcaagtcaactgacttgccgtcaagtgatactgctgtcgcagctgcgttaccaattgaaacacgtacaccaggaacagttgctggaatcttaacatcttggttcccgtttgcttgcaatgtaccgttccacaaaacggcacctgatgcatcactcacttgaatccatgaagcaccagtcgtcttcaagttcaacgtcaactccttgttagcaggggccttaacagtgccgtagttaacggtgttgccagttgcttgaccagcacccaaatcaacagcatccttatccttcttctcagatgatgcagaagaagacttcgcagctgattcctttgacgcgtccgttgaggacttttcagcatccgatgacgctgatgatgacacctttgacgttgtgacagagactgatgacgttgtgttttcttgcttagctgagccagcaaatgacgcaactagtgcccaaataataccaataattgccaccacggcaaccccaattaaaatctttggtaacatttggcgcgtcttttcagccgttgactcttcaacatggtgcataccagcacgcgtcacattatctgaatccacacgtgccccactcaagtctggttcaactgtttgcgtttgaatatcatgattttgcatgaattccgtcacgtctaagccaacagctgacgcatattggcgtacaaacgcgcgctcgtagaaagcaccaggcaactggtcgaattgaccattttcaatggctgctaggtagcgcttttgaatttttgttgattgttgaatatcgtcaagggatagccccttatcaagacgagcattttgtagctcttgtccgattacgctgttgcgctcttcgttcattagtctctcatccttaactatttattgtcattataattgcatataggcttattctatcacatgtccaaagcatttggcgtcgcaattacggttgtcaatgcactgacttgggcatttcttaagatttctaatacatctgtaaacgtcaatgcttgcaaaatattaatttcgtcacgtaatgtcgcaaaatcaaaggttgatccttcaaagcgagtgacaatttcttcaagttgattcaacttgttaattaagcggcccaaggcatctttcttaactaattcgaaatctgcttgcaaagccgcaaaacgatcggccatgttttccaattcatcagcgactgcatcaattagttcatcagcttctggtgtctcggcggcaatggtcaaaaacgctaccccacgttcccagtcaaactctgcactgaacgaatcgtcaatcatccctgagtcataccaagtcatgtaagttggtgagaattcaccaaagaccaaatcaactgccaaactatccgcaattgcaatccgcaacgcttcccgaccagtcggcatatcggcgccatcataccaacgttgtcccatcgctaccttagggcgaacaacatccatttcgacctctaaaatatcatcacttactggttgcagctcgtgagttggcactgatactggcgccacggcgggccgttgaccagctggtgatgcgttaattaggtcacgaactgttgtttcatcaaaagcccccgcaatcacgacgtccatgttgtcgggccgatagaatgcgtcaaaagccaactgtaaatcttctggcgtcacgctatgaactgattcagtcgtaccagcaatatcgtcggccattggatcatccttaaataattggcctaaaatcaaacgatacaaccgcgcattcgtatcatcttgatacatatcgacttcttgcgaaatgatatcctgctcgcgtgcaacggattcagcctcaaaataaggctcctgggtaaacgttaacaattcctttagcgcctcatactcgttcgccggggcggttaaaaagtaactggtccgggtctgagttgtaaacgcattggcattcgcccccaactcactcaaccgtgaaaacgcatcatagccaggttgtgcaaagagtttgtgctccaaaaaatgggcaagacccgctggttgtttcaccagttgtccgtctttttcaaaactttggtctcgcgcaccaaaatcaaccgtcaccatggcaaccatttgatggaagtcaggtcgtggtagaagatggagacgtaggccatttggtaatgtttcatgacgctcattgggcgcaaaacgtgtcacagcatcagtcattctgggtccctcccactaattcataatgcagttgttttttgactgcgttcgcaacttgttgtacttgttgtgcggtaaccgactcaacggcggccaaccactcttcagctgtggtgtgatacccgattaattcttgattctgcaatcgttctgtgatgcggcctggttggtccaaggaagtcacatagtctgccttcatcaagcgtttaatcatggcaagttcgtcgtcagcaactaattccgtctgtaggcgggtcaactccgcgtcaattcgttgctcggcttcacctaatttggcatggtccaccccggcctcaaccatgagcaaaccagtgtatgggttgtaatctgaatagacagaataagccaagccagctgactcacgcacattcataaacaaacgcgagacagctaagccaccaaacaatgcattaaacacaaagccttgaaaacgatccgtctgcgcaatatgcaattgataagccagaatcaagcgggcctgattcaccttgtcaagttcaaccacctgcttaacagcatctttttctggttgctcataatagggatttcccacaatggcacgaccggttagtggcaattgttgtactgcctgcgtaactgtcgcaacatcgacatcacccaaaacaataatatcaacgcgatcatgctgcatcgtatcaaaccaggcatcccaggcttccttgggagtgaccgttttaagcaagtcaacagtcccgtaagccggcaatgcctgcactggatcatcgaaataagcattgatggcttgccgagccgcatagaacggcttttcttcctgtaaaccggcgatttcatcaagtgagatttcacgttggcgctcaaaaacagttggatcaaagccctgttctgcatcaccgagtggcgcgcacatcatctcccggataaaagcaaagccatcaaccaacagactttctgaatccggtgcaaacgaatcgtgaaccaacgtcattcgtagtcgtaacgtgtgcaatgcaccagttttcaaaacatctgtgccaaaggacgcaccatagagttcactcagtgcgcgggccaaagctgtttgtgaaggatattttttagaagccgtttccagcatattgctggctaggacacggccgcccaaagaagtcgcgtcatgttggcgggtgaaattaacgagaattcgggttgtggcaaattgctggctaggcagtacgtgtaaaaaaacgcctggctgtacagttacggtggtcaatggcaataccttcttgtttccaaactaaaagcgcgtaattgagacgcgcccttgttttgttgtagtccgactgtgtcatacagacacgctagttactttaagtatacctttccggaccacgttttaccatcgcttttacgcctgagtatccttctcttctggcagtgccatttggaagctacgcaaatgtcgtaagagcgttgaaatcatcatcaacactgcaattgccaacatgctaattgttaacagcgtgacaatccaaccaccgattcccaacaccgaaacatgaaaaatatagagtaaacaaaaaagccccgttgtgttataccagacccagcggacccacttattatgccaaaccttcatgacctatcccctaaaagtatcttagaaaaaattattatagacataatcgcaaataaaaataccctaactttgactgaagttagggtattttatgacatgtgtaaattatgagaagatggctgacaaaatcaagataacaatcaaaccaacaactgaaatgattgtttcaaggacagtccaaatcttcaacgtttgtggtacgtccaagtcaaagaattccttgaacatccagaaaccagcatcgttaacgtgtgaagctgccaatgaaccagcaccgatagcaagcacaacaaacgctgggttaaccgccgtttggttagcaaccaaaggcgccacaattccggccgttgtcaaaccagcaaccgtagctgatccaacagatacacgcaagataacggcaatcaaccatgcgaagatgattggtgacaatgacgtgtgtgagaatgctgtggcaatcgcagttgaaataccaccggccgtcaagattcccttgaaggctgcaccaccaccgataaccatcaacaagttagcgattgacttcaatgcttctgacattgagccaccaacttctgacatcgtacgaccttgctttggtcccattgaccagatcgcaaaggccattgcaataaccatcgcaatcactgggttaccaaacatggcaatcacccggtcaagcgttgatggatccgtcaagtaaccgtgacgagctgaagcggtcatcgccttccatgctgcatccccgaccatacctgagtaaacctgcttaccaccgttgtgggccaacgtgtaaaccgttgaaatcaacatgaagaacacaggcatcaatgacgtcacaattgacaaaccaaatgatggcgtctcttccaacttaaacgtcttgacttcaccgattgcatccaagtgctttgtaatcttaaacgccttaggttcaatcttacgtacgaaacgtgtgaacaaaggtcctgctacaatcaacgccacaatggcaacgatgattccgtacatcaagacaaccccgatgttagcacccaaaacgttcgtcacagccgttggtgatggctgtggtggcaagaatccttgggctgctgacaaagcagcggccattggaattccaagatacaacaatgatacgccggcttccaaagcaattgtgaagacgattggaatcaagacaaccaaaccaacttcaaatagcaatgaaattccgataataaatgaggcacccgcaaccgcccattgcaactttgacttaccaaacttgttaatcaaagttgttgcgatacggtatgacccaccagcatcagaaaccaagcgaccaatcattgacccgaaaccgaagacaatgaccaactcacccatcgtgccaccgataccgttcttaagcgcatcggcaataccagctgggttcattcccaaaccaagagccacaagaattgatgtaataatcaatgacacaaacgtgttaaccttggccttgagaatcaaaaatagcaaaatagcgatacccaccactaggaccaagaatggccaaacgttcaagccgtttgacatccattggtacaaccctgttgaaggatcagtagtgaggcctgcaagtacagaaaacattccaaacacctctacaaataatctcaaaaaaatatctctttaaattttatgaaatcgttttcataaaaccaactttactagtatacaccctaagtaagcgtttgcgcacaaaaagttcgtggattttttaataaacggtattccagttgcgtgtgctgtttttgtccaccatttaggaatgcatctgttggtcgccgctttgcgacgaggcatggggatgggggattggcttcgacaaagatggcaggtgggaaacgccgccggcgcgagcaccggctagcacccaaataattgtgctaagggtccggctcccagcaccttatctaaccggcggtcggccgaacttgtgcattccccacctgccatcgctacgccaatcccccacccccatgccagcagccgagagcatctcgataatgtttgcttatcatcccattggaccagcaatttattaattgcctgcttagccgactttggtcatctcagccatcagagaacaactcggctgccgcaacagggacgacacgcactaaaaaagaagcacccacacaatggtaggtgcttcgtatttatgaactaattaattagaagttgtacttcgtgtcttcgtcgttaaccttaacgacttgtgacttaagtccctcttcttcaaggaacttacggaatggtacaagttcttgtgcatcaaagcgctccttaaaggccttgatttcttcttcagttgcaagcgctggatcgagcttcaaaccttcgacaggaattggacgctccttcgtgatcttagcatcaacgactacgacacgaccttgcttgtagtaatcaacggcttcttgcatcaccttatcgatgtcagcaatgctgttaaccgtcaaaccaacagctccttgggcttcagcaatcttagcataatcaacatcaccaaagtcaacgatttcatcgttacggtacgtgttggtatcctcgtacttgtccttgatgaagccgtattgcgtgttcgtcataacaacgttgataactggcatgttgtaacgaacggccgttacgatatctgaatcagtcatcgcaaaggcaccgtcgccggcaatgttaaagacttgacgatctgggaagacgttctttgcaccaattccaccagggatggcaatacccatcgtggcaaacaatggtgatgtacgccacatgttcttaggcgtcatgtgcaagtgacgaattgacatttgcgtcgtgtcaccaacatcaattgagaagattgcatcttcatcagcatacttgttgattgcgttgtagacttggtatgcctccaatgggccttccgtcttcgtctcaatcttgtgcatgtagtcacgccagttttgcgcatccttcaaagcagcgttccaccaggctgactcagcaactggttcaaccttctccaaaagtgccttaactgccaaaccagcgtcagccaacatcgcaacgtcagccttgtggcgacggccaagacgagctgggttgctatcgatttggataaagtgctttacaccagccatgaagttctcaacttgtgagaatgggtagttgttaccaatgaacaaaacagtgtctgcttcgaagataacatcgtttcctgacttccaagcaacacgtccagctgaacccatcaaaccttcaaagtcataatcgaacgcttcgtaactcttggcagtcgtcaatactggcgccttcaacttacgagacaactcttggacaagttcaccgtgaccgattgtaccgaaaccagcgtagataactggacgcttagcattcttcaaaatttcaacggctgcatcaacatcagctgtctctggtgcaacaggcttgtactccttgtagatatcaccagatgagtaaattgggttagcgtagttcatctcggcatcgatttcagcaaaaccgaaatcagcaggtacttcaagaacggcaacacccttctttgaaatcgccgtacggatggcatcatcaatcatgtatggcaattgctcaggtaccgcaacacgcttgttgtaaaccgcaatgttgttgtacatagggttttggttcaattcttggaatgaatccattcccaattcacgtgatggcttcgaacccaaaattgccaaaactggcgttgcatccatagcagcatcatacaaaccgttaatcaaatgcgtggcaccagggccaccagatccgacagcaaccgccatcttaccgctaaacttgtattgcatggcagctgccatacttccaacttcttcgtgctttacttgaataaacttaatgttgttttcagggttactcattgcgttcatcaaaccgctcaaagtaccagaaggaataccgtacatcgtatcgataccccaaccttccataaccttcattgctgccaaaccggcagtaatcttcttatctgacatcgagataagcctcctgttttaaaaaaatcagtaaaatttcatttcctaatcaatgcaaccaggtaagtgaatgatatctaataatttacaagtattagtctgacactatcacccatttaaaacaaataaaaagggccatttttcaggattttggcgtacaaaaaacccttcagcgaactgatgggtttaataaatgctaattaaatcaaaatcatagccatgattaggatgacaaccataccaacaagggaaatgattgtttccaaaaccgtccagatttggaaagtttgcttaatcgtcaagtcgaagaattcttggaaaatccagaagccagcgtcgttaacgtgtgatgcaatcaatgatccagcaccgattgccaaggcaaccaaaacagccaacgttgggttgttttgtgattgcacaattgacaacacgataccagccgccgtcataccagcaaccgttgctgatccaacagaaatacgcaacactgcagcaaccgcccaagcgaaaataatcactgtgatagctgacatgtggccgttagcttggaacaaactagcaaccttatctgacaaaccaccagtaaccaagacaccacgccaggcaccaccaccaccgacaatcaacaagataccggcaacagctgacataccattattcaatgagtcaccaatttccttggctgacttcttttgccaaacacccattgagaagatggcgaacaacaaagcaatcgtcatggccaccgctggtgttgccatgaattcaataaccttgtcaaaagcacttgggttctttggcgtcacaccacccgtgtaaatcatcttgtaaaccgtcgcaatgatcataaagatcaatgggaagactgacgtgataactgacaagaagaatgatggcgtcttgtccaaatcatattccttaacttcaccgacagccttaatttctgtcttgaattggaatgcgtctggtgcatacttttgcgccaacttcgtgaacaaaggtccggcaaccacggccgtaatgattgatacaatcaacccaagaatcaacgtcaaaccgatgttagcacccaatgatgttgcaacggctgttggtgcgggctgtggaggcaagaaaccttgtgctgatgacaaggcagccgtcattgaaataccaaggtatagcaatggcacaccagcctcaatcgcaaccgcaaagacgattggaatcaacaagaccatgccgacaccaaagatcattgaaattccgatgataaatgaggcaatcaaaacagcccattgcagacgcttgataccaaaccagttgatcaacgtcttcgcgatacggtatgaaccgcccgcatccgcaaccaaacgcccaatcataccaccgaagatgaagataacggcatttgatcccaagatattacccataccttggtcacccaagacagcgcttgggacatccattgggttcatacccaacaacaaagccaagataaacgccgtcacaaccaatgatacgaacgtgttcaacttgaacttaacaatcaagacaagcaatatcaaaattgcaattgccaacataacgaattccatcgtttaaactactccttaaaataggtaaaattatgccattcaaaacaaacgctcacagcacgggcataaagtcacgtgctgtgagcaacgttttaattgtttatctgtttagtcgaaaacaagtttacttgtcttccttcttgacgtgcttacgttggaagttcgcaatgtttgcgtactccgtttgcaattgacgtgccaaacgaataaagattggtgtcaactcacggtaaacttcgtagttttctgggtttggtgcgtaagtgtttgaatcaccaaccatgtcggcgataacatccaaactatcaaccattcccaaagccttttgtgccataaccgtcgcagccaaagcacctgactcaaaggccgttggcaccgtaacaggttgctcaaagatatcggccgtcatttgacgccacaaagctgaacgggcaaaaccaccagttgcttgcactgacttcaagtcaccaacaacttcttccaaggccaaagcaaccatgtagatgttgaagataatcccttcaagtacggcacgaaccatgtgagcacgcgtgtgattgtgtgtcaaaccaaagaatgaacccttggcgttggcatcccagattggggcacgctcaccacccaagtatgggtggaatagcaaaccatcagcaccagctgggatctttgacgcgatttccgtcaacaaatcgtacgtatcgacacccatcaaggcagccgttgacttctcagcgtcaaacatcttgtcgcgggcccaacggaagacatccccaccgttgttaaccggtccaccgacaacccagtgatccttgtccaaagcatacgtaaatgtacgtcccttaggatcaatcttaggtgcgtcagtcacaacacggatggcacctgatgtaccaatcgttaccgcggcaacaccaggttgcacagcgttaacacccaagtttgacaaaggaccgtcaccggcaccgtaaatgaatggcgtatcaatatccaagcccatcacagtagcgtattcggcaaccatgcccttttccatctcgtaaggttcaactgcttgtggcatttgttccttcttgataccagtcacttcaagtgcttgctcatcccaatccaagttgaagatgttgaacatacctgttccagaagcaattgagatgtccatcttgttagcaccgaacaaacggtggaacaagtattccttaattcccaagtagtgggccgcattgttgtaaacgtcaggcttttcgttcttcaaccacaacatctttgacaatggcgccattgggtgaattggtgtacccgtcttgctgtaaatctcttggcccaaaccagttgacttcaactcttccgtgtacttaactgcacgcgtgtcagcccacgtgataacacgtgtcaaaggctgccaatcagcgtcaaatgcgatcaatgagtgcattgctgaactgaatgacacacccaaaatcttgccaccgtttgcgccacgcacaacttctgtcattgcgtcgacgaaggcttcccaaatttcgtttaggtcctcttcggccatgtctggctcatcacggtacaacttgtaacccttgttggcactggcaatcacgtgaccttcagtgtcaaacaaaactgccttagttgacgttgttcccaagtcaactccgatcaagtattccattgttaaacctctcgtatctcaaaaaaatccacaaacttatgaatagtacttatctattttatgtaaaaacctttcacaatgcaaacgttttccacgaaaagaattttctaatatatcccaatgccggaacatttgacgcacaataaaaagcgcaccgtctcacaagaggtacgcttttcacattattttagatcaggtttgtatacatttcggttatctaatgcccactgacgttgtgaaaattcgcccggttctgtttcggctaacgcgttatcaaaactttgcatattggcatctaattcatccaactggtgcaaaatatttgcttccttaatcaacggacggacaggtgacccatactccatcaacccatggtgagctaacacagtatggcgtagcaccaacatatcttcgctatacaaatccaaatggagttcatttgctgccaaaacaatctgttcatcgattaggacaatgtggccaattaagttacctgccgtcgtatactgtgttgcaattgggccggttagttcaatcactttacccaaatcgtgcaacaaagcaccggcatataacaagctagcattgacacctggatactgcttcacaattgcttgggccaaacgagcaattgacaacgagtggaagccaagtccaccagcaaaggcgtggtgattgctcttagctgctgggtacttataaaactcatcatgatacttcgataacaagtggcgcacaatccgttgccacgtcgcgttagtaatttggaaaatcaacgccgagacttcttcttccatctcacttgccttcattggcgctgcattcatgaaatcactcggatcttgcggttcgcccactcgggttgggcgcattgatagaattttaagttgtggcttatcctgatacacttgccgaacagctgtcataaaaataaccatgccggcttgcaatgtatccgcctcttcttgtgttgcatcccacttcatgccacgtatttccatcgaccgatccgcaacagagacagccagataccgtttgccttgttgtgtgacccgtggatcaacttccttcaataggacaaagatgtccatgcgctcatcaacttgataatcgcgcagttgtttcacttctgccatgttacttatccccctttagctcattcaaatccaagatatggtgtcctgttgttcgtcgtgccgtaaagtacaaaatttgttgctcatctgttgccatttcagctagtacctgcaacatggtttcctgtcgcggtgtatcaaagtctacaaatgcgtcatcaatcataattggcaaggctaacgtgggtgcaactaacttaacgaatgccaagcgcatggcgacgtaaacttgttcagctgttccctttgacaattgcgtcacggtaaacatcaccccatcttggcgtgttactttaattaaagtcttcgtctgtgaaatttgcgtgtagttcccttgcgttaagcgtgctaataacgcacttgctgacgacaataactgtggtagtcgatcaccaattgctaagttaaacactcgattcacccacgcactcgctaaacgattcgtgaagtacgtctgcaaatcagtaatcacagtggcctcttggtttgctaacgcttgttgttgggcttcgattgtcgtatcagttgccaatcgctggcgttgcacatctaaacgcgcaagttgttgttgcgcatccgctaattccgtctgcaaccgcatcgccaatgctgacggcgcaacgtcgtcaaccgattcactcgccgctgccaaaacagttaaatcagcatcccccagttgttcccgcagcaaatcggcctcttgctgcttggcaagaatcgcctgttgctcctgacgacgagcttgcaaggcagcagcgccagccacatcaagggcttggtaaatttctaatagacgttgttggtactgtgcccgagtaactgcctgctgacccgctgttgtcatttgggcttgttcatccgctaaccgttggcgatattcagattccgtcaaatgataccctaaccaattcaagcgttcttccgcccgttgcatatctggcatcaccgtttgttgcatcgtcatcaattcttgaatacgcgcaatcaaaccatggagtctttgaacgtccggttgcgctgtaattatttgttcattagtcatgccctcgtagcctgctggcaaggtaacatccggtgccacccgctttggcatcacccggtaaagcacgtggccggctccggccaataggatgaacaagacgattcccgctaatagttgcccagcgattgccaagccaatcagcaaaataacaccgaaggctaaggccccaatgcccgcccgccgatattgcgccgcaacagccgttcccgtaccagtctgcaaagcttttacttgaaacggtgttaattcagctggcacagcttgccaatgatgcgtctgcaacagcgaatcacgttcatcttggaattgcgcttgttgcgtggctgcttgtcgttgctgttgttgcaacgttgcaaattcatcaagcgcgacacgggtctgattaagttgctcttgggtaactgttgtggtcgttggcacatccggcataacccgcaattgcgcttcgagacggtcagcctcatccgccaacgccgtatccaacggttcgtcagcatgtgctaattgttgttgtaattgctgccaccgttgatacaccggcactagctgctgacgcgcagcctgttcagaggcatcagccgtcaaccgactttgtcgctcggttaaggtggcaacttgttgacgagtggcttcataggcggattctaatttgttgacggacggacgattcgcaattgttgcttgcaaatccattctctggttagccagcgccgttaacgcttcattgataggtcggtgcgccgtcttagttgccccaaattcattcgtagcctctttatcccaacgattagccaacgcgagccattgttctgacccaggcgttgctagcgtacgcaggtgttccgcaaactcgtctggacgcaaagcaaaaatttgtgctaacgcttcctgatcaaagctaaagaccgctaagtataagtcacgatcaacaggtcccagcaattctgctaacgtctgttctgcatccgcaaattgttgccccgtcgcaaccgttcgtaacgtaactgtcgtctgcgtacgtcccaatcgtgtcaattcgtaatccgttcccgctacgtcgaacgtaatagtaccaccataagggccctgttcaagtggctcgtacgtattaatgcggcgacccttagcttgcgggaaaccaaacagcatccccaataagaactgatgtaaggtcgtcttaccggattcgtttaacccctgaatgatttgtaactgtgtcacaaaatcaaacgtctgatcgcgccactggccgaaaccgacaatgtgtgcttgcttaatcttcatcagtcgcaacccccatttcagttaaacgtaatttttcgataacggcttgctttagttccgccaacatagctggcgtcaaaaatgcctgcaatactgccgcatcctgtacttgttttaaaccaagctgttgcaacatatcatagttaaatacatcatcagccgtctgcgaccagtactgttggtccacagctggtaatgacacttcctcgttagctgccacaagtttaatgttatagacaaagaaattatcggttggcgttgatgcggcggttaactgggccaacaactgattattcatgatcaacgacaacagcgcactgtcctcgcttgtcactgataattcaaccaattgaaaatcatcatcattctgcaatgtttgtcgaatatgctggattgccgtcggtgcatctgatgctaaacggacacgagctgtttgccaaatcactggggccactggcgtaaacgtcggcaccaattcaccttgctccgacgtgaccaaataatagcctttgggacccgattcatttttatttaagccttgaatactaccggaataaccgatgaatggtttgtcctgcagtgtttgccgcacatgaatgtggccaagcgcccagtagtcatagtgcttaacttgcatgtcacttaacgtaaacggtgcataatcaccctggccatcttcgccaagcgccccgtgatacagaccaatgtgataatccacatcggcctgcttaactgggtaaagacgggcacggttgtcattaatatgccgttgcgtatacgaaaagccggtgatggccacacgttcttgcgctttcgtgactaaagttacagtcgttgtttcagctggaaagaccgtcacattctctggccaggtaggcaaattttgccaattagccacaaagtcgtggttaccaaaccctagatagactggaattcctgctgattgcaacgtttcgaatgcttgtcgcaccgtcaattgggcccgtgcatcaggtgtcgttgtatcaaacaaatcacctggcaatagtacaaaatcaaccatttcagcaatcgcatcgtcaaccaatcgttgcaatgctgtttcagttgcttgctgcaatgttcccttcagccaagctggaacctgtgttaaacccataaatggattgccaaggtgcaaatcaccagcatgtataaacttcattgtcccacgatccttttcacgttatatgtctttccattatcccatgttaggtatatcctaacaagcatctatcagtagtttgtggacagaaaaacgctcgtcattcgtgacgagcgtttccactaaacattaaacaaagttgcaatataatccattttcccccagacaattaaatccactgttataacttcggcgtcaaattcatatatcacgatgtatttaccacttactaaccaataatacgttaactcactttcaagattcaatacggccgaaagcgggcgtcctaatgtaacgttgtattgtaatttccgaatatcattaccaatacttttgacgatattagtagcaattttttcactagatgagacacttaacaccgtttggaaatgtcatctaaattttccacggctgtgcgagtgtactctaatcgtcgttctttcaacatggttagtctagtccaaatctttctcgtacttcttgatcagtaaatgtatcaccttgtaatttatcttgatgtccttgttcaatttccagcaataaacgtgctatatcacgttctcgatggatttcctttgacggctgaaacggcagcccttgttccgcgacggattgcttaagaaacaagctaatcgccgctgacaaatcaatccccaagtcattaaaaagttgcgaagcttgctgtttcaaagccggatctattctcatcgaaaatgtaccacttgcttgtgccatactgtcacctccgtacaaatgcatcaacattgtcattacaataacatgatttgtagaaaaaaataaagcgattgcaactaaaaaagagcagttgtcataagtgaacaactgctctttttaaagatttagtcttgaccgtacaattcagcgattggcttcgtgatgatgttgttaatttccatcaacaattggttaacggcttgttctgcttccatcatcgtcttcaacgcatcgtgcttgtccatctcaccagcaatttcttgccaggcagcaacttgctcaggtgcaggctcttgacctgcttgcattgattggttgatttccatttgtgcttgttggaagcgttggaaaaccgcctttgcttcggcgttaccgttcaaagcttcaaccgcatcgcgcaaagtcttgtattgtgctgtttcgcgtaagtcagcggcaacagcgtttacgttatcgtaaatgttaatcatattaagtaaatatccaatcttttattgttagttctattatcgcatactgtgcgttaattgcccagaatgttccggatgcctgaccaagctgcctttgccccatcctttacattattccaagccttttcagcaccctgcttcacttcatccccgatactattaatcgtgttggataccccatccgaactgtttgaagcaccgtcattagctgccgaaatcttttgacgcacactcttcacatcaaattgggtttgctcagtattcggaatgacttgttccagcgtcgtcttcatcaatggaccagctgttgccgataagtaagccggaattgattccccatttgcattcgaatcatatcccgtccaggtcgttacaacaacgtccggtgtgtaagcaatcgcccatgaatcagtcgcattcatcgctgttgaaccgtcaccagttacctcagttgtacccgtcttaccagcaacatcgtaaccgtatgggtcagctgacttaccggtaccattcgtgtacgtaccgaacatcatcgacgtcatttcattagcaactttcttcgaccagagacgggtatgcttttgcttggcttggacaattaccttaccggaagcatcaacaatcttggtaatgaagtgtgcctgactcatttcaccaccattggcgaaactggtataggcctgagtcatttgcaatggggtaacccccttcttcacaccaccaatggccaaagccagattcttatctgacttggtcaatggcaacccagccttcaaaccggcattataccccaccgatacgcccaattgatctaacaaccaaacggcaggaatgttataagaattttccaacgccacgtacattgggacatccgcgctggtgtagttgttgtaattcgaaggtgagtagccgttcgttccaaaactcatctgctcattcttcaattccgaatcataagagaaaccacgtgacaacgatggtgcgtaatctacaatcggcttaatcgtcgatcctggtgatcgatacatctgggttgcacggttcaaatcacggaaattgtgctcaccacgtcccccgacaaccgcgcgtacgccaccagttttcgcatccatgacaactgaagctgcctgtgagtcaccaccaaccggattcaaactctcgtcttcataatcatcttgcaagttggtttggtccgtctgatccatcgtggtataaattttatacccatcattcaggatgtcatcttccttcaagtcatacttgctaatggcttcattaatcacagcatcaaagaagtatggataattatagtttgaattgttaacatcgtgatccgctgcactaatttcataagacgcatacgtatccgcttgcgcttgggtcaactttttatcattaaccaaattttgtagcacttgattacgacggttgattgcattcttggggtacgtcagcgggtcgtacccgtttggcgattgcagcataccggccaacatcgccccttggttcacagacaactgtgaggcatcaacaccgaaatacttttctgccgcatcttgcacaccccatacaccgtggccgaagtaggcgttattcaagtacatcgccaaaatatcatgctttgagtattctttttcaacttgtactgctaaaaataattcacggattttacgggtaatcgtttgattttgcgtcaaaaaagcattcttaaccaactgctgggtcaacgtcgaaccaccagccgaggcattaatacctcgaatgcggtaccaaattgtggttaacgcaccacgcgccatacccgtcactgaaaagccgggctcgtgataaaaattacgatcttccgtagccaagaccgcattcaccacgtttgacgaaatattatcaaactgcacatacgtccccttttgaccagcaattgagcccgcttttttatcatccacatcataaatttcagttgatgattgtaatcgcgcctttaagtctgagacatccgttgttttagcttcaaatgtccctactgcactaatcacaaaaattaatgccaaaaaggccacaatcagccatctcgttagctggaaccgcgtccaaaacgggccgattttccgattaatccaggctaacgcactttttattcgttccatcatatttattgcatccaattatcaaaatctgctgctaatttttcggcagctgtgacagacgggcttgtcacgtaaattgtgttgtgccccgctaacgtcgcaacgacctcaggaatgttggcgtcatcaataattgccgccagtcgattaccatttccctgcgtcgtcttgacaattgtcataaattcaacgcgcgtaattgagaccgctgtttcggcaaatacttcctgaacatgcgctgtatccacaaccggcgcgtctgacatcacttgataacgtggtcgtccagtggcgtcagcccgccgaacaatgcgcatttctttaatatctcgcgagacagttgcttgtgtcacatcaataccagcgttttgcaggtggtgcatcagcccttcttgtgaatcaacgacctcacgcgccaaaatatctaaaatcagcgcttgtcgttcttgcttttttaaagccatggtttttagtcctctttttttgcatatataattttattatacagacttttggaccatttgccttaaattacaccaagcaaaaagtctgtgcaatcgacacagaccggggcttaattcaaaattgtctggatacctgtggcgaaacttgtcacgtgaaaatcaggaaaccgtcgcataaatttatcggtaataaacacattatcaaactggtaccgaaccaaaatttctaattgttcagcccgcatacgattcgtggttgcttcattttgaaatactgacaacggtatcacatcatacggaattggccgcccgacgattttttcagctaacgccagtaatgcttggtaactaatacctggcgccactggcaaatgacaagtttggccataggtgtctggggtattcccgagtaacgccaaggcccggctcgcatccggtgtccaaataaaggtgcgcaaggccgtatcactaaccggaatttgtggacgttcacccgctttgattcggtcaaagaccataccgttggtaatgccctgtgtccgatcgggtccataaaattccggtgcgcggccaataaccgcttccaatccctcgttcgtcatcgcctctaaaagccgggttgccattttcgccctaatgaccgatttacgaccaaccggtaagaatggactcgtttctgtctgtggtgtggcatctttttgatacatgtaagtgttatcaaagaatgccaacttggcatttgttttaatagccgcttgaatgacattttctgttatttgtaaaaattgcgcttcccaaacaggtgtatccatcggcaagccaactgtgaaatacaccacatcactgccctgaatcgcctggaacgcttggtcagcatctgttaaatctgcgacaacgacttgatcagtgtcatgaattttttgcggatgccggccgaccaatcggcgttcctttgtataattttgatacaactcattagccaattcgtaaccgatttgaccattgctgcctaatattgtttgcatcgttaatgaccaccttccctgtccgaaatataacacacttcagcgtctcacttgaaaaaccagaagaaaacttaatttttgacaataaaaaaacactcatcaacctcgctgctgatgagtgttttagctgttaaccgactttcgtgaattgcgagttatacagtttcgcatactcgccgccagccgccaacagatcatcatgacggccacgttccacaatattaccattttccatgaccaaaatttggtccgcataacgaatcgttgataagcggtgtgccactacaaaacttgttcgacccgccaataatttagccatggcatcttgaatcatgcgctcagttcgtgtatcgaccgaactcgtggcttcatccaaaattaagatttcgggatttgcaataaacgcacgcgcaatcgttaacaattgtcgttgtccctgcgaaatattcgtggcgtcctgatttaggatcgtgtcatacccttctggtaacgtgcgaataaattcatccgcatgagccatttttgcagctgtgatgacatcatcgtccgttgcttcaaggcgtccataacgcaaattatccatgatactaccttcaaaaagccaagtctcttggagcaccattgcgaaatgctggcgcaagtcttcacgtgtcataccacgtgtatcggcaccacgtaaccgaatcaccccactggttgtgtcatagaaacgttccaacaaattaatcatcgtagatttaccggcgccagttggaccaacaatcgcaatcatttgtcccggcttaaccgacatactgtagtcagtcatcaatggttggttaggctgataactaaaggcaacgtgttcaaacgtcacgatgtcatcagtcgtaattgggtcaaccggggttaattcggtcatttctggttcatccagtacctgaaaaatacgttcggctgacgcaaccgttgcttgaatcgtatttgttaaattagcaatttgtgtaatgggctgactaaattgattggtgtattgcaacatagcttgcacatcacccaaactaacggtaccactggccactttaatcccaccaatcaccgccatagctaaataatccaaattattaacaaaccgcatcgatggaaaaataacggtcgatacaaattgtgctttccaagcggccttgtaataatcgtcgttttgcgcatcaaacttcataatcattggttgctcttggttaaatgttttcaccacggtgtgaccagcaaaggtctcctcaacctggtcattcagcaaccccaaggccgcctgttgccgtgcaaaataacgttgtgatcgtggcgcgataatccggacaattaacaaagacaatggcaccgtcaagaaggccaccaacgataattgccagctaattgttagcatgaaatagataacaccaacaaacgtcagagcggaattgaccaattgaattaacgactggttcaacgtcccttgaatattgtccatatcgttaaccatgcgggacatgatatccccattttgatgtgaatcataataagaaactggcaggcgcgccattttatccttgaaatccttacgcaactggtaaaccgttccttgggcaacccgtgtcatgatgtactgctggattaccgagaaaagggcggcaattagatagagggccgaaacaagcattaaaatttgcatgactttatccatctgaatatgcaaggctgtgtgctgacgcatcgactttgtgacatcatcaaaaatgaccgttgttgcttcacctaaaacctttggtgctcgtactgataagaccacggaaatggccgtgataactaacgaaacaatgacaccagcccgataattaccgagatagccaaataatcggccgatggtttgccagaaatgaaccggcttttcaaccggttgattcatgcccacactacggccacgtccgccactttgaaaactacgcatcgacgcccacctccttcaaatctgcatccgacaactgacttcgcataacttcttggtaggcagggcacgtttgcgcaagttctgcgtgtcggccagcgccaaccattttaccgttgtccaacacaacaatcacatcggcattcatgactgttgcaatacgttgggcgacgataatcttaatggctggttgcaagcgtggcgaatcattaatcgccccacgtacccgactatccgtctcaaaatccaaagcagaaaacgaatcatcaaagacatacacttgcgccgctttaataagagttcgcgcgattgcaagtcgttgacgctgaccgcctgaaaagttggcgccgtcttgttgaacaaccatatccaaaccaccaccagcttcaacaaaatcagtcgcttgggcaattcgcagggcctcccacatctgatcgtccgttgccaatggtagcccaaactgcaaatttgaccgaatggtgccggcaaacaaaaccgccttttgctgcgtaattgaaactgcagcatgtaagtctgtctgagacaactggcgaatgtccacgccattcaacgtaatggttccagatgtcgcatctagcaatcttggtatcaaattcagaattgttgacttacctgaacccgtgccaccaataattgccatggtttggccagaggaaactttcgccgtcaaaccagacagcgctggcttctcagctcctggaaaacaatacaagacattatcaaatgccaactcaggcgctgttgcgggcaacttttgtggtgtggcaacatccacaattgtatcttcagtatccaaaacctcattaatacgatcagcagaggcttgcgcacgcggcaccatcacaatcaccattgacaattgcataaagctcatcagaatttgggtggcatacgtcaagaaggccaccaaattccccatcggcatcaagttagcaccaatcaacttggcacccaaccacacaataccaacgttcgtaaatgacaagataattgtcattaccggcatcatcattgcaaccgtcgtaaagacaactcgggctgtgtgcgttaaatcacggttggccgtatcaaatttctcacgttcaaacccatcgcgaccaaacgcccgaatgacgcgcaccccagtcaatccctgttggaacaccaaattaattcgatcaacctttgtttgcattgtcttaaaacgcggtacagcaattttaacaatcacaaagaccgcgattgctaagattggcagtgaaaaagcgaagactgttgttaggcgcgtattcaagcgcaacgccataatcatagcgccgacgaataggaacggcgacatcaacatcatgcgcaacgcagtctgaaacacattctgcaattgcgtcacgtcattcgtcgtacgcgtaatcagcgtggcatccccaaattttgacacattgctggcgtccatataagtcacttttttaaacaagctactccgtaatttcgaccctaacttctgactttgggtggccgcaaaaaacacatttaacacggcacccgtccaaccaagaatggcgataaccaacattaccccacccatttgccaaatatatccaatgttttgttttgcaatccccttattaatgatgtcggaggtaatcgtcggcagtgataaatctgctgacacctggacaatcaagaatataactgctaacaaaacagggattggctcgagatacttttttccaattcgtatcatttgctatggcctctttttcgttatagttaagccttattaaaccacacatctgccaatatgattagaattttttgttgtccttgtgttatttaagcaaggcataatgacatttagatttttcccaaatataaacaaaaagagtctgggacagcagtatctgtctcagactcttagtcattatttctaaattacatttccttaggcgccttaacacccaacaaacgtagtgattctgtcaaaacttgtgacacggccgttaccaatgccaaacgggcattcaattgctcgtcttctgccaaaatctttgagtttgcatagtacttgttgaacgtgcgagacaagttcaatgcgtacttggcaataactgatggttcgcgatcacgccatgcgcgacgaacaacatcaccaaagtcagccaacaacttctcagtttcccaaacgttctcatcatcgataaccaagttagacatatctagctctgggttaccagccttgcgcaaaattgattgcgcacgggcgttcgcatattgtacgtatggaccagtatcaccttcgaaacgaaccacttcttccaacttaaagtcgaagtttccaatacgctcgttcatcaagtcgtggaagacaacggcacccgttccaacttcatgcgcaaccaattccttgttacccaaagttgggttcttttcgttgatttgttgcaaagccaaatcgacagagtccttcaacacatccttcaacaagatgatacgacctgaacgcgttgacaacttcttaccatcaaccgtaatcaaaccaaatggaatgtgttcaacatcatctgaccactcgtagcccatttccttcaaaacggccttcaattgcatgaagtgttcacgttgttcgccaccaaccacgtacaatgacttgacgaagttgtagttcttcttacggaaaatagctgccgccaaatcacgtgtcatgtacaatgtggcaccgtcagtacgttgaatcattgcaacgttcaagttgtacttttccaagtcaaccacttgagcgccttgtgactcaatcaacaagcccttttccttcaacgtgtcgataacgccatccatcttatcgttatagaaagcttcaccgttgaatgaatcaaactcgatgtccaacgtctcgtaaagctccatgaattccttcaatgactcttcacggaaccatgaccacaattgacgggcctcttcatcaccatcttcaagcttcttaaaccaagcacgaccttcatcgtccaaagctggattttccttcgcttcttcgtggaaacggacatagtacttaaccagcgtgttgattggatcagctttcacttcgtcttctgaaccccagcgcttgtaagctgacatcaacttaccaaactgtgttccccagtcacccaagtggttaatcttgattggttggtaaccattggcctttgaaatttcagccaatgaatttccaataaccgttgaacgcaagtgacccattgacattggcttagcaatgttaggtgatgacatatcaattgtcacatgacctgcttcaccgtccgtgttgtgaccaaagtcttgattcatcaaaacagtttgcaaaacatccgttccaaatgtcaattggttcaagaagaagttaacgtatgggcccgcagcctgaacggccttaaaattggttgcgtcaattgcttccgcgaccgtcgcagcaatttggttgggcgccatgtgacgttccttagccaacaagaaagttggaaaggcaaaatcacccatcgttgaatcctttggcacttcaatctttgacaaaattgtcgcttcatctagttctggcacaaccgctgcaacggcttgggccacttgattcttgtagtccattgttattcctcttcttcgtcctcttcctcggcatcatcgtcttccaacttgatgtcttctggaatttcttcttcgtcctcttcctcttcgtcactcttacgtggcgcagggttgtcagtctttaccaaaatcttagtttctgacatgcgaacgacagcacggtgattgtattcgttaaccgttgccgtatcttctgggtcgttctccgtaatcaagaccaacaatgagtgctcgtaaatcttttccacgatacccttaaagtcgtgttcgaagttagcaaacttcttaccttcaacgaagtcgcccaagtcgaactctgacgtgttttctgcaggttccttagccatggcactatccccttttaattctctgcacatttaatgcatttatttattattagtaacacaaaaaatcgccgtaacaacggcaattctgtttattatagcaaaaatttgcttcaaaaactaggcttccaattcggaaacgacacgttgggcaactgcccaatcgttttcatacggtgtatcaacaccgccaatcttttgatactcatccaatcccttcgctgccaaaacgacaacatcgttgggaccagctgccttaatggcctcactaatcgcaatcgtgcggtccatttcacggttaatcaccacatgatcattggtaatcgccgcttggatttcatcagcaatggcgtttggatcctcaaattgtggatcatcactcgttaagtaaacaacatccgcaccctcgctgaccgcttgcccaatgcctggtcgacgcgaaacgcccttgttgccaggtgcaccaaccacaatcgttaacttctcgacggtctcattcgtgcggacaaaattaagtaaagccgcgattgaggcatagttgtgtgcatagtcaacgtaaattgtaccgtggttttgcgtcgttaatacttgcattcgacccgggattttaaccacttcgaggccttcatgcattgcatctgtgtcagcgccaaccagtcgcgtcgcaatcatcgctgccaaggcatttccttggttaaagtcacccggcatatccagatgatagtcacctgcaataccaaggcgggccgcttgctgaccagcttcacgtacagcgaaggtactaccctgcaagtccgcttcaacagtatcgtaatagacatctgcctttggtgaatcttcgtcctcgcgaccatatagccaaataccatcacgtggtaccgctagctccgcgtgctcaatcaattcactaaaatgatctgaatcagcattcagaatgatttgctcggagtgatcaaacaacatcattttgtgttccaaataatcttcaaacgttgggtgctcattttccccaacgtgatcgggactaatgttcaagaaaataccgacgttaaagcgcagtccgtaaacccgttccatcttgtaggcctgcgatgagacttccatcaccatgtgcgtcatcccatttgcgacagcctctgccatccaacggaacaaatccaatgattctggtgtcgtcaaatgtgcgcgataatggaactttgggtcggccccggtaataacttgtaacgtcgatgacaaagccaccttgtcgtcagtagccacccggagcatttcgtatgccatataagtggccgacgtcttgcctttggtacccgtgataccaatcaacgccaatttattttgtgggtaatcatagaaggccatactcaaaacactcatcgccgctggtacatcatcaactacccaagttggcaatccagtgtcgtgcgtgaacgacgtaggtgcaacgatggccttaaccccttttgcaatcgcgtctgttaaatattcagccttgaaacgtcctttgataaacaacaacgtttcaggtgctacatcatttgaattataagctaaatgcttgagctcacctttaaattctggcgtgctaatcaataaatcctgatcagccaaaatttctgtaatttgttgtgctgtgagtgccatcatttaactctcctatatctacttgttcttaatttgccaattcgccagctgaccgtaattgcgccaacatatcaatggcagcgcggccccggtgagcgtaattgacacggtccggcatgtcgatttcagccaatgtttgcccgttttccgtgaccatgagctcgtctaacccattacgcccgccacgcggttccagtgctaacgtgacaccgccacgtgcttggctgaaataacgctgaccagttggtgtaattaccacaaagtcggcttgcaaatacgccgtgcgatccgcgccgtctggtagttgtgccaacacataagcattaatttccgcatccccacgtagttgataggcttggaattcacgcatggttgtgacaccaaaatgatccggaatggctgggataaacatcgctgaatcgtccgccaaaatgtattcatccggtaacaacgcatgaatggttgccgctttaacttgcgcattttccgccatgtcatccgtggtttctgctggaaaagcaatctgatcgtgtaactcacgataattgatagctgttacccctaatgtttgcaagtaatctaccatttcagcggttttatgtgaattattcgatgcaattacgagtcgtgtcagcattacatttcctccgtttcgatagcacgtaaggtataaaatgaccccgtgacaacaatcaacgcttctgatgattcacgcacccgtcgagccaaagtaatcgctgcactcgggtcatccgcgatttccacatcgacgttgctcatcatcacaatcttagcggccagttcgtccgcagacatcgcacgatctgaatccggcgtcaccgcaatgactgtatcaacgtgtggtaacaattcctccagcatgtcgtggtattgcttaccttgtaataaccctaagaccacaactggcttaaatggtaaatgccaagaacgaatggctgccaccaaactgataatgccatctgggttgtgggccccgtcgaacaaaatattacgcttttcatcaaattccatccggcctttaattttgacgtgcgctaacgcttcagcaactgcgacgtcttcaatcgtataaccacgttcctttaagaccgtcacaatttgcaaaactgtactcaaattattggcctgataggcaccagttagtgacagcttcaacccttcaaattgatcggcattcagctccaaaccgcgtggcgatgacttaactatcgtaattgccggcttaggatgcgtgttccatttcgccccaacagcaatcgctttttctttcaacaagcgatacacttcgatatcctgccccggataattcacgatggttgcacccgctttaatcgcgcctgctttatcagccgcgatttcaagtaaatcatttcccaacaaaccgatgtgatcatatgaaattttcgtaaatgcaacaaccaatgggttatcaaccacattcgtggcatcgcgtaagccacccacgccagcctctaaaatcacaaaatccatctcagtgcgggcgaagtgatccaaggcaatcaatgtccaccattcaaacttggtcaacgtatcctcatcaccaccatgcgctttaatttcttctaagacatgttgatagcttttaacgaaagcttcttcactaatcatctcaccattcgttgtaatcacttcgcgatcattcaaaatggctggtgtcgaaaagtgaccaacctggtaaccagccgtctccaaaatactagccagcatcactccggttgatcctttaccattggtaccgacgatgtgaataacttttaattgtcgctcaggattacccatccagcgcaaaatttcttgcaacatgccgacacgattaccgtgttcatcaggtcttactcgccaagcaccacccatttttgatgtaatttgtcgataagtttcagccgcacccatgatttacctgtccttataataatgaagaagtcgtgatcgagtgaccattcacccgttccgtgttggcattcgatataatatggccaacaaaactgtttttctaacggttaattttaccatagatgggcagtatcggaacgcttggacttatcatttaccagctaattaactaattttagccgtattgttcggttatataaaatatgatggttttttcatatataaaatattaactttttcgtttgtcaacccggacaaaaactggtagattgttaagcgtcattcttttttacttttgaaaagtaagtatatatgaagggatttgcatatgttaaccatctcaaatctgactgtcgggtacgaatatggcccgatttttacagatttatccatttcatttaacgataacgaattgattggaattatcggaccaaacggggctggtaaatcaacattaattaaatcaattttgggcattattcagccaagtgctggtgatatcacattgaacaatgtcccggtcaccaatcgtctgcgccgtgacaaattcgcttatgtaccacaacgcagcgatttggacttagacttcccagtcaacgtcttcgatttagtgatgatgggtgttctatctcaaatatcacgttggcatagtgttggcaaaactgaagaagcactggtgcaccaggcgcttgaacggatggacattgcccatttggcaaatcgttctttaaatgaattgtcaggtggacaacggcaacgcgcattagttgcgcgagcattagtgcaagatgcggatatttacctcctcgacgaaccattcgtcggcatcgacgtggcatctaaagcccaaattatggatgccttacgcgaactccgtgatgcgggtaaaaccatcattattgtgcaccatgatttaagcaaagtcgctaaccacttcgactcggttgtcttactcaatcatggcattctaaatcaaggtacgcctgatcaagtcatggatgcaacgagcttgtcgcaagcctacggtgatcatttgatcatcatggatcgtcacaatcacattgtgcaaggaggctaaaatgacagcactattgaattttttccacgctttcggacagtacacttttttgcagaacgctttgctcgctggtgttatcattggtttggtttccggcgtgattggcgcttttagtattttgcaagggacggcactaatcggtgatgccatgtcgcacgcggttttgccaggtatcgccatcgcggcgttactcggcatcccctactactggggcgctggtgtgtttggtttgctagcggcgttgatcattaatttcattgccgaacacaccccgttaaagactgatgcggcgattggcctcacgtttagtagcttctttgcattaggcacaattatcatgacagcaggtcactcaaccaccaagttaactgatattttatttggaaatatcctcgccgtttctggtggtgacctcatttcaagccttgtgattggcttaattgttatcttagttgttgctattttctaccgtgagctatacctcacgacttttgatcgatcatatgcgcaagcgcaaggtattcgtgcaaatctattccgaaacctcttggtcgtcatgattacattggttatcattgtggcattacgcgccgtcggggtcattttggtaacggccctgctcatcacaccagcggcaagcgcccgattattagttaagcgtttccagccaatgatttggttatctgcggcatttggtgtgttgagtgcttttgttggtttgtttctcagttacacgtttgactggccatctggtccagccatcgttgtgactggtgcggttatttttattttatcgtttattgctcatacaggtttgcgattgcaaaatcgtcacgcctagtctttttaaacaattaggagtttagttttatgaagcgcattattgggattattgttgcccttgttgtggttgttgcggttgcatttggtttgatgcaccgcaacgatcagtcagatggtcgtgcagctgacggccgtttgaacgttgtctcatcattttcaattattaatcaaatttctgaagaaatcggtggtaagtacgttaatgcccacacgattaccgcaattggggctgaccaacacgattatgaccctaccccaaccgatgttaagcgtacgcaagacgccgcaatcgtctttgcaaacggcttgaacttggaaaagggtggttcaggttggtttgataagttgatgaagaccaccgataagcacgctggtaaggaaatcttcaacgtgacggacggcattaagacaattaagctaacgacatctggtgtggctggtcaagataacccccacgcttggaacggtgtactagaaggtaagacttacgctgctaacattgccaaggtccttgaaaagaaggatcctgcccacaaggcttattatgctaagcgtgcaacggcttatgaagcaaagttgcaaaagttgtatgacaagtggcacgctaagttcgctgctttgcctgctgatgataagaagttggttacgcaagaaggtgcaatggcttacttcgcccgtgactttggtttgaagccatacttcatctgggaaatcgatactgaatcaaatggtaccccttcacaaatccgcacgttggttgaagctttgcaaggcgaaaaggttcgcgcaacctttgttgagcaaggtgaatcagacaagccaatgcaaacggttatctcacaaatcaactcacacattgctggtgagttgtggacggactctgtttcaaagaagtctggcgttgtcccaacgtactacgatttgttgaaccacaacgcacaaacaatctatgatggtttgacgtcaaagtaaagtattacaaaagcacccgcttaggttttaggcctaaacgggtgctttttacgtctataaaaaacgccgtccctggtgcaggacgacgtctaagattacgctgtacctttataatagtctaaattcgtgaaaaaacaactatttgcgtgcgatgaaaccatgccccgccatcagtttatatcacgccgtgtgatgacattatgatttaataatgttttcaatattaaatcatgtgcctggttttgctgcatatcacgtagcgtcgccaccaaatcacggtcacgcgtcgttaaatctgggctaagcatcaacgactcaagatattccgctgcaatcgaggcttgttcatcgcgcttcgctacaaacacaggtcgcatctcttcaggatcaacataaaatgatactgatgtcagaccctcaccgcgacgaccatctggttgtgacacatcaacatgtaaactctgtcgctgcgtggcatcagttggcaaggtatctaattgtgccaatgcaattgccatatcccatgctcgcttagtatgatgggctaattgttggtagaaagcgtgctttgtattagcaggctgcgcgacactggttttcttttttccaaacatgttcattcctcacaaaagagcctaccagaacatctggcaggctcttttttacttgtgttcatccaataagattggggccttaatcaagttatcacttggcatatcatcaacattcgcaaccattgcgatgtgggcgtgataattcttaaagacgaccggtgcatccccaccgtactcgccatccaagttaatcataatcttagcattttcatctaatggtgtaatttcaacattttctgattttacatacaacaagtttggatcatcgacgtgcttaccagttagcacttctgaaattaagcccaagatttcagcgaactttgttgtcttaaccaccaacaacgtaaacttaccatcgtccaacttagcatctggcacgatttgttcaaaaccgccgactgaattggttaaggccaggaaaaacattgatgaagtaccttcaaattcaccatcgtcatacttaacgcgcaaattcattggtgccacacgagtcaacatttcagcacccttcacaacataagcaaggtacccatacattgacttaagctttgatgggactgaatacgtcaattcagacaatgagccaccagctgcgatgttaatgaaatacgtgtcattggcgcgtccaacatccatcttagcggccttgccctttaggatgaccttagcagccgctagcggatcctcacgtggaatgcgcaaagcacgtgcatagtcattggttgtcccagccggaataatcgccaacattgggcgcttatccaatggcgcaatgccgttaacaacttcattgattgtaccgtcaccaccggccgcaatcagcaaatcaaacccagcttccgcagctcgacgcgcctcatttaacgccgaattaggctccggcgttgtagcaaacgcactggtttcataaccagcttgttcataaacatttaaaatatcaaccaaatcacgacgaatcgcctcacgcccagaggttgggttataaatgatacgtgcacgcttcatagctgtgtttctcctcttagaaataattatatgtactgcccggtatagagtttcctataccgagcctaaagttagctttacaacagagtgttgcttgcgcttcttattcaggcttacgagcttgcaaaccagccatcaacaattcgttaacaacatttggatttgcattacccttagtttccttcatgatcttaccaactaagaagccaaccgcacggtccttaccattgtggaagtcaatgattgattgctcattgtcatccaaaataccgtcaataattggcgtcaaaacagctggatcagacaattgcttcaagccattggcctcaacgtattcgacagggtcttcaccttgcgtaatcgctgcaaagaccttcttagccatcttcgttgaaatcgtaccgtcatcaatcaacttaatcatgccggccaagtgtgctggtgtcaaagcagtctcttccaaatcaacttgcttctcgttcaagtacgcgttgacatcacccatcaagtagttagctgagcgctttggatcggcaccttctgcaacggttgcgtcgaagaagtttgccatcgccaatgtttgcgtcaaaacttctgagtcatagacttccaaaccaagttcatcaacatagcgcgccttacgttcagttgctgattttggcaacttcgcacggacttcttcaacccattcgtcagtcacgtggactggtgtcaaatcaggttctgggaagtaacgataatcatcagccgtttccttctcacgcatcaagattgtctcaccagttgcttcatcaaagcgacgtgtttgttgcttgattgtgccaccagccatgtaaatcttagcgtgacgatcttcttcgaacgccaatgccttacgcacatagttgaatgagttcaagttcttcaactcgacctttgtaccgtattccttagaaccgactgggcgaattgagatgttagcgtcgacacgcattgacccttcttgcatcttaacgtctgagatacccgtaaattggatggcttgacgcaaagcttcaaggtaggcgtaggcctcgtctggtgatgaaatatcaggggccccaacgatttcaatcaatggtgttccttgacggttcaagtcaacatatgagtagccatccgtcccgtgggtgttcttacccgcatcttcttcaacgtgcagttccgtaatacccacacgcttcttctcaccctcaaactcgatctccaaccaaccattacggccgattggttcttgttgttgtgtgatttggtatgccttagggttatctgggtagaagtaattcttacggtcccagtgcaaatcacgtgtcacctcagcattcaaagccaaagcggccatcataccgtattccaacgcacccttatttgcttgtggcaaaacaccagggtaaccccaatcaatgacatttgtatttgcgttaggctcagcaccatattgtacaggtgatggtgacattgcctttgagtttgtcttcaactcaacgtggacttcaagaccaatcgtcgtttcaaaattcggcacagccattacttgttaccccccggtacttgttcgaacaaacgtgttgcttgctcataagcgtaggcagcacggtaaattgtctcttcttggaagcggtttgcaataaattgcatgccaactggcaaaccgttaacaaaaccagctggtactgacattcctggcaaaccagccatgttaactggaattgtcaaaacgtcattcatgtaagtgacttcaggatcatcctcattggccccaaagttgtaagcaacatttggcgtcgttggtgcgataatcaaatcatacttcgcaaacacattttggaagtcttcgttcatcaatgtacgcacttgcgcagcctttttaaagaaggcatcgtaagtaccagctgacaatgaatacgttcccaacatgatacggcgcttcacttcgtcaccgaaaccttgtgaacgcgtttggacgtacaagtcatccaagttcttcacaccttctggacggaagccgtagcgaataccatcgaaacgttgcaagtttgatgatgcttccgctgaacccaaaatgtagtaagctgccacgccgtacttggtgtgtggcaatgacacttcttcgacttctgcgccgagctcttgcaacttagcaataccagccttgattgtggccttaacatcggcattgataccggccccgaagtattccgttggcaccgcaatcttcaagcccttgatatcacccgtcaagttcgctgtgaaatcaggcaccgcaacatctgatgatgtttgatccttctcatcttgaccagccatcgctgccaaaacgcgagcgttgtccttaaccgtgcgggtgaagacccctacttggtccaatgatgacgcaaaggcgataacaccccaacgtgatacacgaccgtaagttggcttcataccaacgataccgttaaaggccgctggttgacggattgaaccacccgtgtcagttcccaatgcaaatggcacttgaccagctgcaacggcaacggcagatccaccagatgaaccaccaggcaccttggtttggtcccaagcgttcttcgtcttgcggtaatatgacgtttcgctggttgaacccatggcaaattcgtccatgtttaacttaccaacgccaacagcaccgttagcgcgcaacttttcgataaccgttgcatcgtaaattggcttaaagttttgcaaaatctttgaagcggcggttgttgtgacacccttagttaccaagttatccttgataccatatggaatacctgacaagatgttgtctgggtcaatgccggcttcatcaattgccttagcttctgccaaagcttcatccttcatcactgtgataaaggcttcatacgtatcgtcagttgcagcaatgtttgacaacgttgcttccgccaactcaacggctgtgatttccttgttcacgagttgttcgtgcaaggtttccaaatctgtgtgcaagaaatccattagccctctgctccttcatcaagaatagctggcaccttaatcaaggtatccgtgtgttctggtgcgtttgccaacaattctgctgactggtgggcgtttacagccacatcttcacgcaacactgtccgcatttcagtaactgaatacgttggtgcaacaccttccgtatcaacttctgacaatgtcgtgaccacttcaaaaatcttctccaagtgatccgtgaacatgtcagcttctgcgtccgtcaaagtcaactttgccaagttggcaacgtgttcaacttcttcacgtgtaatttgctcgtttgccatgtgcattcctttcaacgctgtaataattctatcttaccaaagaataacgcggtttagtacatatcgtcagacaattcgtttttctcttcgcgaacttggaaacgtaacccctttggatagaagtttttcatttgaccatcaaccaacttaccaaagccagtaccgtttccaccaatttctagcaaataccaaccatttttgtattgctcacggtcacgaatcataaatgtatcaccgtgaacatacttggcccattcttcatcagtcacttcgtagcgacgggtgaattgatccgggtgcaatgctaacgccaatgccaaacttggctcaaaacgcttctttttcagcgttcctaagtggaccccaacccgcatcacttgtaggccggtcaaatcaggcgttccttctggggccgcgtagacttgatcaccgaacgcaatcaacaacgctgggtcgtaatccggtaagaaatcagttcggaaatcttgccaaagtgctcgttggtccttcgtcaagtttgacttcgccaacttaggttccttagcaacatagtcatcttcggtttgatttgaaaccaacttggccatgaagtgtccttcaccatctgagtggtgtgggaacaaacgggccgtcttcttcaaatcagggttcccgtcagcccattctggcttaccatcatccatgccttcatatttatctgcatcgacaatttccaagtcaggacgttcactgattagccaagcaataatgcgctcatcttcttcaggggcgaacgtgcaagttgagtagaccaattggccacctggctttagcatcttaactgcttcttccaaaatctcgcgttgacgggtggcgttctcttctgggtagtgctcgtgccaatacttaatcgcagcgggatctttacggaacatcccctcacctgaacatggcgcatccaacacaattttatcgaagtattgtgggaacttcggtgacaattcctgtggtgaatgattcgtcacaatcgcgttttgtaccccaaaacgttcgacattttcactcaagattgctgctcgcttacggaagatttcgttagacactaacaaacccttttgctccataaacgatgccaagtgagttgtttttccacctggtgcagccgctaaatccaacacgcgttcacctggcttaggccgggctaattcgccaaccaactgcgcagatggttcttgtgagtaaataacacccgttgtgtggtcaacggagtggcctttcacggccccatagttgccccattttccccatggtactttgccatcggactcagtgtcatataagtccatattggccttcaaggggttctggcgaaatgcctttacgacaggcttatcaaatgattcgataaatgcatctgcctcatcgcctaatagttggcggtatttttcttcaaatccttctggtaactccgccatcacagcgctccttttattatgtattcaaactctattttacacgtttttactgcgcaaaaaaagcactgctcttgcacagtgctttcacatttgttaagtgatttttaaagggacaattttagtaacttttcaaggtaacgtgccagcccatcttcttcgttggtatagtccgtcatatcatccgcgatggcctttaattctggattcccattcttcatcacaacgccatgtgtggcatagccgatcatctcgaaatcattcatttcgtcaccgaacgcataaatatcatcgcgcttaatatcataggctttgcgcaagacatctaggccagtatcctttgaaaccccggctggcgcgacttcaagcactggtgactcaccaccccatgtcttgacattaacacgatcagccccgtaacggtccgtcacgaaatgttgaatttgtgattgatgcaaggcattttcggcgtgaatcagaatggcattaacatccgtctgtagattcaagcggtctaacattttgcggcctgtttcatcttgtgggaagaaaatagcatcttccgtcccacgctgcggaccattaccgtttgcccaaacatcattcttactttcggctaccaccgtatcaatccccatcatctgcgcattttccaataaatcaaacgcaatttcacggtcgatattaaatgaatactcatgatcccagtgttgataaggcttgtgccccaatgacccgttaaaattaatcatcggtgattgcaatcccaacgtgtcatagatgtccattgacaaacgcactggtcgtccagtcacaatcgaaacaatgtgaccttcacgttgcgcagcttgtaaagtacgacgcgtgcggtcagataccttgcctgcgtcatttagtgttgttttatccaaatcaatgccgattagcttacgatccatcgtttgccacccctcgttctaaactcaattgttaccatggtagcataaagtggcaatgacgcggaaaaataatcctatttttgtgtgttgtcctgtaatggcacaattaactggctttgttcgacatcgattgtgtaccgaatatcttggttaccgcgcaccgtcatttcaaagtcagtgccataaacaatcacgcctagctgatgaccagccggcaaccgataacgggttggttgcagggtaagcgccacatcaacaaattcgtctggcacaaggtcatccacacgccatggcgctgtccgattctgaagattgatgtgaccaatactaatcatcttttcagtcgttggttttgccaattgaaattccactaatggcgtcggctgccaaccagtaccacgatcaattagcacgccctgcggttgtggtgtcgctgctagacgccgggcttcaccataatcaaccagcatggcgctcactaagccaacatctgccgatgacttaatccgtacttgtaacgtcacttcaccatcaatgaccatatcctgttcaaaagcaggttgcacaaaaaccacccggttcacatccaacttgtcattctcacgttgcaacatctgttgacgccaagcattgaaatcttgcttatacgtggcaaaatcgtccgcaatttgccagtcttcatactgaactgtcgccgtttcagcaactaatggcaatgttgtaggcgtcgtcgtcccccactcatacccggtctcccaagtctcagcttgatcatttgcttgccaagtaacatctggtaactggctagctgcttgattttggacaccgtagagcttatagctcaaccacaaattcatttgatccgcaaaatcaagggagcggttattgttaatgtaaatatgttgtccttggtgaagatacagtttcttaactactggcaatttttgtaagttttgccataagcagaacacctgacgtggtttaacattccaatcattcaaaccatggaccatcacaatatcagcctgaatatttggcacattatttaggtaattacgcgcatcccagtacgtattgtaatcaccggtggtacgatccatatactcagccgttgcatgctggaacccatgccattgcatcttggtccggtgccaatccgcactatccaacatgcgcgaatacactaattccgccaagacatccatatcctcgccagggaaaccaccgggcgcaatgaccaaaccgttatcacggtagtattgataccaatccgagatcgccgcttcagaaatcaccgtttccagaccgcgtacgccggttgttgccaccgcggtcgccagtgtccccaagtaagacttacccgtcatcgccactttaccattcgaccagttcgctttaatagtttgaccactgtgcttatcgatgaatgccagccgatcgcctgccaaccactcaacaacagcccgcatgctagccacctgttctggtgaccctgtatcctgcatcccgtccgaatgacgcgtcccgaccccagctgaatagacaaccgcaaagccacgggccaagaaataattgtttaaatcaacatgtgacgtaccagtaaacgattctgtcgtttcagtcacctcgcctgcaatttcgtgggcttcgggcaaggcttcttgttcaggctcatatttaatctcttcatacgtcaacgtgttgggtgttttgcgtaacagtgcgacgtcaacattgtgaaccaacgcatcattcgcttcattatttaacccttggtaataaggtgacgcggtaaagagcgttggcaccttaacgccagtatctggtcggattacctcggcgcgcaccaaatctcggacaccatcgccatcagtgtcaacgtccgtctcaacgtacaccacttcacgaattaacgcgctcgtatcaaatgtggccattgccttaccattgaaaaacagtggcacgttgttcttcataaaatacccacgactagctaggtcgtcaatgaattgcagcccattacgtgtatgcgtcaccaataattggtaccaagctgtcaaaacatcatccgcatcccaacgtcccgccttgtgatagagtggcaaattaatggtcgccacggcttcagccactttgtcgaacgtataatcaacatcctcaacaaaacctaacaattgcaaagcgacggcgttaaacacctcttccgtcactggcgcaccactatttaagtacccagccaaatcctcacgagtgttaatggcaatatcgcggaacttcacacgaccgtcctgcacttctggaaaggcaatccgtaataactcccgccaaaccgccgtcgcattttttgcgtgcgctacttgaactggttcatcatagaaaccgattgtcgcgagttcttttaattgtgtttcaaacggtgtgtcgaccaccgcaaattgattaattttcattgctgtcacccctttaatagtctgattataccaaagattaaaaaattattagagcattaacgtgaaaaacacggcgtctcgttctgagtcgccgtgttttgctaatttatttttttaattgaatcatgccattagttgtctgcacgtgtagcgctttattttgatcacctgtttggtaatctttagcacccgccggcaagtcaaatccttgggccgtcaaatagccactatccgttttaattgccatcccaggtgcagtcaccccttgcaaaacaacttggccgttttccgccgtaacatcgctcgtttccgttaaggtcgtattgtttagctttacctgaccattatcagttgtgatatgcgccgacttcaaggtcacattctgcagacgcgttgccccgttttctgcttcacttttcactgtgtcgccggtaacgttctccaaacgaataccaccattatcattgcgcaaaagcgattgcgtcacagccaagcctttcactgctatgccgccattttcactcgtcaaatccaatttatccagtttcaccccatcgggtaccgtaatagtgacagccggatcataactcatcgttgtcatcacattatcctggtccgtggcatggacagtcagcacgccatcgcgtaactgcgtgctcatgtgtgcattaatggttgtcattttgacacgccattctgtcccgcgcttgatttcaacgtaattattatcattcgtcacccgaagctgtttaatatcctgaccggcaaaagttttattaatatgcttaatattgaccacctttgggccatcatgccaagcaacattcagattggcaccgctcatgtagctaccagccatcatcacgccaccaattgccatcccaacaccaccaataatcaacgcgtgctttaacttcatcactttaaccctccgttactggcgtgtgcttctttgacaagaaacgtcgaccaatccacttcaaaaatgtcacaaacatctcaaacaacgctttcgtcacggcccaaactagcggcgtgaagaaaataactgctgccgtcaaagcaatgcccaagcccatgtagaatatgccagtcccaacggcttgcatgagtacgccaataccaagtacaaacatgaacaaaccaccggctaacgccccaacgattcccatatagataccagctaaaatcatcagaaaaatagctaacacgctcataataccaaccaccacgacgatggccagtggaatcaaaatcggtgaggcaaagagaccgaggacaattaataaaatcatcattgtcaaattctttgtgcgcttacctgctggcgcatcctgtgcggcatcgttatctgactcgataaaatattcgacttttaacgtccgggcaaattgcttaggtgaaccatacttcgccacaatttcatcggttgtcagccccgcatccatcatttgctcctcataaaactgcaagagttcatcgcgttcatctgccggaatacctgacatatttgctttcacttctgctaaatactcattaaccatattgcctacttctcctccaatagtgaattaatagcttggcggaaatcgccccaagccgccttgatttctgttaaatgttcttgcccggtttcagtcaagcgataataacgtcgaatgcggccttcaaacggctgatcatatgtctccagataaccatctttctttaagcgtcgtagaaccggatacatcgttgattcgctgacacccaataaatcctgcatcgctttggtaataatatagccgtacgtatcttctttagctaatagtgctaacacagatccgtccagcaaagcggttggtacttgaatgttcatcaccgcatctcctttgttttatataacactatttatcgtatagcattatgttatatgagatataatgttatgtcaagaataaagccgtcagaaattcttattactgacggctttactgttatctagtttaaatagggcacgggtttcaaattatcttatcgtcgctccagtttaatcagttccaacgttgtcatgatgacctgccccttccgaagcttcgtattataggactgcacatacatgccatcttgcgaatcagtccccatcatttcattaataaagccttttttggtgcttaccaaattaccagaaccttgtacagcagtaatcttatacttaccaggtttaatatctttacccaccttatacacacccgcatgtaggtcacctgacttaattgccttacgcttggttaccgcttcaaaatgagccgtaaccccactcaaagaaatattaacctttttcttcaaatccaaagtataagacgagacatacatatcagtacccacatctgcattaggatcacctagaatgacattaatatcgcctgtcgaacttgtaaaattcccactcgtaccattagttggtgtgacaatgtatcgaccaggtttgatatctgttccgactgtataatctcctgcagtcaagtcggtcgtcttgccggccgcgctaacaactgtcatcatgccaaagactgccgctccaacagctaatacgattaaaaataattgacgtaatttcatcatttcaatcctcccatctgaatgtacgttcagtataggaatcctttatgaagatttatcgttcggtgctcacaacgataaaatttccgcaaaaaagcacctcaatccgaagactgaagtgcttactaatgtttatagccagttcgcaataatttgaacaaccagttgaatattcaaacctgttagcacgataaagaccaaccaagctagaattgtcatccactttgggttaacgaaatcttcccccatcaccttcttagatgatgtaaacaaaatcaacggtgccatagcaaatggcaaggcgattgataggaacacctgtgagttgatcaacaacgtatccaactttgcttcatccccaccatacatcaacgtaaaggcgatgactggtgccaaggctagtccacgggtaatcatacgacgagcccacattggaatcttcaaacgcaggaatcctgccatgacaacttcaccagttagcgtacccgtaatcgttgagttttgtcctgatgctaacaaagcgaccgcaaacaacgttgacaaaaccggtgatgcaatcgcaccagcaaccgtactatctgacaacgccgtgtacatttgaccgaacgttccaactgaatcaccgtgaccgaagaacaatgatgctcccaaaatcaacaacaatgagttaacaacaaaggccaacgtcaattggatgtttgaatcccaggtcatgaagcgcaccgcttccttcaattcagccttgttttcacggttgatcttacgtgtttgtgcaactgatgagtgcaagtacaagttgtgtggcatcaccgttgcaccgacaattcccagagtcatcaacaatggtgaatcaacacccttaggtgcatgtgtgctaacggcttgtagttgtggcacataaccacctagcatcgccacgatatctggatttgatgacaccaccaaataaccaaaaataaacaagatggtcaaaatcaatgtaatgacaattgcttcgattttacggaaaccaaaacgcatcaacaataatagcaaaataacatcaaatgccgttgtcaaaacagaggcaatcattgaccaaccaaatagcaagtgcaacgcaatggccccaccgataacttcggcaatatccgttgcaatcaacgctaattcagtcataatccacaatacaaagccacctgactttgatgtgcgggcacgcgtagcttgcgccaaatcttcgcgcttcaccattcccaacttaccagccatgtattgcaacatcattgcaatcaatgatgagaccaacacaactgacaaaagcgtgtagtggtagttcgcaccacccgctactgatgtcacccagttacccggatccatgtatccgaccgcaaccagtgcaccaggccctgaaaaggcccacaatttgcgccaaaatgaaccgttcgttggcacttcaactgaaccattcacgtcgcctagacttgcgtcagcagttgcatcgccgacgaagtgcttctttgtcatttcttccttagacatgacaaacctcctatatacgagaaaaagtcgtagtgaggagggttccccagtgtactattcacttttttagttaatagtgctaaacaaatttcataaaggatttcgtccaactaaccatgttagttgaaggcttatgactttcgcttaaccggggctcctcacccgcatttgctagtatacaggtcatattatgcataagcaaccctattttttcacatctgtcaaaaataattcaataacgtgaattattctagttttcttaataaaaaataagcagagcaatcatgctccgcttacaaattcttcatatttatgttacttactttgcgtcgacgaccgtgtcacagcgggcaatcattgacgacactttggcgtgacgagccacataaacggcttgtgacccaagtgattcccagaagcccttctttgagtgggccccgataataatcaaatccgccccaatcttaggcgccaagacgtcaactaagacttcaccagcccgttggccactatcatataccacttcaacctgcttcacgccgtgtgactccgcatatgccttgtaacgatcaagattagcagccaagttgtcttgcatcatttgcaccgctggcaaattcaacacatcaaccgccgacaattcacccaattccagaattgatgcaatgtacaacgtcgcatcgtcctcaattgcctggtgaatcgcattggccaacgccacatgtccttgttgtgactcatcgacaccaaccaaaatcttttggaaatgcattggttcgatattcaagctcaagtcttctgtcatagtgatatcccccatatctattgttatgggctcagtatagcaaattggggcagtattttccgtgccgaacccttgaaaaaagctggataccattggcacccagcttcacaaattattctgttttacccgcttcagcgttatcacggaaagttatggccattcctgctaataatttacgcataaattggtcaccaacaaccaaatatttaggatgtcctttgcgacgtagcatcgcaccgacttcccccttggtgactgtaaagccatcggccgtccaaaaatcaagcaagtcttcgtttgaataagtcatcgcaatcttcaactttttgatcacaacgttattaatatcattatcgcgttgcatactgtaatcaggctcgattggattaccgtcttcgtccttcttcacaccacgttgcgaaataatcagcccattcataaagacttctaagtcatgccgactcaacttttcatcacgtggcgtatccggttcttgcttcgtcatgatgtcttgatactgttctttagtcattttcagaccacccagttcaaaaattttaatcatgtcggcattcttaatattaaaaataaagcggatgcgacgcacaatatcgttattattcattacaaatctctcgtttcgattgaaaaaggccgggactcacccagcctttgcaagcttaaccacgtgaggcattcacttgatcaagcgttggaattgatggttgtgcaccggcaccttggaccgtaatagctgccgctgcatttgcaaagcgcactgcatcttcaacattacgcatgtcggcgtcaagcttcgttgttagcgcaccgataaacgtatcaccagccgccgttgtgtcaactgccttaaccttcaaggccggcacaaacccattttcaccatcagccatatggaagtacgagccacgttcaccaaccgtaataatcacattcttagcgcccatttcttgtaggcgcttggcggcactttccattgataggtcatcagttactggaatacccgtaataatttcagcttcggtctcatttggtaccaccaaatcagtgagtgccaacaattcagctggaatatccttggttgctggcgcgggattcagcaccgtcatgacatcatcagccttggccgccttaaatgcgctcagtgtcgcaaccattggcgtctcaaattgggcaatcaacacgtctgacgctttaatcgttgcatcggctgctgcaacatttgattcattcacttggcggttcgcgccaccgagaatcaaaatggtgttgtttgagtcggcctcaagcataatgtacgcagcacctgttgcaacacctgatagttcagccacatgggctgtatcaataccatccgcttgtaatgcatctagtaatagctgtccgttctggtcatccccgacggcgccaataaaatttacgtccgcacctaaccgctttgctgcgaccgcttgattggcacccttaccaccaggcgccgttgaggcatcatccattgccaacgtttcaccttgttgtggcaagtgtggaatgtgcaaaatggtatccgcattcaacgaacccaatacagtaatcttcttcatcaccaatgtgctcccttatttctagtcaatttagtatatcaaaaaagatggccacttggaaaagcgaccacctttcttatcaactacttattgttcaaaatggcatcaatcttagccagttcttctgcagacaaggtcatgttgtccgctaccttcacgttgtccaacaagtgatcaactgaagatgcgccaatcacgattgatggcacgcgcttgtcacgcagcaaccatgccatcgccaattgggccaacgtctgaccacggtcagcagcgaccgcattcaaagcgttcaacttcgcaaccgttccctcaggatcttccttaatgaaagcattcgtgcggtgcaacggcatatcagctgggaacccatccaagtaacgatccgtcaacaagccttcagccaaaggcccatacgcaatcagaccggcatggtgcttatccaattcggccaacatatccgtcgtttctgcttcacgattgaacatgttgtatgacatttggttaccaatgaatggcgtgtgcaactcatcaaaaatttgaccgatttcagcaacttgttccgtggtgtagttcgaaacaccgacatacaatgccttaccttgacggacaatcaaatctaacgcctcagccgtttcacgcaaatttgtatttggatcccaacggtgtgcgtagaaaatatcaacatagtccaggtgcatgcgttgcaatgacatatccaacgctgccgtcaacgtcttcttaccagagaattcacccaaaggacctggccacatgtggtaacccgccttggtggtaatcaccaattcgttacggtatggcttcaaatccttttcgaagacagctccgaacgtctcctcggctgaaccatcggaaggcccataattagaggcgttgtcaaatgaaaaaataccattatcaaacgcttttaacatcacttcacgtgagttagcaagtggcttttggtcacccaaattacgccacaaaccaaatgatagcgctggcaaaatcaagccagaatcagccacacggcggtatggcatcacatcatagcgattatcagctgctgcataaaccattgtaaatacccctcaatgttcattttattgcatgttatttcaataccatcataacatattataatttggcatctggattattccgtgactttagcaagatatccaacggacgattttcatggatgcggccgatggcgtcagccaataatggtgcgactgacagacgcgtaaacttcgcactctgctttgcctctggcatcaataatgtatccgtgaagatgtagtgggaaatattctcgtcggctgccaagcgttgggctgaatcacccgataagacggcgtgcgttgccacaacgaagacatcggttgccccgtttgctcgcaaggcgcgggctgtcatttgcacacggcgccccgtatcaacaatatcatcgacaataatcgcccggcgaccggcaacctcacccacaatcgcatctggcgattcaggcgtcgtcatcgccacgttgtcatttaccacaccccatggggcgttcaccaagtcagcaaacttgcgggcacgcccagcaccggtatgatccggtgacacgacaaccaagttttccaacatgttgcgacgatagaagtaatcggacaacaacggtgccgcttgcaaatgatcaaccgggatatcaaagaatccttgcaattggtcagcgtgcaaatcgacagccaaaacgcgatcgatgccgtccatttcaagtaatgaagccaccatcttggccgtgattggctcacgcgacttagccttacggtcttgacgtgcgtatccaaagtatggaatcaccacgttaatgtgggcggctgaagcacgtcgaagcgcatcaacggcaatcataatttccatgaaggcatcattcacctcttcagcaattggtgccacaatataaatgtcatcaccacgaacactttccaacacacgttcgtagatttcaccatcagcaaaacgcttgatatcaatttgacttaaaggttgatgcaactcatctgccactgcttcagctaactcatggttagctgacagaccgaacaacttaatttggcactcctccacgggtgaattcctccatttttcattcaatatctatattctatcaaatattcagtataatttctctgcttaactcaccagctagttgcattgtacctgccaagcccctatacttactttaacgaatcaaacaagctggggtgccaagtggctgagatgatacccatagaacctgagcaggataatgcctgctagggagcttggtttgtttacgacttaaagtaagcgaaccccagtattgccgagacggttgatactggggttctttttattttccgaagctttgggcgattcgaattatatgaacgggggtttgcacgttatgcaaacagtacaagaacacaagcgcggatgggcgctacgtgatgttatttttctagctattatcgcgattttcttcggggttatttatcaggtttggggtgcgtcttattacgccttagccgcaattccaacgctcaagccattcgctaacgatatgacaatcggggtgtggttgatggccggtccattagctggggtactccttcgaaaagttggtgcaaccttgattgctgaagtgttggcggccgtcgttgagatgctcctcttctcaagttggggtgctgccacattactctacggcttcgtccaaggaatcagttccgagcttggtttcaccttaactggctacaagaactgggataagattgggctgacgttgtccgtgattaccagcacactgattacgtttgcttgggacttgttcaacagtggctacttggcctataagcctggcctattgatcaccttgttcatcattcgtttgatctcagtcggctttttcgccggtatccttgtttacttgattaaagtccttgttgaaaagtcaggtttattaaagcgttaatatgacaacattagcagttaaaaactttagctttgcctacgatacgggccaacgaaatattttaaacgatatttcgttttcacccgttgccggcagttttaatttattaattggcccctctggttctggtaagtcaacgttgttaaaagcgatggcgggcctgatgcctaaatttggtggcattgtcaccggtggccaaattttgttagacggacaagacattcaacccgtggcaccttttgaacgtgccaaacgagtggccatgctatttcaaaatccggatcgccaattcgcgatgcggaccgctcctgaacaaattgcttttgcacttgaaaacatccaattaccagctgaacaaattcaagaccgggtggccgatgtgatgacccgcttaaatttgacagcctttgctgagcaagatttgatgaccctatccggtggcgaaaagcaacgcgttgccttagccaccattttggccatggatagtgacattattctactcgatgagccgtttgcaaatgttgacccacaagctcggcaagcgttactccatgacttacaagcactccagcaaacgcaaggtaagacaattgtgatttcagaccacgatttatcgggttacgccgagcttgttgacaatctttacgtcttggaggcctcaaccggcacactgcagtcggcgtcattaacacgcctcacaaacttggcgccagttgtccctttcactgggcaccctaacccggctggtgacttgggttggcgccaattacacgtcagcgttggtgaacgaacattgctaacaggcacgacattcaccgtacccagtcagcaaatcggcttgatttccggggcaaacggcattggtaagtccaccctatttaaggcactgaccaaacaaattgcagcgaccggcacaattacctgggccgagcaagatgcgcgcaaaatcaaagcaaaagcctgggcaaaacgggtcgctttgattttccaaacagccactgaccaatttgtaaccatgaccgtcgcggaagagttggctttgtcacaacgtcaaactgcctaccctgatttttggacggctgaacgcgtggctgatgcggttgcccaactcaatctaaccggtgtgatggatcacattgtctatcaactatcagggggccagcagaaaaaactacaaaccttggtcatgctaatcatgggacaaccagtgctcctcctcgatgaacccttagccggtctcgatcaggattctgtccaggcagtcatgaccctgttacaaacgaccgtgcacgcgacccagcaagccattttaatgatttcacaccaacgacaaggtttggcagacttcattgactatgaactggtatttgctgaacagcaacttcgtttagttggaggtgcaacgcatgcctaaattgaatccaacggttttactcgtcattatgattgggattggcttccaaacagccttcgttaaatcaatcacgatgaatcttatcgtagcgggtgtgacgttactttatttgctattagctggtgttaaatggcggtatcttggggtgatgttcgcaatttcactcccccttgcctttgcgacatgggtgtcatttatcgcctttgggacggggaacaccacccatctggcctgggtctatgcaactcgtttgtatgcctacctcttcttgggcggggcattaaccctaaccgtcgcggtgaaggatttattgtttagtctccaccgacacgcccatttatcgagtacttttacgtacggcttattggcggcttttaatttgttaccgcgtgtgcgccgacaggtcaaaaccattcagtacgcagccagcttacgcggtgtcacatatcatctttggagtccgcacttgtatttcaaagctgtgctgagtgccctgcaatggtcggacgacttagccttagcaatgacatcacacggcttttccgagggttttccgcggacggataccattaatgatcccctgccaaagtggcaatggctagttgcagtcttggtaattgcagcttatgccgttggtgcttgggtgattcaaccacgttaacttaaactaaaaatgaccacaaggccgattcacactcggccttgtggtcattttttatgcgttaattttcgaaatcagcaattaacacgcggttacttgctgcatcatcatttggtttagccgcgccaaatgcggcttgcatagttcgcaggttggccgtttccactccgaaataatcgcgaatcaaatcttgcatgaacgccattaacgctgtaccatccagctccgtttcactatggagcacctttgcctcattccggtagacaccagcattgcgcaacgcatcaaccttcacttctaacgcgggcaacccggcaaccaagtgatagagggtatggttttcataggtccacttggtcaaatgcaccacatggcgtaaatcctgcagtccaaatggtagcaccaaatcagcagcgacacctgctagcacaaccggctcacctgttaatttttgaatggccgcccgtaactcggtggttggtaacgtaaagtgaccattgtaatctaacgcagcttgtcccagtaacagttccgaacgcgtcataaagccaatgcgatcaaactgagcatcacccgccattgccgtggctaatgcctgtttaaacatttccggtgcgcgccaatcaaagcgcaaaaatgcccggtccaagcgaatgtcatccccaaccgcatgaaacggaattggcgtatagcccatcgtcccaggtacactatccaccagttgttgccgcgcttcttcaaagtattgactatgataaatggccatttttaatcctccagcaatgtcaataatgtcgctaaatccagttgacccggtgcagaagctgccccgagtgttgcaaatgttaattgtgagccattacgaccaccaattgtgcgggtacgttgcccgagttcacccattgccatcgtaatcaatggtttgccttccgtggcaaactgttgggttgtcgcaagtaggcgatcaacatcggcatcagtttgcggcatcgtcgcgactttaatcacatccgctgcggtcgtaagcgcctgtccaaacacctggtctaaattcgtcggtgtgtcagtaaaaaaatgttgcgagttaataattggtacctgggcagcgcgggcatcaactaccaaatcggctacctgggtaaataattgatgctcgatatcaattgccgtgacaccggttttaatcgctaaccggtagactaattcatacaaggcaatgtcgaatgggcgttggccaccctcggtcgcagtacgccacgtgaaaataacgggtttgtccgcattaaataaaattgtttgtacgtcagcggctcgcaagtttactaaatccgttaagtaatctacgcgccactcaatcacgtcagctcgtgactcgttgatttgttcaacttgtccaagcaccgccgaaacggttgttccggtaaccggcaccgcaattaatgggcgattttgtccagccgtagccgtacccaatgttaatgtcgtcatatgttaaccctcaaatgcaacctgaatcagacgggcaatgtcacgcggcgttttcccatcggtttgcacagtagttgttgcggctgcatcatactttggcaaccgactacgccataatgcggccacctctagcaacgtctttgtacgcaaaataggccgggtatcatcatctgccaggcgttctaatgtctgaccaaacgaacctgataaatagtaaaccggtacgccagcttcggacaatagctgaatattgccaggtgtttcgacaatcccgccaccggtcgcaatcacaccacccttgtgaatgacatcttgcaagacggtgtattctaattcacgaaaacttgcttcgccagccgtcgcaaaaatttcaccaggcgtctgacccgttcggcgaataatttctttgtcggtatcaattaagggcaaccctagcaattcagccagctcacggccaactgtggtcttaccggcccccataaacccaattaaaactgctgttttcattctgccacaactctttctaggtctgcaaaaaagcttggatacgagacactcactgcctccgccttcgctaaagtgacttcgccatcagtgattaaggctgcaattgccaacatcatcccaattcggtgatcgccacatgaatcaaccgtagttggctcagcaacgcgcaatggcgtcccaccatgtaccacaaagccatcttcacgagcttcaatgttcgcccctaatttatttaattgcgtggtcaccgttgcaatccgatccgtttctttcacgtgcaactcttgggcgccggttatcaccgtgtcacccaacgcttgtgttgccgctaagactaatagtggaatttcatcgaccgcggttggcacgtcatccccgttaatatggatcccttgaagcccctgagtcgtgactgttaagtcagcatatggttcaccaccatcagctaccacattagccatcgtaatcaccgcccccatgcgttgcaataatcgcaaaatgccggtgcgggtgtcattgataccaactttggttacagtcaattggctatttggcacaattaaaccagcaatcaaccaaaaggcggctgatgaaatatcaccaggcacctgaatcgtggttgcatgaagctttgtcgtgggattcacaataatatcttgcccatcgcgagtaattgtcacgccaaattgttgcaacatacgctcggtatggtcgcgggtcgccaatggttctgtaatcaccgtctgcccttcagcttgcaggcccgccaaaatcaaagcactctttacctgtgccgaggcaaccggcaatcgatagtgaatcccctgtaagccttgcgtcggcacttttgttgccggtaagcgctggtttgtggccacataacgggcccccatcttccctaacggatcgatgacgcgacccagtggacgagtacttagactggcatccccactatacgtaattggaaacggttggttggccaacaagcccatgagcaaccgcgtcgaagtccccgaattacccatattcaacgcatgactgggctcctctaaagctgtcagcgggcgtccatgaacaatgacgtcttgatcatgccactccgcttcgacccccatatcagccatcgcccccaaagtactgcgcacatcatctgaatctaaaatccctttaatatatgtatcaccgtcagcaatgcttcccagcatgaccgcacggtgtgaaatacttttatcaccaggcacttcgagacgaccacgtacgccttggactgcagtttgcaattttcggtctgtcatttttcgtctcgctttctgtcttttgtgtgtttgttaacttaaaaacgcttaatttcttcacgataagcagctagttgttcctgcaagcgagccatattatcggcatcaaacttatccaaaacagcctttgctagctcaatcgccaccattgcctcagcaatgacggctgccgcggttacggcagtcgtatccgaacgttcaattgacgcccggtgatcctcatgggtatcaatatcaacactttgcatcgcgcggtacaaggttggaattggcttcacaacccccttcaccacaatcatctcaccagtggtcataccaccttcgaaaccacccaaattatttgagccgcggtaaaagccacgatcagcatcccagtaaatttcgtccatgacttcgctaccgtacttttcggcattttcaaagccaccaccaaattcaactcccttgaatgcgttaatgccaactattgcgcgggcaatcttagcatcaagtttctcgtcagctgacacatatgagccaagtccgactggcacacctgtcgccatcacttgcacggtcccacctactgtattcgcgtcacgcttcgtttgatcaatcacttcgcgaatctttgcatccgtttcagcgtctaaagtacgggttgggaagctttcggttacttcgcgtaactcttgcagggtacgatagtttgttaacacactcgtatctgcccgggctggtccaacgttcaagacaaagccgtgcacatcgacgccaatttcagccaataacctcttggcaacagccccaaccgcaacacgcatgaccgtttcacgcgctgatgagcgttccaaaacattccgcaaatcagcttggtgacggtatttcatgccaccaaccaaatcagcgtgcccgggacgtggtcgcatcaccttgcgcattgtgttttcagcatcagctggcacgttgggatccataattttggtccagtggttgtgatcatcattatgaacgttcaatgcaattggcgagcctaatgtcacctgatgacgaacacccgccataatcgtcactttatccgtctcaatcacttgacgttggccacgaccataggcgtgctgtcgacgggccaattgttcatcaatatcggcttgtgtcaacgttaaaccagctggaatcccctcaataatggcgacttcttctggcccatgactctcacctgctgtcatataccgcataattgctacctgctttctacaaaggctggcatatcaactagcgccttctgaacaatggtcggttgaccaggaactgaaatggcaactagctgaagcgtaccggccgcgtttttcttatcattttttaagtggtcataaaaagccgcttgccctatcaaaggtgatgttactggtaaaccaacggctaccaaacggtcgcgtagcaacgctgttatgcctgattcagtgatgccagctttttcaaaccgttctgaaatggcaaccatgccaatggcaaccgcttcgccgtggcgcaactcgccatgcgccatcaactcaatcgcatggcccaacgtatgaccgaagttcaaatacttccggacgccaccttctttttcgtcagccaccacaatgtcgcgtttatacaacaccgacttcgtgattaacgtctcggcccgttcacgaatcgcggccaccgttttaatatcaccggtcaaacgccaaaaatcgccacctgctaagacgcttgttttaacaacttcagcgtatccctcaactaagtcacgatcagacaacgtttgcaaaaaatccgggtcaatcaacaccatatccggctgatagaacgaccccatgatatttttaactgttgccatattaacggccgttttaccaccaacacttgcatcaacttgtgcggtcaatgatgtcgcaatttgggcgaaggcaatcccacgcatgtacaatgatgcgataaccccggttaagtcacccaccacaccaccaccaagggcaacaatggcatcctgccgggtaaagccatacgctgccatttcaccaacgatttgttcaaccatctgcaatgacttcgatgtctcacccgccggtacggttgtcgtgtggactgtaaaaccatgttgtgccagactagcactgacgtcagctaaatacaaggggcccacgttctggtctgtcacaatcatcacctgacgcggttgccaaattgtggcaagtcgttcacccacttgatgacgaacgccactagcactgaccacatcataggctttcgaggccagttttacatgaatcatccgaacttaaccacctctcgaatggcaaccgccttttttgctagctccgcaaactgcgttggtgtcaacgcctgggccccatcaacaaatgcggcagccggattgtcgtggatttcaaccatcaacccttgcgcacctgcggccactgcggctaaaccaacagcggcaacgtgttgcgcaacaccagccgcgtgggatggatccgccaacacagggtagtgcgtcaattcttgcaacaccggaatcgcactcacatccatcgtattacgcgtatatttgttatcgaaagttcggataccacgctcgattaacataatctgatcattaccaccagccgcaatgtattccgcagcactcaataattcatcaagggttgcactcatgccacgcttcaaagcaactggtttgttctgagcccccagcgccttcaataaactaaagttctgcatattacgggtaccaacctggaaaatatccgtatattggcccacgatttcaacatctcgtgtatccataatttccgtaatcatatccatgccgagggcatccgcggccgcacgatgcatacgcaaccctgcttctcccagcccctggaaactatagggactcgttcgtggcttgtatgaaccaccacggagtaatgttgcgccagctgcttgtaccgcttcacccatacgttgaatatgttcagccgactcaattgaatctggaccggccataaagacgaaattatcaccaccaatttgcgaatgcgctgtggtaatgatggtatcggctgggtggaacaaacgggaactcttcaaggcggacggatgtttcgtaatcgtctcaacaaccgccgtttcatcaacaaatggtacttccgccaatgtctttacagtcgcaaatcccacacggttttcattcaaaaaaacatgttccagtcccgctgccgtggctgacgctaacgttttttgggccgtcgccacatctttcatgacaagaatcatctttgcttgcctctctaatcttctttattaatcgcacgtttcatcgcttgcacatttgggagttcgccccgccattgctcaaagctcaatgcaccttgaccgaccagcatagctaagccatcatcagcttggcgatttgcggcccgagctgctgccacaaacggcgttggttcaggcttataaataatatcaaccacttgtacatcgggctgcgtgtcataaaactgctcggtcgataacactgaccgattgtcacgcatccccacattcgtcgcattcacaatcaaatcagcataaggtagataaacatcaatttcatctaaatcatgtaattcaacttgcgctaaatcttgcaccttagcggctttttccgcaaaatgttcgcccatacgattgaacacatgtaaggttaccgatttaggggccgtcgccataatggcgcgtgccgcacccccggtcccaattaaaatggctgagtcaaccggattgcgtaatgtccgccaaaatcccatcccgtctgtcgaatcaccgatcgtgcgaccatctttgaccgtaatggtattaactgactctaagcgggttgctaatggcgtcacttcgtcaagatacatcatgatttgttgcttaaagggcatagtcacattgaagcccttcacccctgaggcaaccaaactcttaaatgtcgctgccaaagccattggcgccacttcaaacgcttgataattggcatcaatatttgcagcttgaaaagcggcattttgcattgccggcgactttgaatggcgcgccggataccccagtagtccgtattgatctgtcactgtcttggcctccgaccttttgtactagcttaccaaatttcagtagtctttaataccgtatccgcctatataaaaaagctgagataaactcagcttttgctttaatctattctactcgtcttagaagaacaaaccaataccatagtggatggcaatggttagcaggccaatcacgacattacgcttgatggcttttttggtgaacccatggccaatcttcgcacttagaaaacccgttaaagcaactgccacaacggttgcggcaatcgttgcttcaaattgccactgaactggtgaaaaatacagtgccaacagcgggaacgccccaccgatggccgcgcaaatcaacgatgaaatagcggccgaccacggtccaacatagtgccctaattggacatcatactttgttgctaagatcgtcctgagtggcgccttttccatcaactccgccacaattttatccgctgttgcttcagtgacaccacggtccaggtagaattcgcgaatatctgccgcgacaccagccggattaacacgtagtcgttgggtctcccggtcaacaacaaccttttccgcatctgcctgcgagctaaccgaagcgtactcacctgacgccatcgatagcgcacaagcaaacaaatctgccaggccagcaattaaaattgtgaattgatgattagtggcggccccaactgagaatagtacgccaactactgttagaatcccatcatttgaccctaataccccggcacgaatggcattcagtcgttcttccatcgtttgatgttcttttgcttgcataccttagcccccttaatgaccaattaatgacccaatcaagtaggtcacaatcattgtaaaaataccagcaaccacattacggacggttgcccggcgttcattcgcaccagacaagtgcgcggccgcgtaacctgtgaacgccaacgcaattaaaacggcccccgccgttgctggtacgcggacgtgtggtggcaataacgtaatcgccaacattggcaagactgagcccaatggaaaggcgatcattgaggccaccgccgccccaatcgccgacacttcatgatgaagcgtaaagccatagcgttcgcgaaccgttgttcctaaggcatctttcgccatcatttcgcgggttgcctgggcggccaaatcagctgaaatgccttgattcatatacttttgttgcacaaacgcaaactcggtcgcgtaatccgtctttaaagctacggtttgcgtctcttcggctttcacttgagcatcattttgtgagtggacagacacgtattcccccatcgccatcgacaccgtgcccgcgagtgcccccgcaaaaccagcgataaaaatggcaaacgaattcgtggtcgccccagccactccgatgacaatccctgaaacagacaaaataccatcattcgctcccatgacggccgcacgaattaaattgtttcgttgggccaatgtttgtttatctgtcatttactcttccccttgttcaaaatgtcacttataagtttacaccaacgcgcagaatttgtttatatgacttaaagtaagaagaagagagtgggtcacttagcgttatattaaggggggtagcctttcggcacacgtttaaaagccgccaatcctccgattttagatcaggcgattggcggcttttaaggatgaaacagctagtcagtatttacggttactgttgggtacgccgattaaacgcagttagcaccggaatcccaatcaacggtactaagatagcaccgacaatcatttcaaaaatgccattaaaaccagcgattgaaataattaaccaatttgccaagcctgagtcaggaataccagtaaatgacgtattcatcactttgaacccaatccaggtcagactcaaaactaacgcggtattaatgaaagccgatagcgcacctaggccaaccaaccaggctgattgttgcgcaattggacgttccttcacaaaacgccagtaaagataaccaataatgacccccactagcatgcgaggcgcgatggcggtaattggattacggaagattagcgccccgatactaggcactgacgtccaggcatgccacaacgaataagcgccccagataaaaccaagcaaggccccagtcttaggccccaaaaccattgccccaatggccaccgtaaaggtaattatcgtcacggctgccccgattgcaaaggcccctaatgggagcgtacctagccaaggcacaatcgactgcaacaagataatggcaataaacaacgccgtcaataccaaatgacggctcgaagtttgacgtgtcttcatgaatttgtcctctataaaatatgaaagtaacggaataattgcttactacaaattataagtgttcgtttacgtaatgtcattaaccactcacttttaaaaagcagaacacgacgaatcgtgttctgcttaaatggttattattcaccgcgacgttcggcaaaatatgccgtcatacgcttcatggcttctgccaaatcctcatctgaggctgcgtacgaaattcgcacgtactctggcgtgtattctgagaaagcatcccctggaataatcgcgaccttcgccttttcagccaaatcgaccgcaaagtcaaagccactcaaccccatatccgctggaattttagcgaaaatatagaatgccccttccggattcaccacttcaaaacctagtgcttgtagttgtggcgtcaaccaatcacgacgacgcttatagacatcccgcatttcatcagccacttcagccgcatcggtcactgccaccagagcaccatcttggagcacctttggcaatgagaatgtcaatgcaccgtgcaccttttgggcttcatcgataaaggccttttcacccaagatgaagccaatgcgataccctgtcatggcgtgtgacttagagagccctataatcaacactgtttgatcaggaatcaagctggctaatgagacgtgcgcttgatcgtacgtcaattgtgagtaaatttcatctgaaatcacccacaggcggtgcttcttaaataccgctgccaaggcctgcaattcatcctctgaatacgttacgccagttggatttgacggatagttaaacaggattgccttaaccggcaccttagctttttccatcgcttcgtcaacctgatccggtgtcaacttgaaatcagttggtcgcgtattgattgataccttcttaccatgtgccaaatcgagcgaggcaaagtatggtgggtacgcaggttctggtacgataaccccttcgttatcgtttaatagtgttaagaaaaccacattaattgcttctgacacaccaattgttacaatgatattgtcttcaccgctatagtttaaatcgtacttcttgttgaagtacgcaacagcggcatttcgcaaatcacgttcaccctgtgagtcggcgtaatgtgagttatcttcttgaactgactgaatgatgcgggccttgatggcgtcatcaacattaaagccaggctctccaaacgttaatcgcaccaaatctggaatatcgcggacagcaagttggaaatccaacaagccatctggtgccaaattagttacaattggattaagcggttggatgaaatcttttttaatcatactaattattctcacattcttcccaaagtaacttatattatagcagtaattgggtggaatgccagttgcgatttttgaataaaatgtgaacataacatgccctatcaatacggaggaaatacacatgctagaatttaccggtattgcaatcgaaaccccactgcaaacatggcgctgggatgacattcaggcgaccccgattaaagcggttgctgaacccctcgtctcgctcagttatttgccagaaaagatggtcatcagtccgcaatatttcattcagcagttgcctggtgcgaaagcagacttattcgcccgtgaaacggtgcaacgcaagctcaacgaagcggccgatttgctcccctatggttataaatttgtcattttcgacgcctggcgcgacatggccacccaacaagccctctttgatcaaatgcgagcgtttgtgaaacgtgatcatcctgattttgatgaccaacaagtgacccaagccgccttgcggattgtcgcattaccatcaactaacccggccaaaccgtcaccacataataccggtggatcaattgatttatcaattgttgacgagaaaggccggctcttgccaatgggcagtccgtttgacgacatcagcgaacgagcccggacggattattatgaaaaagcacctgacaacgacgacaccatcacgtaccgcgaaaatcggcgcctactctatcacgtgatgacacaagccgggttcacgaactatatcgaagagtggtggcattttgactacggcaaccaaaactgggccacggtatcaaaacgtgattttgccgtttacggggcaactcagcccgatttcccttggatttaacgttcatttttattacaatgttcgtgcactagcacgacactcacaataatttattagtctaaaaaacggccccaacacgcagtcatcactgcatgttgggaccgtttttcacctcatatttacttcacaacagctgcaatgtcagctaaccaggctgacatcgtctcaaagacgccgttgtcactttctgtaatacccgtaggcaaaactgttcccatatagtgttgtgccaataattgtgataacaccaatccaccgataacatctagaatgtatgtgtcatttagtgtgcggaacgtcaatacattgtccgtattaaacgcaatgtggaaacgctcaaccgcaaaggtaattgtcttggcaatgtcaccgataccagcgactgttgaactagccgtatcgaatgcattaagttctgcttgcaatacatcctgccagttggccaatggcacttgacggggttgttcgcgttgcaaatctgttagtgataatgacatgattgtcaccgcctcatttttgtaatgatttcattatagcgaatcactaactattcgtcacttttgtgcattcacataatcaacaaagtcttggaagacgcgcaaatgtgtcttatcacgttcgaacatcatttcaggatggtattgcacagcgcggacagatgcatccgaactctgataagcttcaaccgtcccatcgctcgcaaacgcagcaggttgcaaatctgcgcccaactgcttaatcccttggtggtggaatgagttcacaattggattatcacccaacgtacccgtcaaaaagttatctggcaatacatccaaacgatgcgtgggctcataccacttcactgggaattggtcgtgcttcacaattggattaccattttctggcgtatattgcgtatcgatatcttgaattagcgtgccacccaaggcaacgttaatgagctgggcaccgcggcaaatccccatcaaaggcttgttttgtttacgtgcctctgcgacaatcgccaactcaaataagtcgcgttgtcggtctgtttcgcccatttgtggcgttggatcttcaccgtaaaatagtggtccaacgtcttgcccaccaatcaaaaggacggcgtctactgcattaacatactcagccgcttcctctggtgaacccattggaaagacaactggtaatgcgccagcttcacgtagcgccgccgtataattttgttgcgtatagtcaacgtaattcgttcggtgctttggatttgggtggttcaagtgattacttggaataccaataattgccatcgttgcgtgccccctgtttcaaatatgaaacatattataccgctttcatgagcgaatggttataaaaaggaaattttctatactaaaaagcctgagattatccccaggctttccattagatttagtccgcaaacaactcagcggaacccgctggtactcggacaagatcaagggctaccaaacgctctgcaatttgcacggcgttccaagcggcacccctcaacaagttatcagaaaccacccacatgtggtagttgccatcattttccaaatcagggcggacacgaccaacaaacgtatcacgcttaccttcagcgttaattggttgtgggtaaatttggtgatccggatcatcttccaagacaacgccaggcgcatccgacaatgcttgttggatgccctttgtgctagcaccatccttgtcggtcacttcaaagtaaaccgtctccccgtgaccaactggtaccggtacacgaacggccgtggccgttaccttgatgtccggcgcattcttatcacccaacataatcttcttcgtctcatgaatcattttgtactcttcatgcgtgtagccctcatcttcaaagacgtcaatttgaggcaacaagttaaaggccaatgggtaatgcttcttgtcacccttggttggcaaaatttcagccgtttcggtctcaccattcaagtgttgttgcgcctggttcagcaattcattccaagcagattgccccgccccagacgcagcttggtaggttgagacaacgacttgcttcaaaccgaaattttgacggattggttcaagtgcgacgaccatttgaatcgttgagcagttcgggttagcgacgattccattgtgttgataaagggcctgttcattaacctcgggtaccaccagtggcacgttatcgttcattcgccaaaatgacgtgttatccacagccaccgccccacgcttaactgcttcaggcaacaagcgggctgacacagaaccgccggctgatgacaagaccaaatcaaccccctcaaatgattcgggttgagcttcttcgatcacgatatctgaaccacggaattggcgagtttgaccagctgaacgagacgaagccaacaacttcaacgacttaaccggaatcgttgattgttccaattgttgaatcaagcgggtaccaaccgcgccggtagctcctaaaattgcaactgtgtactcacgttctgacataatattttctccttaaattttaataaaaacccgaaatttgggtacattaaaagcacaagccgaaattaatcagttgtgccattaattattagtattttctcattaacccttgaggtcgacgtaatgcttcaagcgcaccatcgccgtctgcaaatcttcagttgaggctgcgtatgatagacgcacataaccttcaccaccagcaccaaaaattgatcccggtgcaattccaagcttaacggtttccgctaagtcgtagacaaacgccatatcatcagtgttcaagtttgctggaatcttcgcgaaaatgtagaaggcgccccctggttgtgcagcggtaaaaccagcctctgccagaccagccatcaccaaatcacggcgctccttgtagatatcacgcatttcaattgcatcagcacgcccatggcgcaacgcttcattggccgctgccatcatgggacccggcactgtcgtcaccaagaattggtgcattttaccaacgtgcgtcatcaacgcagccggtccggccacataacccacacggtagcccgtcatcgcatgtgactttgataatccactcaccaagatggtttgttctggcaacaacttcgccattgaaacgtgttcgccatcgtaaactaactcggcatagatttcatcagacaagaccaacaattggtgttcggccaaaatgtcagcaattgcctgtacttgcgcaccagtataagtgacacccgttggatttgatgggtagttgaacaacacggccttcacatttggatgttcagctaacgtggcttgtagtttttctggcgtcaatacaaaatcaggtgcggtgttgatgccaatcactttcaggccaatgatattagcgattgcttcatacattgggaaagttggcgttgggataataatttcatcacccgcattaaacagcgcattcatcgtcgcgaacaacgcttccgaagcacccaccgtcactaccacttcgccgtttggctcgtaacgtggtgtatcaaaccgttcaaccaggtagtcactaattgcttcacgtaaagccaaatgcccgtgtggcgcagcgtagtgtgagtcgtcttcatcaatcgcagctttggcagcgtccttaatgtgcattggtacagcaaaatcaggctcaccaagtgtcaactttaaaatgccgtcgatggcagaaaacttttggtccaccactcgaattggtgatggtaaaatctgggccaatcgtgtgttaaaacgatcagcaagggcagcatttaattctggcatgtttttctcctctggctcactggccatcttattaagtctcaccggacttagtcgcggctttacaatagttgatctaggccgaccgccaggccatccacctgcgtgacgttacgaattgctaaggcaacgccccccatgaacgattcacgcgtgaatgatgtttgcttgagtcgtaatgtttccccgggtgccccgaagataacttcttcctcggccacatagccaggtaaacgcatcgcatggaccggcacctggtcgattgcttccccacgagcagcatctgctcgatactgggtaactggtttagccttacgagccgccgcaatgcgacttgcggttgcccgggccgtcccagacggtgaatctaccttattggggttatgaatttctagcacttccgcatccgggaaatattgcgctgctttttcagcaaattgcatcaacaacaccgctgataacgaaaaattaggtacgataatcgcatggcgcgcatacttttcagctagatggcgaagttgtgaaacttgatcggctgccaagccacttgtcccaaccactaaatcaaagccgtgtgacaacgcataagtggcattgtcgaaggctgattcgggtaacgtcacatctacccaaacatctgctgtgacatcaatttcgtctaattctgtaaaaaccggtactgtcgcctcgtgcggggtccgacctagaataccaaccaacgtcaaatcagcctgttcggccaacatattttggatggctactcccattttaccaaatccacccgctagaaatacggttgtcataaaaattcctctctcatctttacgcaagatgtgcaatcacatctgccgtttcatgttcatccaaaggcaaaattggcaagcgcgttcggttttgcacttcgcccttttccgccaaaaccgccttaactggtgctggcgaagggtaactaaatagcgtattcatccgtggtgttaaccaccgttgcaactgacccgccttacctagatcaccatcatggaacgccaagaacaagtcgcgcatttcaggactatacaggtgtgccgccactgaaattgtgccagtcgccccaatcgcctttgccgctaacgtctgagcatcctcaccggtatagacagcaaaatctgctggtgtatggtcaaccaagtacgccaaatcatcaatgcttgtgacttgcttgacggcattgatatttggatgctgcgctaatgtcaccacactgtcttttgttaggccaaccgctgaacgacctggaatgttatacagcatgactggtacagtcgacgcatccgcaatcgccgtaaagtgggctaacatccccttctgacttggcttattgtaatatggcgtcacggccaaaatggcatctaccccaggtatcgcactaacttcggcagccaatgcgactgattgggctgtgttattatcaccgacgttcgcaatcaccggcccgcgggttcccacctttgcagcaaagtaagcatataaagctagtttctcttcatgcgtcaaggttggtgactcaccagtggtaccaccaatgacaaatccttgggtaccttcggctaacaatcgttcggtcaacgaatccaacgctggatagtcaatcgtatcttctgctgtaaaaggcgtaataatcgccgtaatcagctcaacttcatcatacatatcagttgcctcttcttattatttattgcatcattcgccaatttaagtaaccaaccattgcgtcaacacctggttgcaaggcggcctcatcaggcgacaatccggcattatgaagcgcatgggttggatcaccaacccctaaccaaaacatggtacctgggaatttttgtagcaagaagccaaaatcttcaccagtcatcgccggcgcaatttctgaaaaatcaacatccattgcctgggtcatataagtcatgaatagcgctgttgtcgtgtcgtcattttcaaccggcatgtagcccccttgaattaactgcaaatcagccgtcacaccggttgccagtgccacccccgccacaatatcgcgcacacgttgttgcatcatttcgatatcctgctggcggaaggcccgaatcgttccatctaaatgggcggtttcggcaatcacattaccgactgtcccggcgtgaaaagtgcctaatgtcaccacaccaccgcgaactgggtcgacattgcgtgacacaatcgtttgcacttgattgacaaacatcgcacccgcgacaactgcatcgacggcttcatgtgggtaagcagcgtgaccgcctttacctgtaaaggttacatgaatctcagtcgtccccgcaaacaatgtcccttgacgcgtcgcaatttgcccagttggcaaaccgggatgatcatgtaagccataaaactcatctgggcgccattcatcagtaaacacacccaaatcgtacgcccgtttaccaccataatcagcttcttcagctggttggaaaaagaaaatcagattatcttttggctggtattgggtaaagtacgctaaaatacctaaccccactgtcatatgcatatcatgaccgcacgcatgcatcaggcccgcatgttctgaagcgaatggtaaccccgtcgcctcagtaattggcaacgcatcaatgtctgcccgatacccaattgttcgttgtggatcggttccagcgacgcgaacgagcaacgccgttggtagttcaggtatttcacgtattgtgacccatggttgctgccattgcatgaccaactgtttcaaatactggtgtgtctgcgtttcgtgtaacgccaactctgggatgcggtgcaagtcacgccggacttgttttaaatcaatcggcgtcatgtcagcacctcgttaatccaggttccgcaaggcgtcgaccaaggccgtcttgccttccgtttgcgcatcaatttccttaatgacacgtgctggcacaccagctacaactgtatgggctggcacatccttagtgacaatcgcgccggccgcaacaacagccccgtcaccaacttgcacaccttcgatcactaccgcattcgcaccgacgagaacgttatcaccaatcgtcaccggcgttgctgaggctggctcaactaccccggccaagacagcacccgcgccgatgtgactatgcgcgccgacaattgcgcgtccacctagcacagcacccatatcaatcatggttcctgggccaatttcggccccaatattaataatggcccccatcataatgaccgcattatcgccaatttccacctgctcgcgaataaccgcgcccggttcgattcgggccttcacaccatcatagttcaacaatggcacccctgaattgcgggctaataactcaacgtgttgcgccgtgattttatcagcatttgcggttaaaaccggtgcaatcagcgcatagtcgccaatcactgtgcccgtacgtgtttcaataaatgcttgtacgtccgtgggccaggtaatatcagtcagttcgccggccaatgtcacccgtgccggtgtttgctttggcgcatttgcaatgaaattaataatcgtttgtgcatctaattctgccattttttacatttccttctataaatagtgtcggtccaaacgaaccaaatctgccaatgtttctcgttccactacgaccttagcttgaccgttttcaacaaaggccacggctggacgcccatttcgattgtaatttgacgccatcgagtagccatacgctccggttgccaacaccgctaagacatcccctggctttgtctttggtaaggcttgctcccaaaccaacacgtcccctgactcgcaatacttacccgccacacggacaacctcatcagaaggcgcatctggctgagcagctaagaccgcttcatacttcgcctggtacagtgctggtcgaatgttatcccccatgccaccgtcgacggcgagatatgaccgaatgcctgggacatctttacgcgagccaatcgtgtagagactataccctgctggtccgacaattgaacgacccggttcgatccaaacggctggcatctgcatgccatatgccgccgtcttttcagcaatcgtatcgataatcgcttcaacaaacgttgcggctggtaatggttcatcatctgcggtgtaccgaatgccaaagccaccgccggcattaatcacttgcggctcgaaatcccattcgtgcaccaaatccaccaactttgcagcggccatctggaaacccgtcacatcaaaaatttgggaaccgatatgtgcatgaacccccaaaacattcaaattaggatctgccaaggcttgttgcaacgcagcttcagcttggccactattaacatcgaaaccaaacttactatcagtttgaccggttgaaatgtaatcatgggtgtgagcttcaacccctggggtaatccgcaagagaatatcttgcgtttgctgacgttccgccaacaattcatgcaatacctgtaattcatagaagttatcaacgataatcgtgcctaagccattctcaatcgccatcgtcaactcttcaaccgacttgttgttaccattaaacgacacatccgccatcggaaattttgcccgcaaagccgtataaatttcaccaccggatacgacgtcaatatgcattccctcttgggcagcaacttcatacatcgcaatcgttgcaaaggccttcgatgcatatgacaccgcataatttaggtgacgttcttcaaatacgcgcttgaaatcacgcatctgttggcgcatggcccccacatcatacgcgtatagtggcgtgccaaagcgttgtgctaattcattggcatcaacaccgccaatactcaaatgacctgctgcatttgtttgataaggtatttgcatattctcttccccgttaatctgtaatttgtcgataaatgcgttcttgtaaattcgttgaaatttcccatggtgccaggtccgtgtattgaccgacatcctccaaggtattctcttgttcaccttgccgaccaataatcgtgacggtggtgccaattggtagttcatatggtaatgaaatcatcatttgatccatcgctaacttccccacaatcgggcgcttcacaccgtcgacgattacctcaaagccttgcaacttacgaggtaagccatcgccataccccaacggtaccgtgccaatccattcgccttcatgggcgtaataagtatgaccatagctgaccccctcaccttcatggcattttttaacaaacaccaattccgtttccagtgtgaggaccggctctaaataatcatctgagcgtaattcaccgcgtgacggttccacaccgtaaaccacagtgcccgcccgaatcacatccgttggcatttcatccgcgtgatacatcgcggcccccgagtttgctaaatgcactaaaggtggcatttcaataccatccgttagtgcatgccaccgatttaattgttggtggaaataatcaacttccggtgcatcggcctcagcaaagtgggtcatgatgctagcatatgtgaaggcctcgcgatgttcatgcataaaagcaatcgcagcttctaattcagttcgctcacgaaatccaatgcgtcccataccagtatcaacagctaggttaacttgcaaacgttggccattaactggcagatattgtagtgccgcttccaaccacgccagtgatccaaccgttgcaatcaaattattttctgcaattaaacgcgcgtattgcggtaacgtaatccctaaaattaacgttggttccgtcaaccctgcttgacgtaacgccaaaccttcatctaacaaagccaccgctaagccatcaatgccacccgcaactgccgcttggctcatcggaatcaggccgaaaccataagcgttggccttgactgctaagaacataaatgaggcttgcgatgcctgacgcacttcttgaatattgtgcgtcaccgctgcttgtgaaatatttaaccgggttggtcgggtaactgctactaccataacttgtgtcctcattttcattagtgttacgctaattgtgaggcttttccgcaaaaaagacgctcaattaacggcaccatcgcaccgtcaattgagcgtctcattaaaaaacattcattgactgtgacgatagctccccgctgttttcacagcgacagtccgatggctcttaaccaaaggcccaacgactcagttgcgctgaatcgtttcggcaatgtcccctttcgctttgcgtcgtcgcccgtgccggctcaacaaagttactcatgtcgattgcaacctctatcaatcattaacgtaacattagaatacccttaaaaaatataactgtcaacacttgacatctgccattttttaattttgaattatcatcaacaaatgaatgaatacacaagaggaaattagtatgaatgtaatcaagtttggtggttcttccttagctgagggctcacaattagaaaaagttattgcaattatcagcgcagatactgcccgtcaagtcgtcgtcgtatctgcgccaggcaagcgtttcaaggatgacatcaaggttactgatttacttgcaagctacgcggaacaagcaattgcgggggatgataccgtcgccattcaggccgaaatcattaaccgatatcgtcaaatcgtcgcgtatttcaacctcgacgaaaccgagatcattgggaccctatctgaacaactggcaaagctaagtcgggtccactatccctcgtttgactacttatacgcagcctttatgggtcatggcgaattactaaacgcccaactaattgcctatgtcatgcgtggtcttggtcacaacgctcgtttcgtgtcaccagccgatttagggatgattgtcactggcacaccccgcgcagctcgcattcgcgaagatagttatacgcgcttagcgaacttccaaatcgcagccgatgagattattatcgtgcccggttttcttgcctataccaatgaggggctaatgtccaccttttcacgtggcggatctgacatcaccggtgctattttggcacgcgggttgcacgcggatttatatgaaaatttcactgatgtatcagcaatctatgctgttgatccacacatcattgatcatccagccgccatcacaacgatgtcctaccgggaaatgcgtgaattagcttacgctggctttgcggtgttccacgatgaagcgattattccagtaattgaagctaatattccaattaacgtcaaaaacacaaataaccccacggcacccggcacgatgattgtacctgtcaaacaagtcaccaacccacgtccggtaactggtattgcgagtgatacccgttttgcggccctatacttacaccgttatttgcttaataaagaggtcggctttaccctacgaattctggaaattttggccaaacatggggttagttatgagcacatgccatctggtatcgatgacatgaccattattttcgataaaacgcaaattactgacgcaatgcgtgatgcgatttgtgatgaaatccaaaccactttagaaccagaccatttggaatggattgatgattttgccattattatggtggttggtgaagggatgaataatcgcatcggcgctttttcagaaattgcgaccccattatctgacgctgggattacattacccatgatcaaccaaggtgcttcccaaatttcactaatgcttggcgtacgcgccgaacaagtggacgatgccgtccgggtaatttatgacgcggtcttttaacccctttgtttgctattaaaaaagacacccgcaaccattaaccgttgcaggtgtctatttcgttaaaattgattttttgcatagttgcgcagatctgattccaaccctgccgtccgggcagccggtttcacatctaatgcttcgtgaattttgccaccctgaccagcataattggctgattcagtattagcaatctgctgtaattcagtcaaagagtacgccgccggatcttgtacaaatcgtaatgaaccatcggccatttcgatttgttgctcttccagagcatcccaaagcgacacaatctgatcatcacgatcgaaaattaactcgacatgataatccggtgtcactaccttaacattgctttggtctgcaacgcctcgattatgcaaagccacaccaggatacaaaacttctttgccagtaaacaacaacaccttagcttcatattgggcgcgcgtccaattcatgtggcgcacaaaatcagacaccggcttaccgagataatagcgtagctggttgtcaaacgttgccgtcaattgcttactcgtggcatatcgtgaccgaataccgttccacgcccgatacttcagacgcatcaaaaaggccactcggttaacaaaatcccaatagtcttgcaaatccgtttcattttctaactgcaggtaatacaagttcggcgtcatatcacgcttagcccaatcacccaaatgggtcatttggacaaaattcgtgtcgtcacgttgcaatcccaacacttgataaagcatccccaaccgatccgttgccgttgcactaccacggtggaaacctgaaattaacattttcgtaaataatgatgacccaatccggtgcgcctcataccatttctgcgttaagacacccgtcatcgtatgatccgtcagttcaggtgcagttgccacagcctcaacataagccgccaccgcctttggtaaccacccgtctgccgtgagtacttcagtctggcccaaaagtgccgctgacatcgcagcccggtggacgtcaacgcccttagggttttctatcagttcgcgtgttcgcttaaaaagcatatgtacacctcctcttcccactagcttaccataattaagcaaatggcgcagttgattcacgcacaattaggttcgcatcaaacgctgccacctgtcgctcaccatcaggttgagcaatacgttgcaacaccaaatccaaggctgacttcgcaatatcccaaaccggttgttcaattgtcgtgagcgctggccggaaaaattccgcataatccgtatcatcataaccaataaccgacatttctgtgggtaccttaataccaatcgcatttaacccggaaatcaacccaatggccaattcatcattaagggcaaacgccgcggttgcatgcgtcacggaaacagccattgccgcagcacgaccagcgtgcttcgtcaaatttcgggtagccacttcgctcaccttgactcccgcttcggccatcgcttccttgaagcttgccgtccgatacaacaaattatcggtatacacttggttacccaacagcaccacgtgtttgtggcccaatgcaattaaatgctcggctgctttacggccaccctgcgtatctgatgaataaaccgcatcggcatcttccaactcatcatgattttccaagacaaccatcgcgatgccgcgacgtttcaagcttcgagcaacggcgggtggatttgacagttgactcgccaccacaatgccttggacccctgcggcaaccaacgtctcaaccgtttgatcagcggttgccgtttcagcagtcataatcgatagtgacacattatcaggcaaaccttcctgcatgcgttgcacaatatctccaaagtaaggatttcgcaaacttggcaccagcacaccaatcatcgttgtcgtcccgcgctttaaactacgggcactggcatttggtacatagccgacttcatcacgtgctgcaaagaccttctgcttggttgcatccgaaaaacgctcccctttaccgtttaacacttgtgacacagttgcaattgaaacgcctgccaaatttgcaacgtctcgaattgacgccttccccattatccgtctccttcttaattcacactcatccccgtgtttgcaatatcaaccacttcaaacttacctggcaacgccaagtaagccaacacatccagtaaatcattgactttgtctggcgtcaccagtgtcacaattgctggtccagcgccggctaagaccgttccgtaaacctctagtgcgtgtgacgcttgccgaatcttggctaattccggtacctcagcctgacgggctgtatctaatccgacggtctccagcaattgcccagcgaggaccacttgctgattctgccatgcagctagcaacatgttacccgccgctgctgtcgccatagccgctgcttgcgagaattgctcgggccgatgggtcgccacctcacgttgatactcaggtaagtaaatgaccgcttggtaagctggtacaacaaccccactcgcaaaaacgttacccgcttctagataactcactgtcacgccacccagtagcgcggcagtcacgttggctggttgaccttcagtacgtgctgccaacgttaatttcgtatagtcgtctaaatccagttcacccaattggttagctaactctattgcggccagcaacgcagccgttgaagagcccaacccttgacggagtggaatatccgacgttacgcgaatccgatgtggcgttatattgggatataagttttgggcaacagcaacgatataattggtggcatccgtcggaatcgtctcacctaaattgtgttcgaccaaccagacatcattggctgaaataacttcaagcgttaaatagcgatcgagcgcaataccaattgacgcgacgccgggaccgaaatcccctaatgttgcaggtacttttattgttatcatgcgggtctctttcttcgtaaaattactttgtaaacattttaccaagttttactaaaaatgacagccccctcaattagagtttgttcttaatttattaagaaatccgtgcaagtttcccatcacaatggccattattagacataaaactaacaattgaaacgtttaaacctaaatattttcgttatttaacattttacttacgatatcatcccacttttcctgccaccaatcaataaattgcgctataataaatcacgtaacagatgcagggtagactttggtgcgttaagtgccgtggaaacggaatgtgggccacggacgaaggacaacgtgttcgcgataccatcgtcacattcactgtaagaagtgaaaccctccaaatactaaaggaggtgttttcgatatgaagacattaagttacgcattacctcgtctgcgcacgacgcagcttgcattattgggcattctgatggccctcgaaatcgttatcggtcgctttacatttggtccagcttctgtgaaggttggcttcacatttatcgtcgttggcttgattgcaaagtggtatggtccttattggggcatgattgttgccttttttaacgactttctatcaacgatgattagtggctatagctacttttggggattcgccgtttcagcattagtcggtgctgccatttacggcttcgctttttatgggcgcgaacacattagttggttgcgggtcattgttaccgttatcttggtcctattcttggttaacgccgttttgaataccctttggattgtgatcatgggtggcatgacggatccgaaggcaattacatcactcctttgggttcgtggcattaagcaaattatcttcttgccaattcaagcgattatcctgtattttttcttgaatcacccaacgcttgagcaaatgcgcgaacgcctattattcaagtaataactgagtaaaaaccccagctttgaatttaaaagctggggtttattagtttggttagtttttagtaactctgatgaacagctagtccaatttcacgacaagctgcttcaaaccgattagcaaacttgttccgctcatccgccgtcgcaaatttaagcgcaaattcttcatagatactgccacaaccaatgcggtagatacaactgtcatagacccgcccgacaaatatcggaccgttctttgtcatcgttgcctcaaccgctccttgcagcagctttgccgtctgcaccggcatttcccgggtgctttgcatcagggtgtgtaacttttgcacacccactaacttgtttccttggcgaatctcgtttcctcgcatttgggcctccaaaacgtgttatctgacggacgtcagagtgatttaattgacaattaattataacatgtaattttattttaatgctgattgaaaatattttagtcaaccagttaaccctattatcaaaccccgcgtgttataatgaacacacgaaacatttcaaacaaaaaaaggactgctattatgagcgaatcaatttcaaaaacccagtatctccaaactattttggagctcagcagtggggatgaaacaactaagatttcaaataaccaaatcgctgaacatttgaatgtaacgccttcttcagtatcaaacatgctggcaaagttgcaagaagctggcgaagttgacgttgtgccatactacggggtaacactaactgaacctggtcgacaaacagcgttgcgcttgattcgatcacaccgcttgattgaaaccttcggtgccacaaagctcgggttgtcgatttcagaggcgcacttcaacgctgacaatttggatcacgatgctgatgttgaatttgttgacgcccttgaacgtttcttagatttcccaaagtacagcccccacggcctactaattcctgacgccaactttaattatgaacaagagaagttacgtactttgcgtgaagccaaggatttagaaaccgttacgttaaacagtttcactgaagatttggaattactacaatatgtcgaaacggttggccttgaactagggacaacttggacaatcaaggaacgcctgccatttgatggcccacttgtattgtcagatggttcacgtgatgtgcaagtcacgcaacacgctgccgactttatttttattaacgattagcagaaaaagcggatgagactaaatctcatccgctttttgtttgacttacttaatccaacgattatctgctgtaaatgctgtttgaattgacttaggcgtcttatcccaagttgttgtccgttcaagttcgccgcgcatcatcacatgcccgcgttcagccgtataatcacatgtaatcaacgtcaccaacttcttaccagctaccggatacacccaatcgacatcggtcggcttaataactttaaagtcaacggcccgatactcgtaaacgtgattcatatccgttaaataaattttctgaccgactgcacccttgtagtaaattggtgaaaacaacacatcgcggccagagtcgccttgaatgaagtgactggcaagcgcatagttaccttcacccatggtttgatcaggaaacatcgtccccgcccctaatgatagatttaaatcagttgtcccatttgaaattggcaccgatagaccaatctcaggaatcgcgacaaacccaataaaattaatctttcccacgttcactcgggcagccagtacctgttgcgccgttaatgacccaaccttttgccaatcatagttagccgttttcttttcagccgcccccttcttaatggacgtcttcgtcacctctggttcgtacgtctttaacgcgacatttgcaatctgattatgaaaaatcaacagcaaagaaataagtagcagcacaacaaatatgaccgctcgtagccaggcccccacgcgccgtttctttttttctgtcattatccccccacctttcttttcccattataaccatttgaaaccatcaaaataagacgcagacgtgtccaaatttataagacaattgacaaacattgcgcctttagtccattgcaaatgtcattttttcaaaccatgcaaactgcgacttgaacgtcttgatttcaccgtccgcataaaaatagtctatatccgccaacaattcagccaccgcggttgtgtacgccgactcatcacacgcaccatcatagcgggttagcaacagctgaataaacttgatgtagatcaatgccgaataatttgtcgcaaaggtaaaccgttgcacaatcgatcgtaaagcgctgacaaacagtcgtgaatcgtgtccactcgcaactcgctgtaatagattaaagattaaaccattaatctttaattcatgatgtctggttgagaaaaaacgactacgcgcattaattttaatgattttttcaagtacaggaacagttatttctggtgacaaatatggtaacgcacattgggttaattccaattcataccgtgtccaaaaaggtaacgctaataattctgtgaataccaccgtggcttggcgttgcttttcatcgtcacgatccgtgttttgccggaaatagagcatccaggttaaccaaccgtagtggcggtagccggtttgttcttgcaattgttgaatttcagcctgaataaccgcaccaccgtcatggtctgtcattgataattgtttaatacgttcagctagtcgtctgaacgttgtatcttctggaataatcaattctgccaattctgtttcagtcagccctaatccatagactaaatgataaaaatcggtgatttcaatatccgcatcccctttgacaaagcgataatacgtcgcccggttcaaaccagagtacgttaacaattgtgttaacggtatgtttttagctttgcgaatatcgttaattacttggcctacatgatcagtcatttgtctctataaccccccaggcaattcggaacaaaataacaaacgtttgggttacttccccggcttgctcagcattgtcatgaatcgccttcataaatcgactaattttttgctcggcatctaacaaaatttgtggattatgttcacgccacgcccgctcaatatcagctaaagcccgccggtatggggcatgctccaaaatatatgctgcaggggatagctcattaataaacgccacaaattttacatagtcatcgtagtttttccgagtcagcaccgtctcagccatcatcaagatattatcagaccaaatcgtcgtcacttctacagcgggaaaacgctcgcgaaattgctgtttatcaatgacgtatttttgaaactcggcaagcaatgattcaattggtgcatctggtgataatgagatgaagtataaggtgacttctatcgctgtccataggtctgttttggccactaaccggcgcatttcctgtttcaacagtgctttctgttcctcatcgtcaaacaccagtgctaacgcatattcggcaatcagcaacacttcccggtcagccaacagatgatactcctcaacttgcgcctctaaatcggtaatgatttgtttggcaagtgtgaaatcgcccatccgcatggcgcgcccaaatttcatcaaaaaacgaccataggccgataattcgccatcttcagcgtaggcaattaaattaacgggacggccacccataaaccgaattagccgaattgctaattgtaaattcagcggagtctcccctttcatcacccgataataggccgacttactcatcacgtgttgatcaatgtctttcgtatgtatccggcggttctgcttcatatgccgcatcgcctctaacagacgttcactatgcttattcattacgccactacttcttttttatagtcattattagcagtgtatcaaacatttttgtgattaaacaggtcgcccatgtcccaatcataggacacttttcgtgaaattatcattctcgttctgaacaacttgctcgtttttttggtggcgtaaagaaaaacactttgctcaccagtgcataccggtaaacaaagtgtttcacgtatcatttaggcttcagccccaccaaaattgttgatgaagtaaagcaatgtttgtaactcgttcgtcaagtcaacgttttggacgcgaacgtcacttggcacgtccaaacgtagtggtgtgaaattcaaaattccgtgcaccccagcctttgccaaacggttagccaaatcttgggcaactggcgctggaaccgtcaaaatagccacatcaatccgttgatctgaaatctgcttttccaaatcatcaagactgtaaactggcacaccagcttgaatcgtgttcacgatatcttcgttgatatcaaaggctgccgaaattcgcgcattagaactttggtggaagttaaagttcaacaaggcttgaccaagatttccaactccaactagggcaactgaagccaaagtatcttgattcaaaatttcaccaaagaaagtcatcaacgccttaacgtcatacccgtatccgcgctttcccaaagcaccgaagtacgaaaaatcacgacgaattgtcgcagcgtcaaactttactgcatcagaaagctcatttgatgaaacacgtgttgtgcccgcatccagcaaaagcttcaaataacggtaataaattggcaatcgctttgcggttgcgcgtgggatgtcatgttctgccatgtcagccgtcctcattattctttattttttatctctaagttatttcacaaataaattctcacttgtgaactctctatccttattaatagtaacatataaccgcccttatgtgaactaaataacaattgtttttcacaaaataaaaggaccactcgtccggaaaagtggtcccaacgcctaaacatcgccgtttttcagacatgttttagccaatatttttttcattaacgctttggcttacccttgtttttgctgtgcttacgcttcgcctttttctcctttgcaaagcggtccgttcgcgacacaacttcctcggtggcttgcttcttaggcgctttcttgcctagacgaggctttgctggctgctttggcttggcaggagctggttgttgaccagccgcttctgccgcggctggtgttggtgcgccagttgagccagaaaatgacttgggtttagccgcttgttcaactcccgtcacaagttggatatcaactgcgaccaagcgacgcaaatcacgtaaatcgtggtcatttccaaatgaaatcaccaagccatgcttacccatacgtccagtacgtccagcacggtgcgtatacgtctcaccagtgcgtggcaaatcaaagttaatgattgcgggcaaatcgggaatgtccaagccacgggctgccacatcagtcgtcagcaagaattttgctgtccccttgcggaagttttccaatgacttcgcacgcgttgaactagaatcaccacgaactagggttgccattgcgacgtgctcgtgggctaggaaactagctgtaatcttcaattgcttcgttgtgttaaagaatacgatggcttggaaattcttgcgggcagctaactgacgcaaccgcttattgcgttgctcacgggctgttggccagaactcatgtgcaatcgcagttgggattggcacgttccgttggtcaatgcggttaaattcacggtcaaatagaccagccgcaatcgtttgatcgacttccgtagcaccaaatagtgccacctgcacctcttgatcatcgacggtatcccaaacggcatcaatttgcttagccgtatcttcggtcaagagttcatccgcttcgtccaatagcaaggtgcgcaaacgacgcaactttaacttaccattatccacaagctcagccacacgcccaggtgtcccaacaatcacttcaggatgctttttcaatgcatccaattggcgcttaacattcgcgccacccgtcaaagccaacacctttaagtctaatagcgtcgcccactcacggaccacccgtgtcgtttgcatggctaactcttgtgatggtgccaaaataaggagttgctcaccatcccctggcactaaagttggtaacaagggccatgtaaaggccaaagtcttaccagttcctgttggagccaatgcgtcgattgattcacccttcgccagtggttcagccacggcctcttggattggcgttagggttgtaaagcctactgatgccaaacgttcttcaaaacgagtatccattctttttcctcatgtcatttcgtttacttttcgttcctttcattgtaacagaaaagcacgcttcataactgttcacgaacagattatgaagcgtgcttgcaaagattacttatctgctgggaaaacaatgccagcatcttgacgcaaattggttaacacaatattcacgcgttgactcaacgtcagcaattcgcgatatgtcgcatcttgaccaactgggtcattaataatcgcggcgaatacttgcatctctggcaccattggatttgcaggtactggtgtgctgatttcagtgtcgttaccagcaccatctttataaatgacttcgcccaattcagcgattgaatcaatcactattgtgtcacgcatccccaaaatttctgaatgcaaataactgttggctcccttaccaaattggatcgtcacatcaaagtcagcgtagcgcaaaatggcaattccgcggccgtctgccccattacggagtggcgttgcaaaatagtgactttctttgggcatcccaaacaacttaatcgctgcatacagtggataaacccctaaatcagtcaatgcgccggcactaaactcgcgggttaagacatttggttctttacctgccaaataatcgtcaaagcgtgacgaatacttttcatacactaacgttgccccggaaatatgcgccatctccgccactttcgcttcaatcgctttaaaattagcttgatgcacgtgacgagctgcttcaaataagcggacattggggtgctcacgcaaggcagagtaaacggcttcatattccttcgtatttgaaaaggctgacttttcaacaatcacatggagatcatgtgcaatcgcctgcagggtttgctcataatgcaagctatttggtgatgcaatataaacaacttcaatgccactctcataaaaggcagctaaatcggtataaaccgcaacttccccaaagtctttggcaaacgcctcaccagtctcggcccgtcgtgagtaaaccgctgttaattggtacgcttgcgattcatgcgccgcttctaccaacattttcgtaatccaatttgtgccaataattcctaactttaacgtcatcattcactccttagttaatctatatcccactttaaagcgctttcaataatgctattgtaccatcaaaagccaaaaaagctcatcaatcatttgaaatgactaatgagcttaattgggttatcgatagtttttagtttttaaaattagtccttaacgaacacagtgacagattcaatgtgtgtcgtttgtgggaattggtcaattggttgaaccggcccttgaatgtggtaaccgttctccaaaatttgaaccgtatcacgtgccaaagttgctgggttgcaactaatgtacacgaacttttctggttccataccagttgcagcatcaatcaattctggcgtcaagcccttacgtggcggatcaacgaagatgacgtctggtcgcataccagcttcatgccattcaaccatcttctcttcagccttaccaagttcaaacttagcattgttaaccccgttaatgtcggcgttacgcttggcgtcatctacggcaccaggtacaacttcgacacccaagacagacttaacacgatcagcgatggtcaatgaaattgttccgatacctgagtaggcgtcaataacttcttcatcaccagtcaagccggccttatcagcagccaattggtacagcgtttccgtcgtttgtgggttaacttggtagaatgagtttggtccgatgacgaacttcttgccgaacaacgtgtcggtaattacatccttaccccaaagcgtgttattcttttcacccaagatgacattcgtcttctcttggttcacgttttgaatgattgactttacttctggcaacgcctcgcgaatatccgcgacaatcatttcagccccgggcaccttctttgaacgcgtgaccaaaacaaccatcatttcgtggctgtagtaaccgcgacgaaccatgatgttacggataacaccagtgtgttcaaattcgttataagcaggaatgtggtacttacgcaagatatcacgaataaccacaattgccttgtcaatttcagggtcttgaatatagaaatcttcaattggcatcaagttgtgtgaaccacgacggaagaaacctgtcgtcaattcaccacgcaattcacgcgttggaatttgtgccttattacgatatcctgttgggttttccataccaagcgtctcagaaacttcaacatcaacgtgttgcttcttaaacaattcttggatttggttttgcttgaaacgcaattgggcgtcatagttcaagtgagccaaaggcgcaattccagttgtcaatgtcgcaacatcaacttccttattacgatcagcagattccttcaacgtcttaataacgcgaccaaatgcatacgttcctgcaaccttcgtaatgccgacccgaatttcttcacccggaacagcgtttgctacgaagattggaaaatcatcaaccttaacgactccgtttccttcgtacgttaagtcgatgaccgttgcgtcaaattcttggttcttcaccactggcgcttttttcttcatcataatctcctttagttggccttttcgacgaccaaatgtacttacattatagcataaccagaacactcacttaatgaaatccccgtgagaatccgcatttagaaaatttcatgaaaactaaaaaaagacaattcgtattcagaaacgagacttgcgataattaacttaatgattaaaacaatatagcgggtatcaatatggactggatgctacagaaaaaagaacgtgaaaaactttggttaaacacctatttgctacaacagaatacagacacagttgccgttaaacaagttgtaaaagaattgggctggtcgcgctacttagtccaaagtaacggcattgacttagtgcgcgatttacaggccttacaccctgacgcaccaacgctgattgcatatgacgagcataaaaaagtattttcaattaatgccgccttggaaaccgctgagcatgcactacgtctccactatctccaccaatctttgcggaatttgttccttaacgatttgttttttgaacgcctaacaagtttggaagattttgctgaacgacataataccagcatttccacggcacgcgaaattaaactctatctggctaaaaacttagcccaattcgatattagtattagtgatgatttgaaattagttggcaacgaacgtggtgttcgtcaacttgggttccaaatcgtctaccactactatgcggcacaagaagaacctttcccggctgcagaccgtccgccactcaaagcaatctttgaaacctttttagctactctgccacaacccttacccgaatcggccaaactagccttctattatcaatttgggatttggcattttcggattgctcagggtcatcaattacacgccgcggttacggatcccttgtttcgaccaacggcaacgttgactggtccagttcgacagtacaccgctgctttaactgatttactgtgtaagcaaaccggtctatctgccgatacgttagacatcgaaatccgttacgcgatgacaactttggtagccatgggatttattcctgaggcaacgccagctgatagcgcgacgacagaaacattagcgacattggctgtgtttactgacattatacaatcaagttacctgagttttttcaaaccacaagagggtttagaaaccacggtactagccacgattggccaagatttatacccgttgcatctgcgcttacttcatttcaatcaacacccaattgatagtcacccaaacattttgaatgcctaccaattttatccgctgcataccgcttacacactgcacgtattacgacggattgcaacccgttttaagctctccttcgaaacggtatacaaaacattgttcacggaatatctgaacacgttcatcgaccgcttaccgcgtgagcaaatcttcccgctactaacagtgaccgttgatttgccagcacgtgcctcactagcccggtacacgaaacgtctcttagcagatatctttggtgcaaatattttagtcactaaccactatacggcgcaaagtgatttatatatcgctgattttgccctgaccgctgatcaatcacggcctgggtttgtctggcaggagattccaacaattccacaaattacgatgttgtacaatcaagtacacacgttaactatccaaaaattcgaacaagttaccggtaaccagattgaacgaattactaacaaccaaactccacgtgcataaaaaaatcccactcctaatgcaaactgcatcaagagtgggatttttaatatcattacaaattacgcaatgcttcaattcgcttatccatcggtgggtgagtcgcaaataaacctgctaacttatcgcccttcaatgggttcgcgatgtataaggctgcgctctctggtgaaacattctgttctgacataggttcactctgcgagattttcgtcaacgcattaatcagaccttgtgggttacgggtcaattcgacggcccctgcatcagccaggtattcacgatttcgtgagatagccaactgaaccaaggttgccgccattggcgctaatagcaataccaagagcgacacgacgataccgatgatattactaccaccaccttcgcgatcccgatcacggttaccaccaccaaaataccaaaagtgcgtgcctaaattcgccaacaacgcgatcgctgaggtcatcgccacagcaatcgtttgaatgcgaatatcatagttacgcacgtgcgtcatttcgtgggccataacgccttcaagttcttcacgattcaagcgttgcagaatgccagttgtcgctgccacggctgcgtgttgcggatcgtttccggttgcaaatgcattgggactgggatcgtcaataatgaagacacgtggcatcggcacttgtgcgacaatcgccatgtcttccacgatatgccacaagtcaggcgcctgatctgctgacgtcacctctgtcgcgtgattcatcgacatcacgacatcagttgattggccaaacataaagacggcatacacaattcctgcgactaacgcaatcacgacacccggcatccagcgcccaaacatataggttcctaacgctgccccaaccacgcccatgaacagaaagaaaccaaagaagagcaaaaccgttttgcgcttatttttggcaatttgttcaaatagcataggtcactgttctccgtttataatccttgatcgtcaaatgataccttaacaactgctttctcttcttccggcgtttgcaagaattcacttggttggaagtgatgcatcttagccacaatgtttgatgggaacgattgcaacttcgtgttgtaatttgccgtcgtcgtgttgaacaattgacgtgagtacgcaattttattttccgtgttcgtcaattcatccattaacttgttgtattgcgctgacgccttcaaatcagggtacgcctcagcaaccgcaaatactgacttcaaactcgttgtcaattggtcagaaatttccattgcttgttggtggtcaccggctgggacttgcgtcaatgcgttacgcaatgacaccactttttctagtgtgccttgctcaaacttggcataccccttaactgtttccagcaagttaggaatcaagtcatttcgacgcttcaattgcacatcaatttggctccaagattcctgggtttgcatacgtgaacgtaccaaaccgttgtagattgacatccaaatcaatccaatgacaacaacgactgcaattataattaaaatcgtcatgttttatccccctagtggtctattttgtactactttcattttaccagaaattcaactttgtcgtgacaaaattacacttgatcaaaaaatgcctgtgtgaattcataacgatcttttaaccaagatgtgttatcacgtgatgggtggacccgatttgtcaaaacgacaagcccctgcatcgtccgataattaatcgccataattgttcctgtgaagcccgtttggtacagccaatcggtcacgacgactgggttatcttcagcaccataggtccaaaaatgccaaccaaacgttcgaatgccagcctgattggctgccaaataaccggccatgtttgccggtaaatcgtcatctggcatcaaccactcgtgtacaaatgacaatgcatcagatgcggtcgcaaacatccccgcatggccagccgcaccacccaggaggtatgctttgaaatcatcaacttgtccctgtaggatgccgccacgaaccggcacgtcttctgttggcacaaagcgggacgttggtgcctgcaaaccgccaatgcccgggacacgatacccactcgccgttaatttttttggcgtcagtaaattagccgtcatatccgtcaccagtggcaacccagtcacagcagttaacactttgccgagtaacatgaacccaacatctgagtattttgttacccggccaggctcatttattaactcaccagccatgatgtctgtttccaacatcgatttcgttaatgctggtacttggcgcacactacttggcaggccggcattatgcaagagtaactggccgaccgtaacacggtcattaccataatccggtagaatgcttttgacagttgtattcggcgtcacttggcctgctttgaagatttggatgaaacgcatggtcgtatataacttcgtcaagctcgccaagtcatagatgtggttaaccgacaataactcatctgcaaattgaccggtgccaactttaccgactgacgcgatttctttttgacctttgaagttaaccaccccaactgttgccccaaacaaacgcccgtcatcaaccatcgtttgggcaattttttcaagccgttcaattaattgatccattagcctgccctcacgacgtcatgcttttcatatagtgatagcgaagctgggcaatcgtcacatccccattaccttctgggaaatagatcatgcgattcgcactatcgatccggcgggaccagccgccatccaagccagcttgtaactcaggcttcccagtcccttcaaagggcgtgcgaaagacttctttcaatagtttattaatttttttaatcgtctttggatcttgtgtcaaaaagtattgatagtcgtcgaatgcttgttcggtaaaaatcatctttttaccgccccgcataccgtcggctagctttttagctgctttcattgccattaggcatcacctcatctcttgatgtatatggttatcatatcatgtggaaaaaatagttcgtttaaaaaagaccgccacaaccaaacaagttgtagcggtcaattgttattattagtctacataagtggcaattgttgcttgaattgcagccaattcatcagcagcagcttgagccgtagcaccctttgtaccgacatagaacttaatctttggctcagttcctgaaggacgaacagcaacccatgaaccgtcagccaaccagtacttcactacattggcctttggcaatgtcattggtgtaacagccccggttgttgtgtccgtctcagtttgcaatgagaagtcttcaaccttggcaacctgaacaccaccaaattcagcgggtgtttcggcacggaacttgttcatcaaagcggcaatcttttcagccccgtcaacccctgcaaacgtcaatgacttcgtgttttcaacgaaataaccgtattgctcgaacaactcttgcaaaccatcgtacaacgtcttacccaatgacttgtagtaagccgccacttcggccaacaagaccgttgcttggactgaatccttgtcacgtgcaaacgacttcaccaagtaaccgtatgactcttcgaaaccaaacaagaacgtgtgctcgttcgtgtcttcgaagtgttgaatttgctcggcaatgtacttgaaaccagtcaacacgttgattgtttcaaccccaaagttcttagcaatatctgctgcgaattctgaagaaacgattgacttaaccaatgccccgttggcaggcaaagtgccggcagccttcttggctgtcaacaagtagttcaacagcacagccccaatttggttacccgtcaacaattggtactcgcctgatggttggcgtaccgccgtccccattcggtcagcgtctgggtcaactgcgataacgacatcagcgccttgttccttagccaaagcaattcccattgccagtgcttcgggatcttcaggatttggcaacttaactgttgggaaatcaccgtttggctctgcttgttcaggcacaatggtcacgttttcaaagcccgcattttgcaaagcttgtcccgcaatcaacgcacccgttccgtgcaatggtgagtacaccaacttcatgtccttaccgaccgtatcgattaattcttggttaaccgtcaccgtcttgacttcagccaagtaagcgtcatcgacttccttgccaatcttgaccaacaaaccagcagccaccagttcagcttcatccttaactggcacttcgaacatgttagcttcacgaattgaagccgtgatgatgtctgattcctttggtggcatttgcccaccatcttcaccataaatcttgtagccgttgtaatcctttgggttgtgtgacgccgtaatcataataccggcatacgcatttaagtggcgtaccgtaaatgacaattcaggtgttggacgcaacgtctcgaagacgtacgccttaataccgtgagcccccaaaaccttagcagattcaattgcaaattctggtgagaagtgacgtgaatcgtaagaaatcgcaacaccacgtcccttaactgcatcatccaatgaatccatcaagcgggccaatccctcagttgcttgacggaccgtaaagatgttcattcggttaattccagcacccaggataccacgcataccagccgttccgaatgaaagtggttggtaaaaagcgtcttcagccgccttgtcatcagttgcaagttgttgcatatcagcttgcaagtttgctggcaaatcagtgcgatctgcccaaatttggtaattatcttgccaagtcatgtttcaaaattctcctttgtataagtccccacgcttatcactaatgaaataattataccatatgctgattttacgatatgaattttattagcattcccaaaaattaaagctatttttaattcacagataaggcacagttaaccccaaaagtatagactagagttaattagtttaatgcttcatgttttagaggagaaaaaagatgcctgtactaaatttaaatgacgacgttgctgtcgctagatataatgcgtttatccgccaatcacccaatgcccaaatcagtcaagatttaggctgggcgaaggtcaaaaacaattgggaaccctgctatgtttatttagaggataccgctggaaacatcacggctgccctatccatgttactgacgatgacaccgagtggcaaaaaatttgcgtacgcgtcaaagggacctgtcatggacatgtccgacctcaccacttttgatcaactcattgcgaccgcaaagcaagcgttgggcgacgatgcctatttgctccgtttggatcctgaagtacgctacgatgcgcaatttgaagcagatttgcgggcccatggttatgaagtccgtggtcgtaatgtggcagaccaagggatgcacgcaaccattcaaccacgtctaaatatggtgattgattttgccaactacccagacgcgacgtcgctctatgatatggtcccttctaaaaccaagaacaagttgcgcaagcctgaacgtgaaggtgtcgtcgttgactacggactagatcagtcattcctagacgacttctttgaaacctacgtcatcatgtcaaatcggcatggcatcacccaccgaccaaaagactactttgaacgcatgatgcagacgtatgccggtacggatattatgcggatttaccgagctaagaaggatgatgtgttgttagcgacaacaattggcttcaagatgggcgataaaatctgggatatgtacgctggttcaatcgaccacgatttgaccaacgcccattacgccacccgtgtccacatggtgcaatgggcgcttgatgctggcttaaagcgttacgacatcggcggcatcgatcatgccgataatactgatggcttgtataagttcaagcgtaattttgtccgccaagacccaactgagtacattggcgaaattgacgttgtcttagatgatgcgatttacgacgaactggtgcgtcagcctgatcaacaacactaacgaaatcaaaaagccgccaatctaccgattcaaaatcggcggattggcggcttttaaacgtgttcaaagcactttttcggcacacgtgctatttaatcgttttgggccgggttaagtccataaactctggttgcaacaatggcgtaaacggcgtaacccccgttttaaaaacatcattatcaacgtaaagaattcgatcaaccacggcctttgttttaacccggtaaaccggcgtggcactttcgaatatcatgtagaaccgatttgtatcgccatcatatgaaacagcttccaaatacggtggcatcgtgactgaaacacccttggtgaacttatcacccgcttcacggtcatatcgaactaacttaccatcaacattcccaaatgatgacgtcatcagcacatgtcgctgattagcagtcaatccttgtaactgtcccactgaggcgtacaccttggtggctgctacaatcgattcatcctgatcacctgcgctttgtccaagcgttaaattaccggaagcatctttaccaaatggcagttcctgaatatttcctaagccccgtttggtgaaatagccgacccacagtgcattattggcatacatcatagtcgagttattcgtttccgtggtaatttggaacacctgctgataactaattggcaagcgtgatcggatatcatattggtcaatttgtgcctgcgtaatcccgtatagcattgagtctttgccatcgtgccctgtcacccaaagcatttggcggtctgggtcataggcaacaccacccgcatggtcctgaaattgcaatgacagcgtcttaatatattgacccgtccactaattgagcacataaataaccgaattggctttgttattatgatcataagctgatacaaaaatttcattctgactggttgtgataccttgtggatcaaaggcaaccgtctttattaggcgatgcgatgccgtggccgatttgttcttggccaacgcccacgctccctgtaagcccggcattgggatcatccgttgaatgccagcccgtaactgaggataccgcgccaaactaattcgcaagcgcttttctgtatacagtggcatttgcgaagcttgcccctgcgccaaatgtttcgtcgtttggtgaacgggggtggccggttgctgcgcaagccccacccacaccaatagtatcgacattaccaataagattgcccacacaatccgtttaaccattcgcttatgcctgtctctctataattgtgatctcatcaccaccaataatcactgcatcggccacttgcaaaaatagcccgtgttcaactaccccaatcgtttgctcaagataataagcgagcgcttggggatgtgtgatttcagttagctgtaaatcaataatgtaattacccgcatcagtcgttaaacgtagaccatctgcgttgcgccgaaattggggatgcaaatcagcatctgcaaaccgttttaataattggtgactaccatacggcacgacctctactggcaacggaaacgttcccagcttcggatgatacttagattcgtcaataatccagacattccgacttgagttcagcgcaacaatcttctcaaacagtagcgctgccccaccacctttaatgccgtttaaagcaacgtcaacttcatctgccccgtcaatcgtgatatcaatttctggtacttcatcaacggatttcaatttaatcccccagcccttagccagagaagaagtttgacgcgacgtggtcaccccaacaatatcaagcccttcctgattaattcgcgcggccaatcgctcaataaagaatttcaccgttgagcccgttcctaagccgacaaccatcccatcttcaataagactcgccgcatattcgcctgctgcgcgtttttgttccgtttgtttgtccatggctttcccctttaccgcgacaactgtcgtttttaactgcctttattgtaacggccacacacaaaaaacgccagattatgataatctgacgtccaaaatgaataattgcaaattttagaatgcgcggaaacgggcacgtcgcttagcaactaactcagtcgttgttaagctttggagttgctgaatttcttctagcaactttgcccgaaccaaattgaaaactcggttgtgcgagcgactttctggcacaatgtactcaatgataccgttcgctaaaagatcattgggtgttagtcccattaattctgccgcctcgccactgcgtttagcatctttccacaaaatggctgcaaagccttcaggagagagaattgagtacgtcgcattctggaacatccaaacttgatcggatgttgctaatgcaagcgcaccacctgagcccccttccccataaacaatagcgatcatgggaactgggtacttcatgctttgcaagatactgtcggcaattgcttcaccttgtccttggtcttccgcggacttaccaggaaatgcacctggcgtattaataaatgtaataattggtcgaccaaacttagctgcttgatccatcaaccgggtcgccttacgataaccatatggttcaggtgaaccattgcgtttcgctagcttatccttaatatcagttcctttatcgatagcaatcaccgttacgggttgaccaccaagattagcaagtccaccaatcacacttgcatcatctccagcataacggtcaccatgtaactcgataaaatcagtaaagatacctgaaataatctcacgtgcagaaaaacgatcttcacgtgatttcttaaccacctgcactggggttaattcacgacgaaatagtgctgccattacttaacctcctgtgtttggtggaatcgtaccaattgtgcaagcgttgctgtcattgctggtcgctgtacaattgcatcaataaacccattttcaagcactgtttcagcccgttggaattcctttggtagcttttcatgaatcgtttgttcgataacccgcttaccagcgaatccaactaacgcatgtggctcggccaaagtaatatcaccttgcatcgcaaatgaagctgtcacaccccccatcgttggatcggttaggatcacgatgtaaggtagccctgcttcttgatgcgccgcaactgctgcactaaccttcgccatttgcatcaatgagtgaataccttcttgcattcgggcaccaccagaagccgtaaacaggatgaccggcaacttagctgccgtcgcatgttcaaagaggcgggtgattttttcacctgtaatcgtaccaagtgaccccataatgaagtaggaatccataatgcccaaggcaaccttttgatcttccagagtcgctatccctgtcagaactgaatcgcccaattccgtttgttgttgcgcacgttccaatttaccagcatagcctgggaaatcagtatcggccaacttcaaaccagcatcaagttcttcaaaatcagttgtcatcaacgcaacacgttcacgcgcttgtaagcggaagccatagccacaggctgggcagacacggtggtcgcctaactgctttgaatatagttgggcgccacagtatggacaagccaagaacaaaccatccggaatacgatcattcaagttcgcatcgcgtttgatcttgggagttgaaaccgtggtgttattaaataaatccattgaatcgcctccttaatcagcagctggcaaactagcttgccaacgtggcaaaaattctttttccagatagcgcgtgtcaaacatgccacgtgctactgttgggtcgtgtaacaacgctttttggaaatcggcgtttgtattaacaccttgaataactaactcatccaagatacggtccattttcgtgaccgcttccaaacgattatccgcgtggaccaaaagcttaccaatcattgaatcgtagaatggttgaatcttatcacccgtgtaaatagccgaatcaatgcgaataccaggtccaccagttggtagaaaggcaaaatcaattgtaccggcactaggcgcaaagttcttagcgggttgctccgcgttcaatcggacttctaaagcatgtcccttaagggcaatatccgcttgtgatacctttaaaggttcaccagcagccacttcaatttgcatccgaatcaagtccactccagttaccatttcagttactgggtgttcaacttgaatacgcgtattcatttccatgaagtagaaatgaccatcgtgatcttgcaagaactccaatgtccctgtattttcatactgcaaggcattcacagccttagttgcaatgtcacctagattttcacgcatcgctggtgtcacaccaagcgctgggctttcttccatgaccttttggttattacgttgtagtgaacagttacgttctgggaagtacaacacatgaccaaattggtcacgcatcacttgcatctcgatgtgacgaacattctccatcaccttctcaacatacatgtgttcatccccaaacgcagctttcgcttcacgttgcgcatcatcgaacttatctgctaattcatcttctgaataaacaaatcgcatccccttaccaccaccaccggcagcggctttcagcaacaatgggtagccgacccggtcagcgaccagcttggcttcattagcatcacgaatgaacccttctgaacccggaataactggtacgccagccgcacgcattgattcacgcgcatttgccttattacccattaattcgatgacatgggggcttggcccgatccacttcaaaccaacggcttcaaccatttcaacgaataattcattttccgataagaaaccgtaacctggatgaatcgcttcagcacccgttaacaacgcagcactcaagatattcttcatgttaaggtaactatctttagactttggccccccgactgaaatcgcttcatcggctaatttcacatggaggctatccgcatcagctgaagaatagatagcaacagatttaatgcccatttccttcagtgtacgaatgacacgaacagaaatttcaccacggttcgcgactaacactttcttgaacattttaatctccaataataaacgtcaaatcagcagtagtagccttcttaccattaacgtaagcaacacccttaccttcaccaattggaccgcgcaaacgatcaagcgtcacttctaggcgcatttgatcaccaggttgaaccatcttacggaaacgagccttcttaataccaccaaagtaagctgtcttacccttaaattcaggcatcgaaagtaatgccacggcgccggcttgtgctaatgcttcaattgtcaacgccccaggaaatgttggattgcctggaaagtggccttggaagacttcttcgttgatggtgacatttttgatggcaaccgtcttttcacccggcaccaactcctcaaccgtatccaacatcaacattgggtaacggtgtggcaaaatttcttgaatttgttgtgtatttaatactgacattgccgcccctccttaagcatctagttcgacacggaagattgcatgaccgtaatcaaccacatcctcttcctctaccaaaatttcagtgatgacaccggcaacttcactcttcactggtgtcattagcttcattgcttcaacaatcgcaacttgttcacccacagcaacgtggtcacccacttgcttgaaaggcgcagcatccggattggccttcaagtaaaccgttccgaccaatggtgcatcaatcgttacgccttgcttttgttccttgtccaaaggatgatgttccgttgcgacaggcgcttctgctgtcgcgacactcgcaacagttggctgcgcaggtgtcgtgacaacaggttgcgtgatttcgttcttactcaaatgcaaactgaaatcatctgattgcaatgaaaactcacgcaacgaactattttccaaatcttgcatcaaagcgcgaatgtcatctaattgcaaacccattaattctcactccacttcttgaaaataacagcggcattgtggccaccgaaaccatagttagctgacaaaacgtagttaggcgcaacaaacttgttgtcgtcgttaaccaacgtcacaccagcagtttcaggatcttgttccgtcacaccaacattaactggcaattgttcacggaccaaggcaccaattgcagcaatggcctcaatggcacccgctgctcccaacaagtgtccagtcatacccttagttgatgaaaccaagacgccgttcttaccaaagaccaattccatagcctttgattcagccgcgtcattggcaccagttgccgttccgtgtgcgttgacataatcaatgtcgctcgcttggataccggcgtcttgcaaagccaacttaactgaaccagctggtcctgatccgtcaggagttgggctggtcaagtggtaagcatcagagtttgccccgtaaccaaccacttcggcgataatttctgcaccgcgggcttgcgcgtgttccaatgattccaagaccaagattcctgaaccctcacccataacgaaaccgtgacggtttacatcaaatggctttgaggcttcaagtggatttggttcagttgacaaggcagtcaacgctgcgaaccctgagattcccatttcgttaaccgtcgcttctgatccacccgtaaccatcacatcatacttacctgattggatacgccagaaagcttcaccaatcgcattcgtcgcactggcgcacgccgttgacaatgtgtagttaattcccttggcaccgtaacgcattgacacgttacctgacaccatgtttgggatagcgtttggcacgaacattgggctcacacgttgtggtcccttgtcgtgcatcttgataacttgttcttcgatagtcgtcaaaccaccgattccgttacccatgataacgccgaaacgatcagggttatcaacaccatcggccaagccggcgttttccaatgcttcaccggtagcgtgaacggcgtattgtgaaaacaagtccatcttacgtgactcacgctttccaacgcgagcagcgggatcgaagtttttcacttcaccagcaactgtgacacccgtctcagtggcgtcaaactttgtaattggtgcaattccaacttggctgttaaaaatcccatccaaaaaatcatttgctgtattaccaacgggtgtaactgcacccaaacctgttacgacaactcgtgtcatgttgttctcctctactttcctaaagcttggatacgacttattaataagttgtaaaagaataagtgcatcaagtcgtatccgttttccttagatgtacaacccaccatcgaccgtaattgtttggccagtgatgtaatcgttttgagccaagaacaaggcagtttgtgcgatttccgtcgcgtttccaaaacgcttcaaaggcacagcctctaggacttgttccttaaccttgtcagacaacgcatctgtcatgtctgatacaatcatgcccggtgcaatcgcattaacacgaatgccacgcattgcgccttctttagctaatgactttgtcaaaccaacaattccagcctttgacgctgcgtaatttgcttggccaacatttcccatcaaccccacaacagatgccatgttgatgatatttcctgagcgggcacgcaacatcttcttaaagattggctgcgtcacgttaaatgtaccgttcaagtttgtattcacaacgtttgcgaattcacttggcttcatgcccattgtcaatttgtcgtcaacaattccagcattgttaatcaaaatatcaatgccatcaatttcttcaaacaaaccagtaagggcgttattaacgctttcctcatcagcaatatccgctgtaatagcgagtgtgttttcaccaaactcagccatcacgtctggtctaacggccgaacgcccgtgtaaaattacccgagccccagccgcatcaaaggcttttgcaaccgctaaaccgataccacgtgtcgatcccgtgatcaacacattcttgtctgttaaatccattacactgtctcctgtgccgcaatcaacatatcacgaacttcattaaatgaggccaaatccttcacgcagtagcgcttgatatctttaccaacaattttctttgcgaatttcatcaaggtatcacttggtccaaactcaattagcgtatcaacaccatcatcaaccattgcttgcaatgcttgtgcaaaataagttggtgacgtaatttgctttaacaaagtcgctttaacatcgtcaaacttttggcccgttgtatttgagtacaccgcaaatgttggtgcgctaaacgtttcatccgttaaacgatctgccagttgatccgcagccgtttgcaacaatggtgtatggaatgcacctgaaaccggcaattcgaccatgcgtgagacacctgcttcagtcaatgcggccattgcctcatcaacatcagcttcgattccaccaatgaccaattgattaaacgtgttaaagttcgctgggtacacgcgctttccagtagcttgcaatttttcaagcgttgcaacaaccaagtcttgatcgtccgtcattacggcaaccatcttacctgggtttgcatcaccggcggcttgcatataagcaccgcgatccttaataatggccataccttgctcaaatgtcattgacccagcggctgttaatgcactgtactcacccaaactcaggcccaatgcaccggctggttcaggcatcacatctgacaaagcattgtagatgcccatgctcattgccaaaatagcaggttgtgtgtacttcgtttgcttgatgttatcttcactattcacaatagtcgtcatcacatcgtagccaagtaattcactcgcatggtcgattgtttcttgatatttaggcagactggcatacaaatcagcacccattccaacttgttgcgccccttgcccgctcatcaatagtcctagtttcatgttttttacctcgttgtttggttacttcaacaagtcttcagcttgtgaccaaacatcttctagaatttcagccactggcttaatctcatgaatcattcctgaaatttggccagccatgaaggccccattttccttgtcaccatcaagcactgctcgacgaagagacccattctcaagttcttcgattgcatctgcatctggctttggctttgtaatttcaatgcgctcttgctttacaaagttctttgacatcttagtcttcaagacacgagcacggttaccaagtaactctcccgtcacaagcgtatcgatatcctttgctttcacaacagcattcttaaagttttcatggacctctgactcagccgaagccaagaagcgtgttcccatttgaacaccagaggcgcctagcatgaaggccgcagcaacaccacgaccatctgcaattccacccgccgcaataactggaatgttcaatgcgtcgaccacctgtggaaccaatgtcatcgtcgtcaacataccaatgtgaccacctgactccattccttcggcaacaactgcatcgacacccttcttttccatcatcttggccaaaccaacagatggaacaaccgggataaccaagataccgtggctgtgcaactcttcaataaacggtgatggatcacctgcaccggttgccacaacttgcacaccctcttcgataatgacatcgaaaacttcacggatgtggcgtgatagcaacatcacattgacaccgaacggcttatcagtcacctgacgagcacgacgaatttcttcacgcaccttgtcagccttccaataacctgttccgataattcccaaacctccagcctcagagacggcaccagcaagatgtcccgtacccgcccaggccattccgccttggatgatagggtacttcatacccaacttttcaaataatggattatttagcttaacgctcattttgtggttcctttctcttggtgctgaatatttaggcgttaacttgtgcagctaccttgttaaccaagtcttgtaccgtttggatttcttcagcaacagccaacttaatgtcaaagtcgtcttcaacacgattcaacacttcaaacaaatccaatgaatctgcgtcgatgtcttccgtcaagttcgtttcaggcttaacttcaccatcttccaagtcaaattggtctaccaagatttcagttaccttgttcaaaatttctgcttcagtcatgttattgtcctctatttcttttgtttaataatttaataattcgataatttaaatgtataggtcatatacaaaaatggttaaaaaaactacaccttgataatcaaggcaccaaccgttaagccaccaccaaacccggcaatcgcaattgtttgccctggtttaatcgtcccagcttcacgcagttcatcaagtaaaataccgatactagctgcactagtattaccatagaacgccatgttcgttgggaacttttcgattggctgaccgaatcgcttcgcaatactgctaacaattcgtccatttgcctgatgcaacagataataatcaatctcatcaggtgtgaggcttgcttttgcaagcgcctcgtttaagaccgccggcacttcgcgtgtcgcgaaattatacacttcacgaccattcatcttaaaatacggatcagcagcctttaactcacccgcaaaataatttgcgtttcgttgttgaccagctgtcaggaattctgagcgttcaccaaaggttttcaatgattcagctagtaagcctgtctctgcttcagtacgttcaagcaaaaccccggccgcaccgtcaccaaacaacacggctgttgatcggtcatcccaatcaactagcttactcaacacctctgccccgataactaaaccgcgttgataacgtgttgtcagcaacgcgctcgccatactcaacgtataaacgaaccctgagcatgccgcgcttagatcccaagcaaaagcattcgtagcgccaatctttccttgcacaatttgtgccacacttggtgataacgtgtcaggcgacattgttcccactaagatgaaatctagttgatcagctgttaaaccagcttgattcaataattttgttgcaacaccaactgctaaatcacttgtatcctcagtcgatacgatatgccgttggcgaatgccggtacgcggttgaatccattcatcggatgtgtccataaatgtcgctaactcatcattagttacgaccctttctggcacgactcgcgctgactggacgatggtaaatctttccatatcgccctctcttagaactggattagctcgtgaagatattcttgcaaattaagcacggcctttttcaccgcctcggtttcatcatcagatagagaatcaaataatgagtgcgccataccgcggtgaaaagcctcgtgggcacggaaaactgtacgtccgttgtgagtcagcgccaaatggacaacccgtcgatcattgtcatcacgatgacgctcgacgtagccctttttgactaatttatcaataacactcgtcatagcacttggtgttaagtgcaccatttctgcaacttgcgatgcggtccgggtctcatacatcgagattgccgcaatcgtgtgcatatctttgatcgtaatgtcattgaactttgattcgcgtaatgaggcttcctcaatccacacaacgttattaaatacgttgaccaatgcctcattaatctgttcgaatgatgcttcttcactagctgccatacttacttctccgtctcactcttggcattatctgccgatttctcttcaggtgaaacaacaaacatcagttcagcactagttgctaacttgccatctaccattgccttgacgtttactgttcccatgttctctctcagattaccgaattctacgtgtaacttcaagacgtcgcctggtttaaccatgcgcttgaacttggcattatcaatacccgtcatgtaagccgtcttaccgacgaactgtggtgatgacaaaatcagaatagatgccgcttgtgcaagcgactcaataattagtaccccaggcataactggattacctggaaaatgtccttgaaagaactgttcattaatagtgacattctttgtcgcaatcaatgactcaccaggcaccatctcatcaacgtaatccatatatagaattggataacgatttggaatcaaatccataatttccgtggttgtcaaaactgccatagtcccgctccttccaaaaagtatttcgaacatcgaaatattcgatattcaaatagtattttattttcatcgaattgtcaacacgccttttccaataaatatacgtataccccatttacaattaacacaaaaagcgcagaaaacgcctgtttttgggcattctctgcgcaacgcaatgctaacgtgttcacagattattcaatatttattcattcacttacaaaaagtaaataaaaaaacacacccataattcgggtgtgcctcatgattgttagtccttcttatcgaacttgtccttcagattatctaccgcatcctcggccttgtccttcaaatcccctagcgcttcacgcgccttaccggttaaaccttgggcctttccctcagcctctagttttgcatcaccagttgctgcaccagcaacttccttggtcttacctgagacttcatcgaacttaccttttacttgatcttccaatgccatcagtaatttcctccatatctgtgattgcttatatcatacctaaacacagaagaaagcgctaccaaaaatatttgaagattagccatttgggaaattacagtaacccaacccgcttaaagatgtcatcaacatgcttgagatgccaatgataatcaaatgcgtcatcaacttcagctgccgtcagtttactttgaatggttggatcggcatccaccaaatcacggaactgcttttgttcatcccaagacttcgccgtcaatggttgtacagtatcataagccgcttcacgtgacatgcctgcatctaccaatttcaacaacaaccgctgtgaataaattaacccatacgtacgggtcatattcgtcttcatcgtttcagggaacacttgtaaattagccaagatacctgtcaaacgatgcaacatgtaatctagcaccgttgtaccatctgccaaaataatacgttcagcactcgaatgagaaatatcacgttcatgccataacgtaacatcttctagcgccgtaactgaataacctcgcagcacacgtgacaaaccaacaatattttcagatccaattggattacgtttgtgtggcatcgctgaagagcccttttggccacccttaaagccttcttcaacttcgtgaatttcagaccgttgcaacccacgaatttccgtggcaacttcttctaaggtcgtcccgatcaaggcgattgtcgtcatataatccgcatgtaagtcgcgtggtaacacttgtgagccaacgggttggggcgttaagcccaattcgttcatcgcaacttcttcaacagttggtggtacgttcgcaaacgtgcccacggcacctgataactttccagtctcaaccagctcagcaactcgttcaaatcgatcaatgtcacgcttggccgcctgataaaaacgggccatcttcaaaccaaacgttgttggttcagcgtgtacaccgtgagttcgtcccatcatcacagtatctttgtaacgaagggcgagttcacccaaaatatcacgatatgccaccaggtccgccttgataacgtcatttgcctggcgtagacgtaaagcttgcgctgtatcaacgacatccgttgacgtcaacccatagtgaatccacttccgttcttcacccaatgattcagacacatttcgggtaaatgctaccatgtcatggcgcgttgtctcttcaatttccgcaatgcgagtgacgtcaaagcgagcattcgcccgaatagctgccaagtccgcttcaggcacgtggccctctgctacccagcccgccgtcacagcaatttcaacatccaaccatgattggtactgattttccaaagaccaaatgtgacgcatttcaggtcgcgcgtagcgatcaatcataatataacccctctcaaattcgtaaacacgaacgaaacgtttttaacattcattattgtacattattcccgaatgatatttcaaggtaattcaaaaatgttttatttttagcgcacaaaaaaagagaccagaaaaatccggtctcttttagtttacttatctgatgattcagatgaagctgctgaacttgagcttgcttcacttgaacttgaacttgcacttgaagatgccttgcttgatgaagattcagatgaagaagatgacgtcttagcagccttagcagttgcagcggcttgcgtgtacgttgccaaaacattcttcaattgtgaatccttaatattaacgttagccttagccaattcgttaccaataattgcttgcacctttgatgaatcagacatctcgttcgtcaccaagatttccttcatcttagacttcaaagtcgtgaatgacttcttgtcatcacgtgaatccatcttaatgacaaagtaacctgagtacgtatctgacttaacaggcgtctttgtgtattcacccttcttcaacttgaaagcagccgtcttaaagtcgtcttccaaagttgtgttggttgaatcaaaggcgtccatcttaccacccttgtccttagttgaagagtctgttgagtacttcttagccaacgtggcgaacttatcaccatcgtccaacttagaaatcatatccttggcttcatcttctgaagaaaccaggataacagaaacgttcacattaggcgtgtagttcttgtattgttccttcaattgctttgtcgtaaactttgagtttgcttcaaccgcggccttctccaaagcttgcaactccaaagactccttgaatgagtcttccgtcataccgttgttagccaaagccgttgagaattgtgaaccgtattgcgccttcacgtcatcatattgctttgtaattgcctttgacgataccttgtcaccatacttcttatccaacaccttttggataatcatgttagccaattgttgttgtccttcagtggtgctctttaacttcttgtagtagtccgcttgcgaaatacttcctgaatcggtagttgcgattgacttagggcctacaccccaaacagccaatcccaaggctgccgcaacgacaaccaaaatagccactactttcttccacatggaaaaattccttctttcaaaaatttattatgtgtatcagtttaccatattatctttaagtttgcttatagcacctgatacgttgcgcccattgcaaagcgtccattatctaacgtttgcgttgtattgagatgctcggcaaaatccgcatcacgataccgcagacgtgccgttttaagacgccattgtaatgtcatgagttgatcaaccaactgctcatcagacgcggatggcgtcccaagcatatatcgtacgaccagtcgcaaccaggatacacccgtcaccttatctagaaaggcaatatgtgtgaatggcataggccgaatatcggccgcagtaatctcgccatctattggtaaccgatcaacaattaattggtacatgcccggcgtatcgatttcaagctccggccggggtaaagtttcccataacgaaggcgtcatagcagactgatccaataaaatgccgccattatcttgatggccaatcccgatgatgtgcaattcaaccccgtcatagaaataattaacgactgtctgttcaccttcactcaacatgctacttggcaagtatttttctttggcaatcacttgcacattgacccccatcttacgtaactgggtaatcaacttaatgcgattgccagggacgaacacacgggttggttgttcaatttcaatcacattcatcacgtctgaaatttcaagcggttcataatattgcttatcaccaagttgcggtatgaaagttaaatcagtcggattattattcatcaaaattgtctttaaaccttgactccgaagttcatcagccaccgtcgccatcacatatgaggctgcggcaccatcacctagacgaaaggcgccagtcccgataatcaaagccgaatcgtcacctaagcgttcactttcgttttcggattcgaaagtcgaataaaactgcgaaactgactcttcaaactcccccgccgatggttcaaacgccttgtaggttggcaaaataccattatcccaacgataacggcgtactgcctcgtacttttcatcccacaatttagcaactaacccgtctgacaagccgtaatacttggcttgttggagcacatccgcttcccacggattatctttcacagcttgctccagattattaagtcgttgcagcttgtagaaataaaaggcattaattttagttaattctgccaattcatcaacggtatacccccgtcgtaaagcctcaagcaagaccaaaatccgattatcacgggggtgaatcaactgctcaacaatctcattatccgttaacgcattcatcaatgttggtgaaaaattacgattgttaaagtgtgctgctcgaatcgctttttccaacgcttcttcaacactacgaccgacaccaatcgtagccccaactgatttttgcacggtatctaatcgattttctgtcttgataccggccgtctcaagttctccgaaggcaaacacaggaaaacgaatcacgatgtgatccatcgtcggttctaatagtgccgtgtgatcagcgtatattgatggaatccgaactgaggtcaaactttcgccaaccatcaagcctgtaatcactggtactaatggataacccgtcgccgtaacaaccattgctgaggtgcgatcaaagtacggtgtgactcgagtgatgacaaattcttcattcgccggattaaccgcaaagcgaacttccaatagaccttgcacgttaaagccacgcgcgaccgtaaaggccgcgttacgcaaagtttggaacattggatcaggcaacgtctgcacaggtgtaatcgcaattgaatcggctgagtgaatgccgaccggatccatatcctcgacaccgccaatcagcaaagtcgtatccatgcgatcacgtaccaccaccatcgcaatttcctggtaaccgcgaatacttttatccacgtttacttggtgggttaatgatcgatttaacgccgtttcagccgctccttctagttcttcagcatcctcaacctgcaaacgaatggtttgaccaacaggtgccactgatcgaacaaccactggaaaatcaaaatcgcgtgccgcatcaaacgcttcactaacattgctagctaaacgtgtttggacagctggcaactttaattgggtcaaccgctcctgtaaatatttcgtattttgggcggcttgcatcacaggcaatgtcatccccaacactttcggcgcatcgttacctaaaatttgtaaaatttcagcactcaggcgtaccgctgttaagccgcccactgatgccacaatcgccgtaatatgttcttcgacaatcactttaaccaaatttggggccgttaattgtgtttcaatgacttttatttcctcacgctcagttgtaaaaccatacggattgtcatcagcaatcacaatttgatgtccccgcttcaccaagccgttaaccacttggtaactggcggcatcactttcagtttcacgaccaaagtcattcgctgaaccaccgattattaaaattcgctcggtcatgaaagccatcctcctcgtcgtgccgtcaccatttccataaattcatcaaatgcttgcgttgcttcaaaggggcctggggccgtatctgggaaaaattgcacactaaaagccggatagtcgcggtgacgcagtccttgaacgacaccatccgtcatatcaatatgggtcacgaacatatccgtttcccgtacagaatccggattaaccgcgtaaccctgcccctgggtggcaaacataatccgactcgtgatttgctcacgaattggatgattcatgccgtggtgctcaactggcatttgctgcaaagtagccccattcgcaatcgcaaatagttcatgtccaagtccaatgccgaaaagtggcacccgggtttggaattggcgaataatatcaaacgtttcatctggaatttggtgtgggtcacctgggccagatgacaacacgatcccatcagggtcaagattagccacttcatcaacagtcgcattatatggtaacaccgtcacattcgcatcaaaatcactcagcatacggagaatgccatttttcaaaccaaaatcaagcaccaccacgtttgcgccacgccctggattagcataggctttcggcgttgagacttgtgcaacttggcgcgtcgtcaacaccatggcccgtaattggtcaaatgcgtgcgcgtctggtacatcaacgattgacgccttttgcgtacctgttttgcgcaagtgacgggccaacgcacgcgtatcaatttgtgaaatgccggggacattgtgtcgctttaaatagtcgtgcaaactcatcgactgcagccgattagttgacacatcggcaatttcacggacaataacccctttcaccgttggcacaattgactcatccgcccgatgattaattcccgccgccccaatcgttggtgaggtaaacatcacaatttgattgtgataaatcggattggtaatgacttcctggtaaccagtcattgcggtatgaaaaacaatttcaccaaaagttgttgcaggcgccccaaacgcttcaccagcatagacggtgccatcctgcaaaattaaataacgtttcgtcatgacgtcgttcccgctatcgctatggatagcgatccctcctttccgtcaaataagcgggtcttaacgaatttcaactgaatcaacaccgtcgatttcagtgacattcacattaatacgttcagccgctgccgttggaatattcttaccaacaaaatccgcgcgaattggtaactcacggtgaccacgatccactaacactgccaaattaaccacagccggacggccattatccatcaacgcatctaaagcagcacgaattgttcgacccgtataaagcacatcatcgaccaaaataacgcgtttgccatcaatatcaatatccaattctgcctttgaaccccgatcggttgcatcatcacggtaggttgaaatatccaactgagccaccggaatttgggcattttcaagttgctgtaatcgttgtgcaatgcgttcagcgataaagacaccccgcgtcttaatccccacaatcacaagattgttaatccccttattcttttcgataatctcatacgtaatacgcgtcagtgcacgttgcatcgccattgcgtcaacaatttccttagccataatggacatccttttcacgttttttattttgctataacaaaaaggcgttacctatacaaaataggtaacgcctaaattaaactcattcgtcgcgttaccccctagccacctctctggatgactttaagaagataccttcattctagcacgaatattcgcttaattgttgattaatctgtaatctcagcatatgggtcaagctgatccaacatcgctgtaaagtagtctggcaatggcgcttcaaacgtcatatcttccccggtcgttggttgcgtgagccccaacgtagccgcgtgcaaatattgaccattacctggcaacgtcttctttggtccgtacaatggatcgccagcaactggatgaccaatataggccatatgcacacgaatttggtgcgtacgtcctgtttcaagggttacttgcagtaatgtgtacccaacgaagcgttttacaaccttgaaatgcgtcacagcatcacggccaccagcaacgacggcttgcttcttgcggtcagcggatgaacggccaagtggcgccttaatggtcccctcgttttcaacgaattcaccatgcaccaaggcataatattgacgcaagtttttcttatccttcaattgcgcagacaacgattcatgcgccttatcgttcttcgcaaccatcagcaatcctgacgtatccttgtcaatacggtgcacaatgccgggacgtaccacaccattgattgttgacaatggcgtgtggaacatcaacgcgttcaccaatgtgccggattcatggcccaatgcaggatgaacaaccatcccttgtggcttgttgacaactaacaaatcgtcatcttcatacacgatatcaagtggaatatcctcgggttgtaaatcaatttcgaccgcttcaggtaccgtaaatttgatttcatcatttggtttaacactatacttagccttcttaacagccccgttcactgttaaaatgccatcattaatccaccccgtaacttgcgtacgcgtataatcgtcaaacgcatcagccacaactttatcaaggcggccagtttggtcagtaatcactaacgtttcttcactcatatgttttcgttttttccttcaatctttgccttgaacgctcgcaaaaagctcgcattcatccaataactgtactgttcaccatcatgactaaacatgactgtatgttttgtaaattgcacaaattgcatatctgcaaaatgaattttttctgtgtggattcccacaattggtgggaagcgtagcgcatcatcatcgagatacacccgacgacggaaaattaccgccccggcaatcacaagaaagataccaaatgaccagtacgtccagacattcaaatgcgtgacctcgagccacatgacaccgccgaataatgcgatcatcacaatccatgcccagcttacccagccaattaatcctgctggttggtagtaacccttcatgactaacacgtctcctttcgggcgtttgtactattctctagtataatgaaagcagaggtatttgtcatgttaatcaagttgtatgctgacgcagcgacccagggtaaccccggtccaagtggtgccggcattgtcatcgtccgagatggcacccaaagccaacaatatgaatatttaggtgacatgaccaatcatgaagctgaatttgctgccactatcctagcctttgaacatttggcgacattagccgatgcgggcgacacggtcatgttctataccgattctaaattagttgctgatagcattggtaaatcttatgccaaacattatccggcccagatcgaccgtttaatgatgctgattgatcgttatccaattgttttaacaacctggattcccgaccgtcaaaaccaaggcgcccatcaacttgccttacaagccattcataagcgaacgaaatgattggcgttatcataaacgatttagtctttcagaacacacttaaaattaataaaagcgaccagaaaaaaattccggtcgcttttatttttttaggcatcacgttttttaataccaatacctgtccaagctgataacaatgaaaagacaggtgacaacaatgagaagaatacaaatggcgcaaacacgtgcaccggcacgcctaaggtttgcgcggcaaaactaccggcaacaccccatggtaccaagtagtttacgaccgttcccgaatcttcaactgaacgtcccaacgctaagcgtgataggcccacacggtcgaaggcttgtttccataattgacctggcagaatcgttgccaagtattgttcaccaatcatgaagttcgccgcaattccagtcacaatggtccccgtaatcacaccagcgccatgcttaattcggttcgcaagtggcatcatcacagcttgtaagattttctgttcggtcaacaagccaccaagtgccaaagccagcatgataataatcaccgtcggcatcatagctaacataccaccccggttcaaaagtgactgcaacatgtcgttcttagcggcggttttgaaaccgtttagcaaaacatcggctagcgtcgtcatattatgattcagtaggaagtaagcgcctgttacaccaacattcaccaacaaggttggaattgcggggattttcgcccaagccatcccgactaacaataccaatggcaccactgtccaccacgttggcgttagtaaaccggctagatgatgcaattcagcagcggatgccccggcatgtcccgttcctaacacaataaaaatgataaatgacacaatcaaagccggcaacgtcgtccacatcaagtttttaatgtgcgcaaacagatctgtctctgcaattgatgaggccagattggttgaatctgacagtggtgagcttttatcaccaaaaatagcgcccgacaatactgccccggcaaccaatgctggtgaaaagcccattgccgtaccaacacccattagtgccaccccaaccgtggctagcgttgtaaaggctgacccaatcatcgacccgacaatcgctgtcaccaacaaagcactcggcaagaaccatgcagcattggcgacgttgaaccccaaccacagcattgtcggaatgacatttgtgcccatccatagggcaatcaacatcccaatcagcaagaacaaaaacaacggtgctaatgccgtttgaataccggccagtaattgggtttgaatatcgtcccaagttgcgcgacgtagtttggcaaaaatcatcgttgctaacaaactaataagcaacggtacgtacggtgataagccgaggccaataatgctaccaccaaaaataataactaataaaataacgaggattaatgcgtgcccaaatcgaggcgtttctgtttgtttcatcgtccgatctcctttaattcattaccgagtgtcttgttagttgccataagcgtcgataacgaattaacccgccgacgccagtaactattgtccataccccatgcttcagtcctccaatacaaaaaagtcccagtaatgtgtcaacacacatcactgggacgaatcatcaaaatccgcggtaccacccaaattaattgagactaatcgcctcaattcactttactgctattaggttgtaaatagttcagtcgttacacctgcgccactcacagcaaaccgtggcttctctgacatacaatgtaacgtcctaccgatgaaccaagtttacgggaagtgttaaaagatgtcaacaacaaaatgagatgtttttaattgttatccgaaatttggtacgcttgcaaatatcgtgccgtttgcaaatcaagccaatattgtggattaaggtcctcgcccgttgccgcatacaaaatttgagcaggtgtttttgatgcgccgtattgccaaatattcgctttacgccaatcaaacaacggttggatgtttcccgtagccagcaagctgtcgatatcaagcgtttttgccatttcgtgacggaattgggccgcatacaaatggccaagggcatatgatgggaagtagccaaagtcaccgccggcccagtgaatatcttgtaagatacctgtcaaatctgatggtggtcggatacctaggtattcctcatacttcgcattccaaagggctggtaaggttgcaatatcaatatcatcgttaaaaatagctttttcaatttcataacgaataatgatatgcaacggatatgttaatggatcagcttccgtccgaattagactagcctctgttttcatccaccctttatagaatgtctcaaaatcaacatcgtctaagacgccatggaaagcctgttgcataattggataatcatgacgtaagaaggcttctgagcgaccaatcattacttcattaaataacgactgtgattcatgaatactcattgcaattgatttattaaacggtgtgtaatcccatttaggcgcaacattctgtgcaaagagaccgtgaccggcctcatgcaagattcctagcacagccatttgaaaatcagtggctgaccaccgggttgtaatacgggcatcattacgattcaaatcttgcataaacgggtgcaccgtatcgtctaatcgacctttatttggatcataccctaagcgaacggccgcatcccagacatatgcccgttggtcactaaccgcgacctctcgctgtaaaaagtcgtctgccggttcagttccttctgttgccaagcgttcacgcagcgcaacaacccccgccttcacttctgcaaaaacggcatctagctttgcaacggttagccctggttcaaactgattcagcaacacatcatatggtgtcgcctcatctttacgccagtatgtaataaaacgacgctttaaatcaattagctgtgccaaatatggcgcataaatggcgtaatcatcttgttcgcgggcttctgcccaagcgtcctgcgctgttgaagtcaacttgttaaaagcaatgtattcatcagccggcacggctgcatcacgctcatagtcttcctggaacttggcaaaaagtgcctgttcgtcggctgacaattcatccccgtgtcctgcaaagtacgcaaccaaagccttggcttgatcacccgtcgaaacacccagatacttttctgttaaataactttgtaattctgcgcggaactcgctggcatccttaggcataccagtcagctgatcccaccccgctaaagccatagtttcttccaataaagcttgttccttgagcaatgcgcgcaaatcctgtcctgtcaatgtcatcatatccatcctccagtttaatccgtgcgtttattctaatctaaatttaataagaacacaaataaaggtgagataacaattgttatcccacctttttacatatgatttagttaaatttcataccatattttttatgactgtaccagccataacccacggtccaagcaatgccacctaacgcagcaattgtatccgtcttatccaagaacaatgtcccaaagataaagagaaagaatagcaacgtcaaaggactagcaactttataaaacggcatcttaaacccatcttcaatgaaatccgcactggcccgatacttgcggtgcgcaatcatgattaagctataaataaccaaggtaattgctgccgtagctgacgcaaaaaaattaaacgctgactcaaaaattggtaatgcgttaatcacaggtgtaagcataatcaaaatcgctgagaacaaaattgcgcgtgctggaatcgccttcgttgacaagcgcttgaagtagtcttgccatttaccagtattttcaagggctagggcgtagacatcacgaccagctgaataaatcagtgtgtttaatgctgacatcgcagcggtcaacaccacaaagttcagcaaagccgccgcccaatcaatcccgattaacttaaaaataaagacgaacgggctttgatcagctggtaaataatgccaatcataaattgacatgataatggccaaagctcccacatagaacaccaaaatacggaacaacaccgtgttaattaccttaggcatgacttcacgtggatttttggtttcagcagacatcaaaccgacaaattcaattcccacgaatgcaaagaacaccattgggaacgccatcatgaaattcatgcccccgtttggaaacagctggaaatggtgggtaatgtttgcaaatgacaccaccccgccgtgaacgcctggtgttttaaagccggtaatcatcatcaaaattccggtaataataataccaagaatggcaatgattttaattgaagagaaccaaaactccgcctctccaaaaaatttaactgcgaccaaattcacaccaaccaatagtaacatcacgacaatttcaattagccatgccggcaccgttggtagccagaattggacatatttaccaatcgccgttaactccgccattgccggtaaaattaacgtaatccagtatgaccagccaacgaagtgaccagcgccaggacccagatatttagacacaaaactcacaaacgaattgttatctgggtctgcatagagtagctccccgattgcgcgcatcataatgtaaaggaaaattcccgttaataggtacacaaacaagatcgatggtcccgtcaaactaatcgaatcgcccgctcctagaaataatcccgtaccaattgtgccgccaatggcaatcatcgtgacatgtcgtttagacaaaccccgttgtaatgaatctggtgccgtatttttatcagccatccccgactcctttttaaatcataactttatttgttttattacggttgcgtttacagcaacgttgaatataataccacatttccccgccttgaaacatggttttatgcaaagatatacaattctaaaccgtatatccacaaaatatgcatatatacataaaaacacccacgatttggttagaatcacgggtgctcttatgtatatggttattgtttaattaggttagtattaaacattatatgagaaaagtgtcgagtcggttaactctcaacattagctattctaccgactctttgtcatcagcgggaaaaacttcccgctcatgtctacttttttgccaaatgttctcgccacatagcattaaacaacgttttgtacttatcggtaatttcaaattcaccaactagttcatcatagtcagcaaaaaaatcaacgaggtggccaaccgcctcttctggattagtgaagtacgtgcgatagttttcatacattaaaaagcgccaacgccacgaagcatactttagcgccttatcgtcgcgtttttgctcttcaaacgcaacttgtaaaagcgcatccagtaattcttggttaccttcaaacattgctttaaatatcgcatactcaacgccttcaacaacacggttagcataagttcgttgcaaaatattatcaacatcattcgcgtgcgtcatattcaccatcatatggacgccagccactgaatcgactgccatccacgccaatttcaaaatacgaaattctgaatcatgccaggtgtccatactttgtagcagccgttgcgcctgttggcccaacgactttgcttcttcgctggcataccaccggccatccagtcgactaccaatgatcatgcgtagctccaaccattgttccagaaatcctaagtggcctgtttcgtcgtagcgcattttcgcctgcgcaaccgccgttggtataaacgtctcagccacgaactgaagattgtacttcacacgatacgtcgcgtcattaaattgtggtacaacggcatccaaatcaccaggcattaacccgagatgtggcatcagcgtcaacaaatcgttcacccgaaacgacgcatcatcgtcatacatccggtaaaccttggtttttgaaaaaccatattgcgccagctcctgtaccttgatccgcttatcacgaataacttggtgcaaatagtcaccaatactcgttaattcaaatggtggcacaatttcagcgtaatacgataactgttggagaccagtcggcgtacccgtctctcgcacagtctgggatttcgtccagatatcggtcatagatacctgcaaatcattcatcgtgataacatcaatttgcaatcgacgggccgctgccaaaaagttttcaatactgtcccgacggttatcattacccgacataatccaaccgttaataaaattaagtaaccgtttcaacgatcgcatttccacatttgaagatcgcgttggctgatgattaattgcatcgattacaaataacatcttttccagcataatctttttcgggttaatgatgtatttttgaaccgctaacaagtgaattgataacaccacttcatagaaagtacttggcatatattcgcgatacaagacaattgattttacaaacgtttgatacaacggccaaaaagttttagcatccattgtttgtccgtcaattgcaagttttgccatatcaacaatcgtaaacgaccgtaaatgcgttagcactgaaatttctcgattttgaatgatgtcagcttcttcaactgtatgataaagtgcctcagaaaatgacattgatagtaattcaagtaacttgtgtaaatccgcaaccgttatatctacttccccgttgatataacggtaataacgtgacttcgaaataccaattcgttcaatatcttcaatcgacacatttttttgttggcgaccggctgctaaattcgccgctaatgttaatcgggtagtcttatccatggttaatatttctcacgtcacaaaaaaggcttccaaccgaatgattggcagtctttttactcatgcaagattatgaggttgcataatccaacattactttctaaataatatttccagaacgtttggctctgatcttcaaagtatcaactcagacgccaaacgttgtcacattccggcaatccggttccacttacttttcttcacttgaatattgtacaacactccgtcaatattcagttaatcattccctggtgaaaacatacggaattatacacctaaactaacagtgcaattagtttctcctataatttagcacgtgtttgtaaaaaccagaccgcttttgtgtattttcaaaaaacataaggtcgacttatttcccatcaattgtacaagatttgttcttgcgagctatttagagcagtaaaaaaaaccgcaaagcaatatcgcttcgcggttgtcacgacgaataattggtttaaaaatccgactatttcctatatttaatttgctactgcaattgcatcattatgacatccgcaaccatgataataataccaataatttgcatgacattaacttgcttcttaactgactgataccagccaaatcattgcgcaataatggtaccaacgagtatgcccatcaacccccaaatatacttcacattcctagcgttgtggattgtagttaacaactgacccatcttcattgatcacttgaccattgtggttctgatcatcaaagaagaatgacaaaatcaactcagccgcattgtccgtagtacgaacgaaatcaccttcaatgtgcccattcaagtccgtagatacggcccctggcatcacggcaaaaatctcaattggcatattttgttgctcaaactcaagaccgaagtccttagtcataacgttaagcggtgccttacctgccatgtacccaagtgggtgccaccacttacctggttcaattggcgtcgaaatattgataatcgttccactgttcttttgcaacacaggcaaaagccccttcgttagttcatatggtccgataaagtcaaccttgtaaatagcaagcagttcttgtgtctcgtactcccatgctgtgcgatccatatcaccggagattccagcgttattaaccaacaagtccaagccgtcataatttgcagtgatgcttgccactgccgcatgaatactgtccaaatcagcgacatcaactaacaacaattctgcatttccaaacgtttgcaactcacgtacagctgcttcaccgcgaccagcatcgcgagcgccaaccaaaacggtatagccctgctccaacaattgttgggcaattgcatagccaattcccttgttcgcaccagtcactaaagctgtcttaaccattattaattatccttctttctttaaaacagcattattatacgactggaacttgcgaaaagtaaggtcttgaaattatttaaaaacctgctctggcaagctatcatttcaacaatacaaaaaaccatccaacccgaaagttggatggttttttcagtattgaatcgcttaaaattaagccaaaccgtacttcttgttgaacttgtaaaaccctttaacaccaacgttttagtcgccctgtgtgcctatattgtgcccgaaatggtttcctaaaaataaaaaatcccatcaagattaagtgcaatggcatctgtacagacgggctttaattaattttcaaaaaatattttttgaaaatatactaagtgtctttatttttttgtattaattggtataagtttacagtaggaaattgtaatgctaaatattcattactcattaatattaaataggtagaaacatgacaaatatcacccaaatatcgggcataaaacgccttgttttggtcatatatgtccgatatatacctacgtattattggcgagtgaccaaataacatgtccctaaccaggggagttatcataatcgatctgaccatctttatatctttcatgttgatttactaacgaaagttatgataatctttgtttgtaggtcagaatattatccttgtcaatgaaatgcttatcattggtattacttgtaacaaaaattataagtacttctgattttcaacctgttacatctattgtaacaatcattctctcatagcaacacaactcccaagtttaattgctatcgataaaaagtcatgttattcggttcccaaaaaactgaattagattttttgtcatcctgatagataaaattttaggtacttacccactcactaaaataccccatttaggatttatcaggacaaaggactctctacggaccggattatttccgaaacgttcagggtccttttttattctatcaaaagactaacaagtacattattttggagacatatatgaaaattaaaattgttatcgccggcggaactggttttgtaggtcaaggcattattaagcagctatcacccgaaacatttgaagttcatagcctgtcacgtcaccattatgagccgaccgaaaccgaccacactatctatcatgctgttgatttatcacaacttcaggaatggaaacatatagtggaagatgctgattgggtaatagatgccgtaggaatattattacctaatcctataaaaggtattaattataagaacagtagttacgaacctgctaaatatttaatcgatcagattgttaatcaaacaaacactaagtttttatttgtatctgccaataatggtcctttcttcatgaagccctatatgaatgcaaaaagagcagttgaattacacatgaagcaagatatacctaatcgatcatatattgtatatccgggtattatttttgataagtcgcgaatcagttcttttgttccgggattaattatgtcgcatatgactaagctaccttactttagaaaattacgtcctgtcagtctaaaagaattttcaacagaaatcgaacttatacttacgggacactatagtgtattagagcagcaaatatagttatcttttccaatacatgttagaaattacactcaggctttataattaaacaacgagtaaacacaataaaaacccgccagacgaggaagttaatccaagtccagcgggctttattcataagtgggccaatttgcgcatatgttttaatgtcgcaagttggtccgtttttttatttaatgatgtcagctaaattattcacagttgcagtcttagcattgaacgtgccgtcagttccaaaattaaaatgatatccgtgccaatctccctcaccctgtactaacttaccgtcaccgtctgaccaatagtgaagtccccatgagttcgtccagttagacttgatcaacttgccattagcaaatgaccagtaagaacccatgtgtttcttgatgccattggccttgtgcttgaacgacttgtccgtgtaccatacgccacccttagaccacaccgtagcactatcaccatggttcttcttaatcaccgcttggtcagcagtgaagaaattgtcgtacagttgcgtaatatcaaacgcaccgctcacaccatcgcacgttgcatgatcgaaccattgccaaccatgctccgaggagtagtagttttgactagccgttggcgtatatggatagtgtgcaatccatgacttgtcaccgtcaggtgttgtttcaacgtgtgaccccattgtataggttgttgatcgatacccaccagcgatgcccacttggtgttcagctgttgcattcacagcttgcatagctgtccccattgccatttgatttggtgattcagcatctactgccagcacagctccaactcccaaaccatcagcttgagcggtggccactgcgtagttagcttcttgaacagcagtggcattatcagtcgcatgagcaaagtaataaccatttacgtacagacctgccgcttgtgcgtttgcaatattattagcagcagttgggtcttggtaccatgtaccttctgaaactttggtagtaatggctttaacgccttgattacgcatattaacgaaatcgccaactgacaagtaaccattccaattggatacatcgaccatgtcaaaccgtggtgtatctgcatgcaccgtatgatcactaacaagcgttgttccaaacaaaaaggccgccccaacggcgaccaacttcattgttttattcattttacttctctgcctccttcatcttttcaacagcccattcaattgcctcatcaatctgcttagcagtgaacaaatgcgctttgtcagccttgatcaaataatctgtcatcgacttgatcgcttgtgctttttgcaactggccaccgtcaaaggtcacctctgcccacttaaccacagcttctgccataccaagcaagtttgttagcctcttattgcgggtagaccgttctgaagcccaactaatggccaaaattaaaagcgctggagcaatacctgattgccatagcgcttctgcaaaggttattaagttattcgttgtcatcgtgatgttctctccaatcttccagtagccttatacgtgtctcgtggtcatcaatacgatgatcataaatttttaaagtttcttgtaagccagtgatcgccttattcaagtcattcatagacttaacgaacgttttttgaatgacaaaccacatcgcaccagataatgagccgataactgttaaccagcctgcgatgtcatgtggaaaaaagttcataactctaccccactacttttcaaagctggcaacaaccttatcagcctctgcaaatacggtatcttgaaatgctgaccaagctgtccggaaatcagataaatgttcacgataaatgacaccatcgttgatgtagtagctcattgatggcacaccgtattggtcaatcgaaccacttaaggttgcgtagttcactgtaccaccatcttctgcggtaatggataactgttgattgaattgcgttgtcttatcaatttgtgccatcgttagactcccccttgcttaattcatcgatacgtgacttcaattgttcgttctctgattgcacagcgctcaattgtgcccgaagttgtgcgatttcaatcgctttgttggcaatctcgaaaccaagattttgcaaagtttgttgttgtgattgttccacgtttgttctcctatcttataaagtgacgttgaaccaagttttaacggttccgtctgagttgatgactgatggtattttaacagcgcctaaattatcaagtgcctttataacacgagtcagattgtaatacgttgtccccgatattaggtatgtataaccggacccgtacgctaatccagcctgcaatctactatccccaaagtatggataattgaaaccattaaaagttttggttgtaaagccaagttttgccttggaaattcccggtacgttaatcccttgattgaaaataacatcatcgtcaaaattaaagccggcgtatgctcctgttggcgcagaattacttcgataccaagacatctgtataaccggattcatcgatgtatctccattattacgggctgcccaagccatatactcagcatttccatcaagccagaacgtcaacccttggtaagtattgggcttgcccgtcataccttgaacaccgatacccccaatggattcaccggccattgttagcttcattccagaattcatgaaatcggtaatcacgccaccagaattaacagtcataccagtagaatttatcgtggttgagccatacttaccgttccaattggattgaataaaattcgacacgttaccagggattttgttcacatcaagactggcaattttagcgttggtgattgaaacgtctgcaatttgtgcagttccaatcgaggcgttcttaatcagtgcaccgtccatgaagttgttaccaatgaaagttgtatcgccgcttattgttatttttttaccaacaatattcaaaccagacgagtcaccattgatacctgaaataattgcgccagtgtttgattgaataccgaacgcgaaaaagttattaaacaacttcaatgttgaagtattgtcggtacttgaccccggaatgtaatcaccagcattcagcttagttgaacccaaataaggtctagcaacagaaatttttccgcctccgtactgcgtaacttgaagataaagttgtgttgtcgctgaatccaacgtaatgtcagccgtgtaagtattccaaccagacattgctgtatcaaatgaaccgccaattgcagttgtctttgttgtcgtgccagaactgtttttttgaacaatttcagccttcatataagcgcttgttccaaaagattgagcataaatgtcaatgcttgcatagaattgtgtgccgcccaaattcattgtataaatcggtgtgcttttcaacgttgaagtcttgcggtcaaagtcagtacttccgttgttaaacgttgctacccgcacacctttgagcatgatttcgttgtcaattttccacgatacatcaccggcgagcgtccagttagctgttgcgtttacaaaagaactgtcggtaattaaatttgttgaactaactgacgccatgatgccatcgctgacttgggaaatttggctttgcattccggtgtcgtagtcctttatctggctggttacaaaatccttgcctgcttgcagcgtaacgctatctccgttctctcggtcagttatttcttgctttaatagagcttcaccattagcgaccttatcattcagttcattggtcaattcaacctgtttatcatttagttcatcggtgtaagtataagaggtctcaatcgcactatcaacggcgttgttaatgcgttccaatgtcttggtatctacggaatccacccacacgccgttggtaaagacacgaataccagaatcagctccatcgtcccagaaccatgtatctccttcttgcgggtgtgctggtgcattacgaccagagtggtttgagttcttcccattggcgctgacaacagcctgtgtggcctgctcttgaacctgaataactttgttctgcaagtcagataaagcgttctgattggcatctgcaaagcttaccttagcagttccgacaaccaaactcgttactcgttctccgattgggtcataatgcaactcgttcacgatggccgtaacgtttaccccatactctggtacgtacaccgtaacagtgtcggtcagcccaatcgtctccaacttagcaaacttgtctgcgtaatcagctgagtcttgtaaactcaacacatcaacctcgattgttacatcaggtaaatccttattagtgttttctgactgggcaaaccagttaccagcatacgcatttatccggtcaatgattgctttgtcagtatcaccgtcattaatcgtaattttgtcggttacatcaactgattgtgtgtatttgattggataattgccaacacgcttagaagaaactgtggcaccctccaaatagcgggttgtattaccttcagttaaattaaccgttggtataacctgtgttaccaagttagaagtatcgaccgtgtaccttaacccgctgatgttctttccgagtcggaatgttgctacgttataacggccgcgtcggtttaacatagcaactctacggttctcccgcttcatttcaccgccccaatattgcaagaatgaaccttgcgtacctgcgatggcttccatgggattaacgtaattcagggttgatgttgagcttgtcgtaatatccgagtacaaagtaaaaatactaggattaacaattgcttcttgtaactggttcatggccgttgaaccagttcctttcatcgtcactgatttcacgatgttgtgggtcagatcataggtaatggaatcggcctcaatctgtaatgaatgatcggcaatatccagctgcgtgttcacaatacgaaaggcgtggttatcatcaagtggcgatggcttagcaagtataatacggccttctgaaatatcaccataatgttgacctgtaacagggtataacccagtgaacgttaacaagccgttacgttgctcttgaatatcaactgaataaagttcggttagttgccctaacccgttacttgtgaaatcaatctcatcgctgttgtataaaatcggtgtcatagcgtcctccatcgtggttctattgttgctgtacccgcactcaaattaatattgttgttaccaggctttagtgttgggaatgggccgatggccatcttagcgttctcgttcactatgattttgccattggtatgccacacgttttgcatagcactatccagttcaatcgaccctgtaacattggagaacctgtaatcagtactgtttatcgttagcgtgatagaaccgctgccgacaatcttgatgtatggcttggcaacatagttggttagatttaccagcgtagaaataagtgtcgtaatcgtttctgtttgagcaggtgcaacataacgatatggtgccgctgacaacataatggttaactcacgataaccgtccgagtaagttggccttgcaatcgttccggttgattgcctgataacttggtacgtgtaatcggggtccgagtacatctggaaatcaatgtactttccggtgtccaatacgcttagaaatttttggatgttgctatctgcttgcttaccttcgaaaccaataatcaattgaatatctctgttgttataagcaccatcgtcaaacaaaatagcccgatcaataccgaccggactagtgttaagcgtcattttacgttctggcactgcgattgttggataattcaatatccgtgcgttaagttggtcactcgttaattggtgacctaatacgaaacttcctctttccaatctttctatcctcctattctatccaaacgctcgtgacttggcgttttgcttgcgtgtaattgcatctacaactacttgctgcaactccttcaacgtattaggcgttaaatctgcgttcacgttgatttcgattttgtaagtgtcaccctcttggatgacttgtgattgtccactggtacgattgccattgatacgtgcattggcttgttctagcaagtcattggctcgcatcttcttggctgagtctagcggaataattatttctggcatgttttgctctgcgacttcatacaggccatgttgattaactattccaccttgtgcaaatccgttgcctaatagacgtttaatcaaactctggtgctcatctgaatcgtgcttactcttaatgccagacaacatgttaacgattggactggcaatgccgttaattagcccctgcgtcatcattggtgaaactgcctttactagtgggctacctgtaatagttcccactgcacgatgcatgacgtttattaatgccacgattggctcacgtaggaatgatgtaagctgcgtccacttatccgaaatccaacccactgcactacttaaccaatcatttgttccattagcgaagtgaggcaatgcgtgggctgggataaccgtttcaccaccactgaactcaaccagtctgttgcggccttcaagtacagtggctttaccagagttatcaataattgcttcctgataattctcgcctggtgcgtcattaacgactgcaagtcccttcggtgcgccctttgtaccattagcaaattttggaattcgtgacagaccatgaccgccaccaaacataccaataaccgaattgattgcaccgattccgttgttgatgatcccaatgacaccgttaataccatctctagcccaacccgtcatagtattccacatggaaccaaacccatctgtaatactattccaagtgtttgagaatgctccactgattgcgttcaatattggagaaaacacgttcttgacggacttaatgccatcgtcaccagaccttaccatcttgttccagataccgctaaagaagtcagaaatgccattccaagtcttgctccacgtatccgaaattgcaccaattgtgtccgacacaatacgatgaattgagttgataataggcttaaagaaacgtactatcttgttccatgtgtcagtaaagaagttagcaacaccgttccaagaacgtgaccaagcgtctgagatggcccccatcgacttactcaacgtgttaccaatggccgacatggtgttattccacacctttgcgatgctgtttaacaatcctgagaaccacttaccaattgcgttccatgtactcgtccaagccttttgtactggtttccatacagacttcaaccacttagtaagttgattgaaaatcttcttcattgggcctactagaggcttcattaaagtagctgcgataccaattggcaacgccattgaaatcaacacaatcttaccgaatgtcttaagcaacttcttggcaaacttagtaaatgagttccaacctttctggaatccctttacaagaccagagaaccacttgctaataaccttggcaccatcaccaatcgtcttacctatgccaccaaaccacttaccgatgtttttgaagaacttgctaatcgacttagtagctgatttaatccacttactcattgatgtaaagaacttaccagcagacttgactactccatcaacaaacgccttaaactttttgttgtgcttgtacagcattactaatccagcaactatagctgtgataattaagacgacccgtccaattacactgtttttaacgacaagatcatatgccttcgtagcaagcgtcattgccttttgagcggcggtggccagcttttgtgaacgagccagcttggttaatccagttcttagcgtaccaaaggcagtaaccatgttgtgagctgagctgactatcttggaaccgaagtgcaacgctaaaaggccagccaacactgcggtaattgccttaccgtgctgtgatacaaaattaactaccggtgtaatagccttaacaattgctggcatgttcttgaccatagtgccgatgaactgcttaacagccttttggagtggttctaacgcctttttgaagttctttgtctcagtagctgacatcgtaatcgaactgacagacgcttgtgctgagcgcttcatcaactcaaacgggttggactctttcagctggtcagatgttttcttagcggtacctgaaacgtcagagaacgccttgttttgcttaccaagtgatccaagtaccttaagtgaattgtcctcacccaaagcactccacagatttgaagccaaggtagcttccttctgcttgtcggtcatcttacccatttcactagtgatttgtttaaacatatcaccagctgtgaccttaccctctttatatccgttgaacatttcttgggactttttagaaaactcggtgattgattcatccatgcgaccatcattcagactgatactgaactctttggtgaaatctaacaacttgtcaccattgtatgctccgctttgaataccgttggcaatcattgagaacgaatctttggctgacaaccccatttgaccaagaacttgtgaatactcagccatattatcggagatgtcaccaccaatatcgccaccttgcttttgcagcgtgaacaaattatcgaagtattcttcataactcatatgccacgccttcgtagcattttgagcaccacgcaagacttcctgtgtgtcagcccccgaagccttggaatactgtgataccaacttcgtttgcttggccaattcatcaacatcagcctttgggttcatctgcttcaactgggtataagtttcggtcaagtcctcaactgattcaccataacccttggcatacagcttattgatagctgagattgcttccttggattcaccataagatgcagtcgttcttgcttgtaggctggaaacttggctttgttggtcataaattgctgaaaccaacttagatacaccagctaaagccgttcctgcagctgcagccgtggctgcaagtcccaacttagtcttattaacagcacccgttagccgttcaaatttacccccggcctcagtagcgccttcattcttaccaatctttccctgtgcgccatctagctcttctaatgatcgttttcctttggcaattgaagttcccgtcttgtctaacgcgaccttttgtttactaatgctatccgatgatgcttcacccgattgcgtcattttatccaattgcttacgctgggcttcatataattggccctgcttttcaagcgtacgtgctaaccccttcttttgggcttcgttggcttcttcttctttaccctcggctcgcaagagttcaacgtatgagtcagtctctttgattgagttttgaatttccttgttaagtccagcaataccagactcttgcaattcataagctcgtttagcttgttcttgctgcttggtcattgaagcaagttgacgctcagcagttgtgatttgcgatgcgtatttctgatacgtttgctctccagcttccgtacttcgattaacttccgattgctcctgacgcaacttggccaacacgtcttgttgctggttaactgattgtgtaagtcctttgtacttagcttcagacgccccaatttcatcaccagattgtttcatctgtgactccatctgcttccactcatttgttgagtccttaacggctgacttaagctcgttcaatgaatttgtagccgacgtagtattcagtccaacctcggtagcaagcaagcctgcaactttctcttttgccatgttttacatcctttctagcctggtaatccattccacagcttcatcatgtcttccgatgacatcatgcggttatcttctgaagcgttcatgatagacatcaaactctcgtactcggcttcctcaacatctttaacgctccagtgaagattaaccatgacatacttttcgaaaagctctaagtccaaaatgtggttattatatgcaattactcgttctccagggctggttctaaacccgcatcatctggctcattttgaatgtcctcaatttcttgctctgacattcccataattcgcatgtacaatcgttgagccaaagtcataagttcttcttgatctaactcttcaagcttctcaatttctgtatccttcaacttcaacatatcaaccacgtaatccgttacattttccaaggcgtctaatacagattggagtgattcaactggcgtgtcttcatccatggcgtcctctaacgtagccagctttaattgaactttgtacgttttcttaaggttcttaaccgtggccttcacctcgaatggcgtcttgcgtagttctttaaacgaaattttcattgtgtattcctttcatcattcgcaaataaaaaaaggactcaccaattcattaagcgagccactttcaactgggcttctcaccccatttgaacctatttattgtcgtggttgtaagacaatcgctgtaatattagttacttgtgctgggcgtagttgcttcagcataaccaccaaatacttctgccagcattgctgccttatcaaaatctgcgtctcccgagtagaacatcttcattccttggccattccagtcatccaacccaaatgattggtatgtcaatgtgtcacccacacgattttcgttagcattgtcagtttgaatgttgaccgctgcttcagtcatttgtccatttgagaatgcgtaaaaaatagaatgcttacggtcaatagtttctgactcaacaatcaaggcaacccgtggcaagtcttgtgattgtaggtatcctcccttaccatctgactcacgtccaagcaactttgccttaatgtcaaacggcaagttattccatacaccagctacttgtgggaatgactttgcctttgtcacatcaaccattccgttatccccaaattgttgcgtaccgttagttgaaatattggtgatattagctgacaaagtacccaaatccttagagtttgacttataaagcccatccgtcgctaaacctgcatctcccgccttaatctttccgtcatcatcaagcaatgctagatacgtcttcttcaatcctacttgtgccatttttaattcctccaaataaaaaggagactagccgtcatagccaatctccactagtgtcgttgttttgtttacttcaatattcttaatcgtttgttgttcgtcggtttgacttagatcaagatagtgtggctgtgaatctgtcacacgccaacgttccttctccaactccttcattaactgaacttccgtaacaagcatgctccggtcaaagtccaaactataaaaaatctggattcgcaccccaagttcaatcatgttgaacgtgtcgtcggcataattactaacatcagatactgactcggtaatcaacacctgtgcataatccaaaaaatataagcagctagtcaaccataacaattacggttgaccagctgctttaatcttcgtctctaaatatgcttttattgcgtgcatcactagtgataaacaatattcaagttacttgtcaggaactaatcttctaactaaaagagttttagcatttgagtacattggaagccaattttgtttatccaaatatacagcaagcatgaaaacaagcaaattacctcctaatgctgccaaattattattacttatatagagaattgctgaggagattgctacacacactaaatgacgagctatcatccaccaatcaactgataagttaacaaatgcactagtatttttgactcgtataagaaacatagataaaaacgcaatcacaccacccaaacacgcaccatatatgccaataataggcacaaaaattaagttcaacgctatatttagcaccccaccgatcatcgttgttttcaacaatcccattgtagatttcgctgctatgtacgtggttcctacaaaactagaaaggtttgaaaaaataacactcaacagcaacaggggaacatacttccatgaactataaaagtcttctccaatgaaagttctacttatgattggcatcaatgcaagtattgctgtagctaacgacaattgtaaactagtcatcctattaagcacggtcgaatagaatgcacttttatcttgagattcgtaattttgcacggaggaaatttgccatgcttgtgaaaaaacactaaaaatcatcgtcattattgctggtatttttgtagatacagaaaacaatccattagcattaatgcccaaaaacatgattatgaaatacctattcacgctagtagttagccaccacgaaatcgcatttggtattaaaggaacactgtacatcaataaatttctgcatactctaattgaatcaagattgaacttgatatattgccaaatttttaatttgaaagctagaattacaatcgaaatcattagtcccgcaatgatccctaaataataactaagttgtcccattttaaaaaataacaatcccaaaatcgttattaaagcactagaaaatgtattaatcaatccagctgaaacatacagttggaccttttcaaatcccctggctatattcatcatcaaggactggaatacagacagaacacttgccactgagaaaataattaattcaggcaggttcgcgaacattccaatcaatatcgctgcaactgcaataaaaatacttaaactacttaccacgaaaccagatgatattattttcaccttatctgcctctttatctaatagccatctaaacactgcatcaaatatgcttagtgatagtaaaggaatacagattgctaaagatgtagtgaataaatctatttccccatactgggatgttgtaagaacattcgtatatataggcaataataaaaagactagtagttttgaacttaaactgccaatagcaaaaatgcttgtgtttcctaacagcttcgtaattcttttatccacttaatctccctcgctctctaacagggacactaagttaccatatccagatgccattgtcatatgcatggattcagaattaatgctttttgacatgatttttcttctagctgaaatcagtgattcagtagcaggattccaatattctacccaattacaacttgataaccatgattcatatgccgctcctattttcccattgttatttttcaaaactaaagttggagtttttgtaatatatccgaacaccattccatgaagtcgatcagtgataattaactcgcgttgagcaagtctattccacaaatcttgcaagataataagcctatccttcttgctaacttccccttcgataaccgtgtcagactcctcgacatccttataacattgtcgaacttgttcgtctattaaaaccctaagttcattacttacagatttctccttgtcctgtctgaatagcgttattaccccctttctatttgcaccattatcgttcgatatttctaagctcataacaatatctggagacaatataattttattttcaaacttttcctttaagaatgcataagacttctcatctcgtgccgcgataacaacgtttttatatttcttgtagaaaagcacttcttttcgtaagaaatcatcattttcaaaaaacgtagattgtggaaatacaataattctattgttgggaaagtttttaattattactcttcgatattctgcctctctttgatataaatcaccaaagctacctccaccttgcagaacaagaattgagtcattatttaagtttctttttagatatggaattgaagctggaatgtctttgcaagaaacttcaaaagtaagtctattcttgctttgtaacattctatttgttgcctcagaaatggcttgatcgcctaaattaccatgtaacggtgtcccaataaatacaaacacctttttatcagcctctatcttcaaatcctttggtactaaaattcgccaaaaggctttctgaacaaaatatttaactttataccgcatatactctctccataaaacgttatttattcacatcttatatgaatttttagaaggaattttgacttgttatagcttataattcgtctacaacaaaccagaaacaatttctactcaatgaagtatgcgcaaaaagcagctgatttcaacaaagtgaaatcagctgcctaagcaaactccgtgacgtctgtgaaaactatttaatatggatggcccgttgttaaacgacggttagtactattcagtcatatgtaacaaaaaatgcaaatgtaagaattgtatttcctaattaatcggtttatagcactatcttatgatcgatgttgaagttcttgtgtgccactacgataacgcacacatggctttgttcagattgtaatatacctctaaaatataagaccagatgtattatacaaaaatatgcaaacaaaaaatgtcataaacgagcacttaacgattttggttttccgacgcgccaaatggattttgaatttatttattaaacactaatcttgttcgcactgaattagttctaaataaaaggaactattctcgctaataattataaaattaattcttattcgttcgttaacattaattaaaatctattgcctgaaaggtatatttaggaggatgacccatgttaaatcgacacatactagtgttaggaaatggatttgatttacaggcccaagttccaacaagctttgaaaaatttttgctaaaccagatcaaaccgtatatacatactttaaaacccgatgaaaaattagaagattttcggaaaaatttaatcgacaaacccgaactaaatatattactaaactctcaattgactttttgggaatttttcttgctattgactaataaaacaaattggagagatttagaaggagcgatgcgtgagtattgtttatctccagaaattggtggcaactcttccttgaagcaacattttgaaatattaaacagcaattatttcaattcttcaattaaatcatctgaagacgcctatctatattttttatcaaaaaaaacatcttacgactcaaatgattattcgattcaagatcatattaaatatttagtttccgaattagaaattactgaacagcatttttctgattatatagacggccatatcgacaagaataaggaatgtaagcaaacatatcgtaaaaactcaaatttattatttaaagacatttttttattgttaaatatagacgaaagagatgtatgtgatatatatactttcaactatacaacgccttggaatctaatgcccaacttcccacaagggcataaaattaatattcatggaaaaacaaaagaaaaagagcaccattccggtgcagcaaaacaaataattggcataaataaatataactggacgtccaccgaagaaattaatcttgtacgtgatttttttaaaatcgaacgaattaacagatcaccgctattaaattctgcgactttagataatcttgcagcagatctccattctcataagggggcctaccgaagcatttcattctttgggcacagtctaaacgacattgatttcccacaactattttctgttttagatgttagcaactttttatccgatacgtccgtgcgcataaatttccttttcactaatcataccaaaactccttctgctacagcgtccggtgacatccgaagtaagtcagaacaattccttagtgcctatctaaaatcaagaattgatcaatctgatgaattgcatatccaaaaattatacgaaatattaaatactcaagttaatttcaaatttatagattataacttttattcacatatagattataaataaaaatcaagtatgactgtataattaccaaaaagaccgctactaacccaaatagaattagtagcggtctttaattaccgcagccgatcgaaatcaactttagttttatttacttttagaattaatcgtacggcagtagattacttcttcaaagcagtccacttccagtcagtgaactcttcgatgtcgcgaccttcgttacgagtaacttcgaagtgctttgccaagatgtcatccatcttcttgtcaaatgcatcagcttcagcagcttcaacaacaccgttagccttcaatacggcaacagcatccttagcttggttgaagcgatccaactttgagtatacacgcatgtcgtaagtcgtagtgatgtcaccatcttcacggtaaccgtgtacgtgcaatcccaagtgttgacgctcgtagaagattgactcgatcaagtcttcgtatccgtggaatccgaagacaactggcgttcctgactcaccgaacaaagcgttgaacttgtcatctgacaaagcgcgctcgtggttcatctcaccgctcttgttttgcaaacggtgcaattcaacaacgtttacataacgcatcttaacggctgggaatgcagcgttaaccaagttcaaagctgccaaagtttcgatcgttggctcaacaccagcagatgcgaagacgatatcagcttcttcaccttcagcaacagttgaagcccagtcaatagccttcaaaccttcagttgccaattcttcagcttctgcaactgagaaccattgttgacgtggttgctttgatgcaacaacgtggttaaccttgtgacgctcagtaaatgcacgaccgaatacagccaacaatgagttagcatcggctggcaagtattggcgaacgaagtcagacttcttttcagccaagtgcgtcaacataccaggatcttggtgagtgtaaccgttgtggtcttgttggaatacagttgaagttgagatcaagttcaatgatgggtaatcgttacgccatgattgctctgaggcgtgacgcaaccacttgaagtgttgtgtaatcattgaatcaactacacgtaggaatgactcgtatgatgcgaatacaccaacacgaccagtcaacgtgtaagcttccaaccaaccttcagcttggtgctctgacaattgagcgtccaagatacgtccttcgtgggcttcgtattggtcgtttggctccttaacttcttccatccattgacggttcgttacttcgaacatgtcccatagacggtttgacatcgtctcgtcaggtccgaagatacggaatgacgttgggttcatctttgagatttcagcgaagaatcctgacaacacgttcatgtccatgttgcgctttgagtcagccaattcagttccacggtttgactcgttgatgtcgttagcgtatgacttccagtctggcaatgccaaatcttcagccttttcgccacgagcacgtccaccgttagcaagagggtttgaagccatacgcttgtcacccttaggtgccatttcagccaattcagccttcaatgaaccatcagcgttaaacaactcttctggcttgtatgagttcatccactcttcgaattgtggcaacgtagccaacttcttttgtgccaaaggaagtggcacttggtgggcacggaatgaatcttcgattggcattcctgattggtcgtgagtaggaccaccccaaccctttggcaagcgagcgatgattacaggccatgctgcgatctcgccgtctgcgtaacgaccgttctcacgggcgtccttttggattgcttggatgtcttcgattgcttggtccataaccttagcagtaagctcgtggtatgccatgtaatcgtggatgtcatcgttttcgatgaaacgtggtgaccatcccaaaccttcgaagaacttcgtgatctcttcatcgctcatacgtgagaagatcgttgggtttgaaatcttaaatccgttcaagtccaagattggcaaaacagcaccgtcgttcttagggctcaagaacttgattgagtgccatgcagtcattgaaggaccagtttcaacttcaccgtcaccgataacagtaaatgcgatttggtttgggttatccaaaacagcaccagttgcgtgtgacaatgagtatccaagctctccaccttcgtgcaatgaacctggcgtttgtgcagtcatgtgtgatccgattccaccagggaatgagaaacgcttgaacaaacgtgacataccttcaacatcttgagtgatttcagggtagttttcagtgtatgaaccgtccaagtatgagttcgtaaccataacttgtccaccgtgaccaggtccaccgatgtagaacatgtccaaatcgtacttgttgatcaaacggtttgcgtgagcgtaaaggaaagtttgtcctgagatagtaccccagtgaccgataggcttaaccttaacgtcgtccgccgtaattggcgtgttagttactgagaacaatgggttgctcttcaaaaagatcatacctgctgaaaggtagttggtagcacgccaccaagcatcaaccttagcaaggtattcctttgaatcaaaatctactgccattttgattaaatctccttataattttgagaaaggttcaatcgcagaagttatcttctggattacaagtactataataacagatttcaaaattacgtacaataaaaagcacaaaattggtgcggtccaattttgtgcttttcttatttttcacccacaaatgccggtttcatcgcatttgcgccatttttgaacaaattgtgaatttcgcgctattcgccgtccaaactgacgaaactgttataacgcatgtatttatagtgaacacgcattgatccaacttcaaacggcgtaccatcatccaagaagtaaataccagccatgacaccaactggttcaacctcagacaaagctaaatgatcacgatcatcttcacttgatggttccaccgtcacagtcataaatgacttcgtaaccgcttttttagttgtctcttcagcgtagtggaacattgagtgacctagatcttccgccgtcaacgctggcagcaacttgactggcaccagcgcgttctcaatcataaaggcttgatcctgtaacttacggagacgcttaatccggtaaacttcttccccatcttctaggaataatgccaagcgcgtttcttcgtcagcttgttccgtctcaaacgatagcaattcgatagccggtgactcaccgttaaaccgataggaatcagacacacctagattgttaccaatcgagtgaaacatcgattgattctttaaatacagcggattgacaaatgtccctgaaccacgctttttaaaaataataccttgttgggctaaaacattcagtgcacgcttaattgagctacgtgacacttcgtatgatgatgccaatgatcgctcatctggcagctttaaattggggaattcaccgctataaatgcggtccttcaaatcacccaataccttcatataaaggacttcctccggcatcaatctgccctcctactttatttcggactttatcttaacacaaaaagtggtccaaccaaaacatttggttggaccacttttaagatatttactggattttttcttccacaactccacgggcaaacaagatattccagattgttaagaacaaaattttaatgtcacgccacaagttaatatctaacgcatattccgcatcatacatagccttctgcaaaatcgttacccgatcacggccattgacttgcgcccagcctgaaattcctggtaagcaacgatccgccttgcgattacgacgttccaacaccagctcttcttcagatacaatcactggacgcgggccaataaaactcatttggccctttaaaatattgaacagctgcggcaactcatcaaccgatgttttacgcataattcggccaataaacgtgacatagttgtggccatgcaagtcattcgacgccacttccggtgtatcaacccgcatcgaccggaacttatacaaatagaatggttttgaatgtcgccccactcgcaattgtttaaataaaactggtcctggtgattcaagtttgatcaacaaggccacaactagcattggtatacaagccaacgttagtaaaaacaccgcacctaagatatcaaatgcgcgtttccatatcctttcatacatccccaaacactccctcgttttagataatgtcgttgttttcaacgaaaattatccctaaagggtatgccttttagggcatagtaattcgtaagtgttttaggaaagatatcgaacaaaataagactgataaaatgcacgtatataaaaaaagcgaccgcactcggtcgcttttacaagatatatttagatgtcacgtttcttaagcaattgcgtcaaacctagcgccaacacaaccaaaccggttgcaatccagaacgccatgtgaatacccatcaagtcagcagtagcttgcgctgtcttggcaggcgctgacacggacgtcaaactgtacaccgtaatcaacgctgccgttccaaacgaagccgccacctgacggattgtcgtatacattgctgatccgtctggcacaatttccagtggcaatgaattaaacgcctcggtttgaattggcatcgtcaccatgaccaacccaagctgacgcacgaattgaccaacggccggcaaccagattggcgaatctaattgcaacgtagccaagataatagttccgattaccacaaaccctagaccaatcggcgccaaacgcttcacaccgaattcgtcgtaccacttacctgacgttggtgataggaatgccgtaatcaacgcccctggtaacaaaaccaacccagaaataaaggctgattggccacgcaccgtttgcatgtaaagtggcaacatcaatgccccaccatacaaagcggccatcaaaaccacgttaatcaatgttgccatcgtaaagttgtggtacttaaatacatcaaaattcaacaacggaatctttgaatgagtttgttggtaaacgaacaccgtcgttaccacaataccaatcaacaagaaggcccacacgtccggactcagccagttaccggttcccgcatttgagaacccatacaacaaactaccaagtccgatacttgagagcaccatccccaagaagttaaacttcaagaacttttgctcaccgatattcttcaagaaaatcgacgccaaaatcaaatccaaaataatcaatggggcaatccccaagaataaccaacgccatgagtggcttgataccacaaatccagatagcgttggtccaatcgttggcgcaaagttcaacgccaacccaataatacccattgcttcaccacgacggtcagccgcaaataagttcatcaccaccacgttcatcagtggtccaaacacaccggcaccggccgcctgcaccatacgacccaaaatcaagattgggtaagttggcgcaagtcctgcaataatcgtccccgctgcaaagactgcaacggcacttaaatataatgttcgcgtctttaatcgttgaattaaatacgccgtcaatggcaccatcacaccgtttaccaacatataaccattggtcatccattgacccaaggccgttgaaatgtggaagtctgccatgacttgtggcaaggccgtgttcattaacgtttgattcaagaagcccaggaagacccctgcaatcaaaataatcaacacaccgcgctctttcttagaaattccgctcatgtatgcctcctagtctagataatctgttccagcccattcagcctcgaattgggcaacgaaatcatgcatcgcacgatcacgaatcgtcccaattcgctttccctctcgtgtattcaaataatcctttagtaagaacaacttctcataaaaatgattcatcgtcgtttcgtcatttgctgcccggtaatcagccttggatgtaaaaatttgtggcttaatcgctgggtcgtacaatgtccggcgctttactgaaccgtattggattgcgcgggccgttgccactgccccaattgcatctaagcgatcggcatcctggacgatttgtccggctaatgacaacggctctggcttaccaaaacgttgcttactccacgacatattatcaataatttggaaaatttcagcctgctgtgcctcattaaccccattatccgctaacattgcgccaaccgctcgcttggcgcttgtgacatctttaaataatttgtcatcatacgtatcatgcagcgtcgccgctgcaatcgcaataaacgcatcagcggttggttctgttgccaaaatatgctttgttaacgcaacgacgcgatcgatatggctcgtatcatgaccagtttcatccccacctaacacggcctgcatgaacgacgtcattgccgctaactgttgttcttctactgctgtcaaaatattactccccccgcttggttaacgacgaccaattaacgccgttagcaaatacaacacaaaactaccacccaataggccaccgaagaagtaggcgactgggcgaccaaccgtctcccaaatcataaaggcatccgaaatcgttagccccgtaatcaccccgacaatggtcaaaaaaatcaaataccaaatcacaccactcttggtgttttgccagtctgccccacttaaattcaaagcgagactcaaattcaaaatcaaatatgcccaaactgcaacttgccaccaggcagtattagtcatcacactttcacctgtgtgataactcaacaataactgaggccataccaatttggtaacaccccaactcgctactgcgataccaaagattggtgcaatgccgataaaaaagttgccgacttgctggtatttattattcggactccaggcatgcgacacataccccatccgattttcattaccatctttaaacggattctgaagtaactgaatcttatccacatgatggccgaaaattaacgccaccactgcgtgcgatatttcatgtaccatgacgccaagccaaccaaaaatcaggggtgcattcagaccaaacgcccgcatgagatgttggttggttcgggtagtaatcactgaaatcaacgcactacccacaagtggcaagacaaaaaagatgccaacaatgaacacccatgactgccagacaatggtccaactcatacttaagcgtccgtgcggatatccgcaaattgcgcatgcacaaattcagccaattgcactgcgtcaacgcgaattgaacgaccaacttcacccgctgacaaggtaatcgtaccggcttccttagcgatgttatcaaaataaatggggaacttcttgttctgccaaataccaactgggttattggcgccgtgaatgtagcccgtcgtcttttgcaaatccttcgttggaatcatcgtaactttcttgttacctgataccactgcaaacttcttttcatctaagtgagcatccattggcacaatcccgatgactggtccggtgacattccccgtcaacgccagcgtcttataaatatcatgatccgtgaggtcatatttatctaattccgcttggtcgcgattcataccgcccgcaaaaacaatactttcatatggaatcttagctttatccaagatttgttcgactaaaatcttcttaatgcgttctttcttcgccattttcaactctccaatctataaccgataactatataatatacgctttattcgcgcacactaacagcctcagacactaaacatacagaaaaaccgtccgttcgctgaatgggcggcttttctggttattgaatgaagtctttaataatccgcgtgatgcggtcagccgtgtgaccatccccatacggattcaaattatcagccatctcttgataggccgtttcgttatgcaatagttcttcgacggtcgtcttgacggtgtcataatcagtccccgtcaaacgcaacgtcccagcatcgaccccttcaggccgttcggtcgtatcacgcaacactaatacgggcacattcaatgaaggcgcctcttcttgcacaccacctgaatccgtcataataaggtaactgcgggccgccatgttgtggaagtccaccacatcaagtgggtcaatcaagtgtacccggtcaacgtcggccaaaatctcacgcgccgttttttgcaccgttggactcaaatgaaccggatacaccacttcaacatcagggttctccgccacaatatcacgaaccgcacggaaaacatttgccatcggtacgccttggttttcgcggcggtgcatcgtcaacaaaatcatcttatgattgggatcaacctgttgcaatacctcgtgatgataatcttgttgcaacgtatactgcaacgcatcaatcgctgtgttacccgtggtatagatgcggtcggcatccccaccttcgcgtgccaagttattcgcgctcagtggtgttggggcgaagtagacatctgcaatccgatccgtcagctggcggttcatttcttctgggaatggtgagtacttttgccacgttcgcaaaccagcttcaacgtgaccaactggaatttggtggaagaaggcactcatacttgtggccagcgtggtactcgtatcaccatggaccaacacaatatccggttgctccgtggtcagaatatcatccatccccatcagcactttactcgtaatcttcgctaaactctggttcggttccataatggccaagtcatagtcaggggtcacatcaaaaatatccagcacttgttgcagcatttcacggtgctgcccggtcaccaccgttaccggggtcacctgttcgtcagcttccaaggccttcaccacgggggccatcttaattccctctggtcgtgtcccaaagacagtcattactttaatcatttttgaatcctcctacagcaactaatgctgtgagcgttgcgtcataatacggctgttgcgcaactgagcggttataaattgtcgcgccggttttatagagtttgccatagcgatcagcatctgattgcgccgcataaaagattggggcgctaaagacatttgattcatacttgtgcaacgccttacccgttacggtatagcccgctaatagttgcgtttgttgatcaaagaagtgcatcaaccggcggttaatccacacagcacgttgatcagaactatcggccagcatcatcggcacgcgcgctgcattataggcatagtgaccatcttgtttcgtcgcgacttccttggctttagcggctcgaacgccttgctttgtgacgaccgcaaagtcagggactaagcccgttttatgttgtttgcttaacgttgccaacttagtcaacatgctgtcagaaacttgtccccaccgttgatcattcgttaacttggccaacgatgcgaacacacttggcatcacgtccgacgtccgcatcacccggtaagctgccgtatccgctgttgcccagtcaccaacggttaacagttgttgctggtcattgtactcgtaacgcaaaatatccgctgcgattgctttggccaacgtgttataagttgtcgcttgctttggccaaaccgatgcggccacctgtaaggcatacgcgatatacaaatccccatctgtggcactatgcgcatcggttcgccacgcacccttaacatcgcgctgacgccaattcattaagtgcgtttgttgattagccacaaccaaccgattttgctggtagtaggctagcaagtgatcgaagtccgcctgacttgcccaacctttgcgaccggcttgtgctgtaatcagcatgcccaaaccttgcgcttctgacattgccatctttttaccgtcaacgccagcatttacatacgtcgcttgggctgattgccgcgtcacgaacgtcttttgccaagtttgatacgtattggctgtgactgattgttcattatgtaaacgggcgtacaccaagattgatgtgaaagccacaataatcaaaccaacggccacccaaatttttttatttaaaaccatggtctcctcgctaatcgttaaagcgctttgttttcacccaaacattaccgttacggtggaacaatgcatcacccatcacctgcaacaccgcatgcacagacacggccataaacagttgggtataagtgaaatacgacaggaacgacagccagatttgcttcgtcgttgcctggccaaactgcgtggccatggcaatgttaatctggagcatatacaacagaatcattaatacccagttcaccaacaatacttgcgctagaagcacattattcgtgccgaacgtaaagggaatcgtaatggctgggttaaacagacctgcaatatagaacgcaacgtttaccacaaagagaatgtctgataacaaaatcgcggcattgaaccagaagaaggttgcggcgtagtaaaacgtttcaattttgacgcgccagttactccgatcaaacaaatgtttgatgttattgatcacaacttggtaattacctttcgcccaacgcaggcgctggtagtaatagtccttaatgtgttcgggttcttgctggaacgcctctgaattgtaagccaatgcaatcaacttgccgctttgcataattttgaatgagatatcggtatcttcggtcaacgcaccatcacgccatcctccgattccggtgacgtaatctttgcgaatgatgaaattcgtccctggaattcgaccaatcttgaatagatgccaaatcgcaatgtgttgcacccgttgcgtcacgacaatttcctgattaataaagcgggttaacaagttttgttccgcattacgggtcttgttacgaccaaagaccgccacgtggcgttccggatcttcaagagccttgcgcaccaagaaatacaacgcattccgttcgggcattgcatccgcatcatacacggcgatatattcacccgtcgcaatttctaatgaatcattgaggacacccgccttaccacctttacccgttcgttccacaatcacaatattgcgatcacgatactccggtaattgctgaacacgtcgcatttcgtccgcggtatgatcatcagaattatctgaataaagaagtaattctactttgtcagctgggtaattgaggttcaataaggctgacattgtctgagcaatgacaacatcttcgttgtgggctggcaccacaattgaaatcgtcggataacggcgcaatggggtaattgctacctcttcagtactattcttcaaccaaaaatgaacagccccgaacaacgtaaccattgccatcgtgagggatagccaaattgataacaacgtgatgattaataacacttgatgcaccattagttggtaccccgctgctcccacaacttgcacatggttgcttcaactcgtgaataaatcgtccactgcatcacaaataacaccaaggctaatactaagaaggcgccactaacaaacatggctaaccagtaaaatacattaatcatctaacgttcctttcttcatgtactccgtcactaaatccgtttccatatcacggcgaatatgcttaatggcgtcatctagggttggatagtcctgcatattctcagtcgtaatatatttgtggccccactggaactgtgggcggaaatcaccaactcgaatcgacgctaaatcaatcttcgtcacagccgtcaaatagtcatacgtttcacgcggtaatctaaacgacacaatcaataacatgtcatcatctaaaatgtagaggaattctgatggcaaacgccgctctttcaggacattggcggcttgtgctaacacatcgttatattgctctggattaaattgctggtactgctcgctatgcgcccattgaatgccagtcacatccagtgacatatcggctaagccaggttcgccgttaaatcgggtcacggccttttcaaaaattttgcgcgcattgtatgaacgttgcaggtttaagcccgggtggtaatttttcgtaaacgcggcaatattgtgctgattttccgttaaccacccaaaactcccgacgatggcccgtaagctactcgttaggaaaatagccccgggaaacgcgacaatcagaaaaaccttggcggtcacgtccatcacgaaagtgcccaatagcaataccatgacgctaatcactaaaaagagcatcgctaaccaagttgtgagtaggcttggcaacattaaccccgttgcaattcctaaaatcacaagtagcacagttgcaatttggacaacaccggaggttagccctgccaaccaaatgaataaaataagtgcggtggtgaagccgaaaattgctaaacggctacgtgtgatgagattttttctcgaagtcatttattgccctccttttacgaacaaaaagtaaacgagtactatcctgacatgttttgataacttggttaataaaatgcctttcaaaaaaacaacgaaaaaatataaagccgtccgttttatcagactatacgtgtaccaaaaaagcctcatgacaacatttgcaaacgttgtcatgaggcttttctcattcactcatatttacttgttttcgacgccattcattgaacttttccatgccaatgcgattaatttcatcgaggagctggtcaatataggcccgtgactcgataccacgccaaatataaacgacctcatgcccctggctatcacgaggcacgtcagtcagtaagatatctgtatctgctgtgcgccgattcgaaatttgaatggtcgtccgcgtgaccgccccaaattgatcaagaagcaaccgttcgacattcacatgattcccaaaatcaagcgcaacatgcactttcggcacatcgataaagaacgtgctcgttgtcgcaatgccagctaccaaatccgttaacaacaccgtcttcagtttgtcagcactcacccgttgctgggttgcaaaacgctgtacaatttccgtacccaattcggtcgataacggatagcgattcgaaaactcagcgaaatgttgcatatcatacgtgccatcgccaaccccatacgggtacatcaagaagcgcattaaactgtcaccaactgtgtacgtgaggcgtcgtgactctattccatgtagtggccgataaaagatgcactgataactcgcttgcacactatcgtcaaaatcttgccaccattgcatcacatggtcagtcacgtcttgatgggtctgcgtcgtggcaaaaagtcccaagctgtgtaaaatcaagacaataaaccgagcttcgttgtctaaagcttccgctgacagcaagccgctgcgccccatcaattgtttaaccgcctggatgacacgttgactttgaggcgacatctcaggcgtcggtactaaatattggtcggtatacgcagcagtcacaaaatgttggtgtgtaaatcgaaccgtccaaatcgccgccatatgccaaatgatacaacgttgcgattcacgtaaatcaccgaattcgggtgtaataaagctatcaatataataatttgcaactcgtttcacgcggtcaggaatttcttctgtccgttgcccgttgtaaatggttaacaatgtgaaccgcagaaaacggatattttcttcctgaccaactaattgatatgttttattcaaggtaatgccttgttcagtcaggtgttcaacaacgatagcgcgctctttataaacggttggcgttgatacgttcaactcaaatgccaggtcttcccaagagtcaaaatcttcagcgactaggtgcataataatctgcgcccgtgtcgattgtgagaggtaataatgtttcaattcatcaactggcaaaacatttagcggcgcatcaaagataatgacgttacctttttcaatcactagaatatctgtttcgcctgtcaagacggcaatatcttcattcagctgttcaatgattgaaatcaccatgtagcgtgaaaattgaaattcagccatcaagtccgttagtctggtgaagcgattgcgtaccatatagcgaaagactgagatgcgattctgttcctgcgttgtccagatccattccatatgtattccccatttaaaccccaaatttcaaaacgattatatcaccactgatgttaataaaattataaaattttttcaggtgtcgtcgcattgcgacgaggcatggcgggtggggtgtgacttcggcaaagattataaagagcaaactccgccggcgcgagcaccggctaacacccaaatcattgtgctaagggtcgggctcctggcgccttatttaaccggcggtcggccgaacttgtgagttccccacctgtcatcgctgcgccaatctcccacacccatgccggcagccgagatattctctactttttagcaaaaaacagcaatgacacgggccattgctgttttaggacttaatatatcgattattttctgcttaatgcaaccaatataacactgccgcaacagccactaggacaccggcaatcgttagaattggtcgccgaatgtccttaccaaccacaattaatgatgcagccacaaataggccgactagactcacaatagtttgcaccatggcaaggactcgcttttccttagattaagcttgtacgtgtaattctcgaatgcctcgtaggatcatacggtactgctcacgctctagcataccatgatttagctcatctgacgccttgtccagtttttcgtccgcttctgcaccgaatgacatcccctcttggcgggcttgttgcacaccggcaatcacgttgaccgtaaactgatgcaatgtttcaagcggtgccaattcaaccacgcgtgatgtaatcgttggctcaaaatcattcaacatttcagtaatggccatgaattcatcagggcgaatcgcacccgccaccacgatatccaattgttggaagaacgtcacgatttctgggtcagtactgaaaccgaacacttccgcttcacggtgcattgattgaatcaattgccccaacatcatcacgttcgactcacggaactttggcacaaagcgaataaatgacttgatcatcttttcatagtcttcagccgttggttcttcactcgtttgttcgcgcaacccttgcaaagccgtttcaatcactggatcctctgacgcaacatcgtatgaatcaacaatattttcagcgactaacttcaacatctcgcgattgccttcatagaacttcaacggtgcaaacatcaagcgcatacggaattccgtcaaacgcgctgacaattcagcaaccgtgtcacccaattctaggctcgttgctaatgacaagatacgggcgcggtcggcttcgtacaattcattgtcacggacatcaattaatgcggccaactcatccattcgctctagcactgacacagtcgcatcaacgattgcttggcggttaacgaccccacaatcccaaccatacttcttgctgaccgtttccttcggtgcggccatcatatccttttcaagggctaatcctgttaatagtggttccatcatgttcacctcaacttagtctttattcatcgtactgttatcgtaccggataaatattgtccaattgtcttgaaaacttgtggattatgcgaaaaaagagaccaacatctctgtcagtctctcatctaaaactattcttgatcgtactgccattcatcaggaaaacggagaataccattcgtccgcaacaaagcagatggatagagttccttcaccatgaagaattcaggcgtaatttcaaaggctggcgtaaccccaaactctgatgagcggatatagccgaattggttccagtagcctggccaaccaatcgccgccaagacaccatagccatcgtaacgcgcggcaatctcggcgttttgcgtcaaacgccaaccaattccacggcctcggtacagcggatcgacgacaaccgggccgacaacaccaatcgatgaacccgtgcgattatcagacacagtcgcacccgaaaccatcacgtaccccaggacttcatccccacgcttcgccacgatttcaattggtcgcttaccgaatggttggcctgcacgcaaccgtcggactaacttttcttcctcgccggtactgtaattcgcatcgtcgaatgctttgcgaatcacctgatcaaccttatcaaagtccttgtccgtcaggaactcaaaatgcacgtcaatcaatgggtgcgttgcattcatctggcgcattgggaaacggtcaaaaatgtaacccaattgcttcatgaaacgcaacttttgtgcatcaccatgacgtagtttctcactgcgatccggatcaccaatcaaatgaccaaataagttatacaggtcataagtcgtcaacacgcggaactctggttcagtgtgtgtaaagataaattggcctggtaatttatgaccaatcaacggttccactgcactttggggcatgtaagccactgacagcgtattatcaaaattgctgtataccaattcaggcacatcaagccgttcaaatttggccgcacgcatgatggaatcaattaatggttcatcatctaaaaagtcatcttcaataattaatggggtaatcttactatctaagtcgtaccccgacaaaatttcgagagcaaagccacccgacacgattggcacgatttccgcgtcatttaacatgcggactaattgttcaaaatctgtatagcgcgtcgcatccatttggcacgccctcctatcgtcaatattcagtacttcaattataccgcagatgcctagtgatatacctgtcgtaactcgctaagtaagtctttggtttcttgcacataaccaaagcgacggttcacatccccaacggtcccagcatcgtggacgtaacccaatccttcgtagaccaagttttggtacaactctaagtatggcaagttacgttctgtagccagctgcatctcggtcgcttggtcatagggaatcgaacggaaatctgaggcgaagtgggtcccatcgaccgttaacatcaggtaacgggcatcgcggttctgacgcatcttacgtttcaatgagaacggactgccgactgaacccgggtttaagatggcgcgcccatccgatgccgtacggtaaatcatttggtgcgtgtgcccataaatcgccacgtcagcttcacgccccataaacaaggcatcgaaataatactgatcgctcattggtagcaattcatgtccagaattcttctgtggcaaattgtgcgatagcgtaaaggttaagtcctctacgttatgggtatctgcaaccggcaacgccatgatgaagtcgtagtcctcacgcggcatgttttgcatcacgtaagatgccaaacgcgccgtgtagacacgtgttggcttattatagtcgacagtccgctccaatgctgcaaataggaaatcatcccagttaccacggagccaaactgtgacattaatcttacgcaacatctcgacaatatcgtgtgcgcctggccctggcatgaacaggtcccctaagaaccagtattcatctgctcccgccgcttgtgcatctgcaatggctgccgcaagcgccgtcacattaccatgcacatccgacaaaaccgctactttcttcatcattcgtcacctcccgttaattaagtttcattgtaaatcgaaaaacaccacagccccctgaaaaaggaactgtggtgttacattagattaacttacgatctgattgttgcatcttcttctcgaagcgacccaacaaacgactaataccaaatgtcaaaatgaagtaaattgctgctgaaataatcaacggaatgaatggcttgaatgacgcaccttggacgacggacgtctggaatgtcaattcaccaacaccgataacggaaaccactgaaccttccttgataaccgtcacaaattcattacccaaagctggcaagatattcttgattgcttgtggtaacaccatgtaacgcatggtttgcatcttcgtgaagcctagcgaacgcgcagcttctgtttgaccagcgggtacagcttgaattcctgaacgaataatttcggcaacataggctgcggagttcaagaacattgcaatggcaccggccatgaaacttgaaacgttcaaaccaataacttgcgtaccgaagtacacaatgaatacttgaatcaacaatggcacaccacgaacagcttcgatgtaggcaaccgcaaaccactttaatggcttaacgcttgaaagcttcatcaacgccaacaaaatacccaaaacaattccgaagaaaacaccgatcacagccaaaccaaccgtattaatcgttcccttaacaaagtaagggtagtacttttcaaagaatgattccttgtggttcatcagtgcaactgcttcatcgcgccacttatccaatggggcaccgataacatgcttttccaagatgttattaaccttactttgcagcacagtcgcattcttggccatcacgactgaagaaccattcgtttcacctggcaaagcggcctttgcaaccgcaaattgtgtactctcacccaagtaactatcagccgtcgtatccggtacgacgacaccatcaaccttgccttgtgtcaactgggtcacggcatcgttaaccttctttaatgacacaaccttcttcgcatctacttgcttagcagcatcttcttgaatcgatgacaattgcgccgccaacgtggccttcttcaaatcatttagattcgtcaacttgttggcgttcttcttcagcgtcatcaccacgttcttatcaacgaagtatggttctgaaaacgatgcttcttgctcacgttcaggcgttgccgtcatcccggccacaaccatatcaaccttgcccgtctttacggcacccaacaacgcatcgaaactcatttcttgaatgaccaacttcacgcccaaacgcttggcgatttcattggcaaccgaaatgtcgaacccgacaatcttatccttaccattaacagtcgtgtggaactcgtatggcgcataatcagctgacgtaccaacaaccaacttgccacttttttcaattttcgataggacgggatcggtttgcgcagcactcgctggtgcgaccattccgaccaacatcatcattgtcatgaccgcggccatgattttcgttacccatttttgcatataataaccctcattttttacaacatcttcgctaagaagctttgcgcccgttctgaatccgggtgctcaaagaacgcttctgggtcatcatattgggccatgtcaccatcggccataaaccaaatctttgatgccacttcacgtgcaaagcccatttcgtgcgtaacgaccaacatcgtcatgccttcctgtgctaattcacgcatcgtcttcaatacttcgccaaccatttctggatccaacgctgaggttggttcgtcaaacaacataatcttggggttcatcgccaacgcacgggcaatcgccacacgctgttgttgaccaccagacaaggatgctggatatgccgtcgctttgtcggccaagccaaccttcgtcaaaaacttttcagccgtctgtgttgcttcagcatcagccacgcccttgaccttaaccaaagcgattttgacgttctcaatcaccgacatatttgggaacagattaaagctctggaataccatccccatatcctggcgaatcttatctaattcactttctgaggcttgcgtaatatcttgcccttcaaaaataacttcaccagacgttggtcggtctaacatgttcaacccacgtagcaaggttgacttaccagttccagaaggtccgagcaaggcaatgacatcgccttcctcaaccgttgcgttgatactgcgcaagatggttttatccccatacgctttgtgtaaattcttaatcgttataatcgccatcttgctactcctttgtttcgtactcgatgaatagatattaccaagttatgtaattttatgcaataactttctttgtttttgtatatttatcacaggtggaaacaggcgcaaacgccgtcattacaacgattacaggtttcaaaaaagttttttgtatacagaaaaaggcccgctaattgaatagcgggccttaagctctctctttgcacaacgcttagcgtgcaatgtgttctgtaatgtttgcttcgtcttcacgccaaccctttgcgtgggcacgtgaacgcaagtcagcttcgatttgctccaacgtttggttacgcgtctcaattgtgaagcgcttgacgaaccagatggctgcgatacatagcacggcataaccgatgaacaatgaaccagtaccgaagtagttcaacaatggtgggaacgtcaatgaaacaatggcgttggcaccccagttaacaacggctccgaatgagttacccaaaccacgaatgttcaatgggaatgactcaccgatcatcacccacataaccggtccccaagttgctgagaagaaagcgatgtaaatcgtcaatgcaatcgcgcagatgtaagctgcggcatgtgattgacctgagaagtgcattgagaatgacatgatgaagagtgaaatacccattccccaggcaccccagatcaacattttcttacggtcaaccttgtccatcatcttcatggcaacccatgtcacgataacgttaaagacaccaattccaatgtgggcaatcaaagcggcactgacaccaaatccaacatcagtaaagatggttggggcatagtacaaaaccgtgttacatcccatgacttgttggaagattgccaatcccatggccattaccaagaccggacgggccatcaaaccaaacaattccttgaaaccaccgttagccattgaggcttgcaacttaatgtcagccaattcatccttagcggcttctgagttgtcttgcaactttgtcaaaacagccaaagcttcgtcttcttgacccttacgaaccaagtaacgtggtgactctggcaatgcgataccaccaaagaacatcaaaattgatggtacagcggccaatcccaacatccaacgccaaccaaggtcaaagcctgacaacgcgtagttagaaatgtaggccaacaagatacctgtcatgatcatcaattggaacatggttccgattccaccacgcttgtcagcgggtgccaattctgacaggtaagttgggatcaacgctgatgcaccaccaacggcgattcccaaaacgatacgtgaggcaaccaacaactcaaagttatgagcgacggctgagcccaacgcacctacgataaagataagtgatgagaccatcaacaacttacgacgaccgtacttatctgatgaaggtccaataatagctgctccgatgatagctcccagcaaaaccgctgacactacccatccttgttgccatgaacccaaattcaattgcttctcgatgaaaagaatagctcctgaaataacacctgtgtcataaccgaaaagcaatccacccaaggcaccaaagaaataaatcagacttgttgaaagtgactttttctcatttgtcatgtttccgttctcctgaactaatataaaataaataagttaatttatcgatacaaccaacctctacatcaactataatactcattttgaaagcgctttcaagcgaattcacttattctgctatatttagtcgcaaatggtcaaaaaacggtcatccatttctggatgaccgtttgaaattcgtctagaatagtggattcttagtggttacgacataggctgccccgattgggtcaccaaagcgttgcaaacccttagcgtcgaccaggaagtcaaagctggccaagtcacgcatggcttgctcaaccgcggccggtgccaaattctcatcaacatccttcaacttccagtgcgccttagcccctggcttttccgtgttcttagctgcaaataccaaatctaatgtcttcatgttaaattcctcctcgttttgaattacgcaacaaccggcacgttcttggcggcgacgaccttgatttccgtcacagctggttccacacccaagacttcgacaaccttggcgagctgacgcagttgtgcctccgccgtccctggcttgacgtagaacgtccgggtgatcatcttgtcgttggcggggtgatttcccgtgaaacgtaccttaacaacttccattacttggttttctgacatttttgctgtcctccgcattttgattttgagtacccgtggccacttcgactcgttctgagttatcagctttatttgctgacacctatactaacgaaacgaggggcgcaaaatgtcgcaaagtcgttgaatttagttttggcgggtcgttttattgttcattgcaagtcgccgcttcgcgccgaggcatggtgggtggggcgtgacttcgccaaagattataaggggcaaactccgccggcacgagcaccggctagctcccaactaattgtgctaagggttagggtccgctcgccttatctaaccggcggtcggccgaacttgtgagttcaccccttataatcactacgtcacaccccacccaccacgccagcagccgagatgttctctatttgattcgtttaacttgagattgagcacgaaaaaggcagaccctcagagagtctgcctacagttttattagttactcaagtatgcaatcatccgctgttgtgcagcaatgattattgccagcatatcttgtacaaatagcgttgcttcagcccgattactcggtctgcttgtttctcgaaacgctttatagtacttgcgtacattttttgaaatctcggtagatatagataagccagttaattcatccaaggactgtgctaaatcacttgcgagtaagtatcgtccaaaccgaccattgccgtcattaaatggatgagtattctcaaacataaaatgcgtaataattgccttaaaaaccgggtccacagacaacgtatttctaaatgaaatcactgccatcaggacttcattaatttctatttctgtttttggtggttcgtgagtcgttttaaatggtgtacctattctgacttctctgtcacgaaataatcgaccgtctggtaaatcagcattgccaatttcattttctaacagctcatcataaatcactctgaaatctaacaacttggtaatttcgagcgggacacggttggatacagccagataccgtctcgcactacccgacaatcgtgcagttacccgcttcaccggattattaaccactgcctccaacgcggttgcatcaactgatacatcctcaattgcattggtgtgtataatttcatcaaccaccaaccgtttcactaaatgacttctttcgtcatctgacaatgcctgttttaaggtcgtgagttgcaaggaattttgagcaatttctgcgcgtaactgttttatttgctgagtcatcaccataaaaagtgggttggctgaattgcctaactcgctttgattaaacagctttgggtatagatttgtaacaactgtcgattcatcgttgatgcgtcgttgatattctcgctccaagccaacgcttcggcgctcgactgtctcattaagttgatatttatacttattcaacaattgatgctttgccatacccatgacccctttttttcgtttagatagcaataaatcccgaaaatagcgcttttcgggatttgaaaactaatcatgcaactgctttagtgtggatactgtgctccacgctcgtagacttgttctggttcctggctgatacgctcgaacttgttcaagccggtaatcaatgccatttcttcatctgttagtgcgaagtcataaacattaccgttttcaactacacgttcgggacgtgatgacttcggaataatgcttgtgccacgttggacgtgccagcgcaaaacaacttgcgctggtgacttttggtacttcgctgcaatttcaacaatcacaggctctgccaaaaccgatccacggcccaatggcgcccatgcttgcgtcacaatgtgattatcttggtgatactgcaataaggcgtcctgcgtcaaatgagggtggttctcgacctggttaaccacgggttgttcattggccctggttgccaaatattgcaagtgaaccatgccgtaatttgacgtaccaatcgacttcacgagtccttcgtccttcaaacgttcaaaagcacgccacgtctcaaagaagtgttggtgcaatggccagtgaaccaatagcaagtcaacgtagtccatatctagttcgcgtaatgaggcttccacagaggccaacgttgcatcgtaaccttgattagcttctgcgacctttgtcgtcacaaacatctcgtcacgtggtaatgagagctccttaattgcagcccccagcatcccctcgttcttgtacatctgcgccgtatcaaatagacgataaccactttcccaggccgactggacgacaccagctagctccgcttggcttgtgaccttatataatccaagtccttgcaacggcatctcatggccatcagcaagggttacctttgttgttaaatcagacatgttaaatccctccaccattcattttacccgattttgtccgcacaaatataacttttctatgacttatacatcgctgctaaacacatcttggctgccacaactgaccggggttgtagccggagcgctcaaaactcggcaacatgccgcatggccggcgtcattcagtaaagtccacacaggccttgaggacttagggggaattatttgccccgctgaatggcgtccgcgccattcggttgccgattttgagctttgtcggaggctacgaccccggtcagttggttcccacctacacacaaaagcgacgcctttggggacgtcgcttttgcttttgagatttttaagttattttcgagatgtattttgagagtgttcgttaatttgttaagttaaaacattttgggtttgtttttaattcattagtccttgatgtcaacgtaagtcaacttgaacatgtttgacaagtcctgcaattgctcggctgtaatcttgaatgacaagaccgtgtggtgaccaccaccaactgacatccaaccaacagcacccttgttcaaaccttgcttaggcgtccacaattgcttagccactggcaagtgaggcatttcagcttctggcttgttaccagttacatcgtatgacatcaacttgaactcgttaccgtagtcagccatcgtggcgtcaattccgtcaccttccataccagtgaagaccaaacgggcaggatcatccttaccaccgattcccaatgggtgaacttcaacacgtggcttgtctgaggcgatcgttgggtcaacttccaacatgtgtgatcccaagatagcttcgtgacccttacggaagtccaatgtgtaatcttccatgaagaccgttgactcgttgtgagccatgatcttcatcaaacgtaccaaggcagccgtcttccagtcaccttcaccagcaaatccgtaaccttcagccatcaacaattgtgctgccaaacctggcaattgctccaaaccgaacaagtcttcgaagttggtcgtgaaggccgtgtaaccattcttgtccatgaagtgcttgataccgaagtactcacgcaattggtacttcacgttgtgctcaaacttttctggtgtgttgtcgccgataacgaagtcgtattccttttccaattcagcgtacttagcatcgatgtcatcagggttaacggcattaaccgcctcaaccaaatcaccaacagcccagtaatcaaccgtccaaccgaacttgatttgtgcttcaaccttgtcaccgtcagtaacggccacgttgcgcatcttatcaccgaatgtcacaaccttaatcttgaatgattcgttgtaggcaactgctacgtccatccagttagcaacggcttcttgcacttcctgatcagcccagtgacctgagatgatcttgttgttgatacccaaacgggcgttgatgaaggcgtactcgcggtcaccgtgggctgattggttcgtgttcatgtagtcgaagtcaatcgtgtcgtaaggcaagttgttcaagaattgcgttgccaagtgcaacaatggcttttgcaacaattgcgtaccacggatccagttcttagctggtgagaacgtgtgcatccacgtaattacaccggcaactgaatcgtcgaagttagcttccttcatggcagctgcaatgttttctgatgtcgttgccaccaacttgaattcaactgggtatggcaagacacctgattcattcaagccatcgacaatcttcttcgcgtttgattcaacttcttgcaacgtctcaggtccgtacaagaattgtgaacccgtgataaaccagaacttgtagttgttagtgttaaacataatcattattccccttaagtaatttcccgaatgttagttagtaacttctgtcttcttttgaccgtaataggcgttcgcaccgtgcttacgcaagtagtgcttatccaacaacgtttgtgacatgtgcacgttgtgtgggttcaacatcatggtgtggtaggccatttgtgcaacttcctccaacacaactgagttataaaccgccttctcggcatttggtccccaaacaaatgggccgtgatcttgtaccagaaccgctggtacttcgttagggtcgatgaaacggtcttcaaacgtctttacaatgacatttcccgtctccaactcgtaagccccattaatttcagcttccgtcattaatgacgtggctggaatatcaccgtagaacgtatccgcgtgtgttgtaccagctgctggaatatccacgccagcttgcgcaaatgaaacagcccatggtgagtgcgtgtgcacaatgccaccgatatctgggaattccttgtacaagacacggtgtgtgtccgtgtcgcttgaagggttcaaatctccttcaacgacattcccgtccaaatcaacgacaaccatgtcatccggcgtcaaatcatcataatcaaccccagatggcttgatcacgaacaaaccactttcgcgatcaatttctgaaacatttccccaagtaaacttaatcaaatcgtgctttggcaaagccatgtttgcctcatacacgcgctgcttcaagttctccaacatgaatttcatcctcctctactgttgcaactaccggttcgtctgagatggcatcaatggcggccttttcgatcgcgataccgtccttgtagcggaccataaattcttcaaaaccagcgacgtcaactgggtcaggcgccatcgttgtactgtcttggttcgcgaagacgcggttttccaagaagtccgccaatgactcaccagcttcacgcatcgtcacatattgtgacaagattgccattccccaagggccaccttcaccagcgttcgtcatcaacgtcactggggcgtccataactgcggccaaaatcttttgaccaacgactggtgtgttgaaaataccaccttgggcaacaactgaatccatcacaacgtcttcttgcttcaagatgtccaacccgatcttaacggcaccgaaagctgaatagaggtgcatgcgcatcaagttaggcaagttgaattccgcatttggcgtgcggacaaacaatggacgaccttcgttaacacccgtgatgttttcacctgagtggtaaccgtagcttagcaagccacccgcgtctgggcgggcatccaaaacggaacggaacaaggcgccgtacaggtcattggcactcaactcaacgccaatagcttgtgcgaattgcttaaacatccgagcccaagcattaatttctgatgagctgttattggcatgaaccatggcaactgctgaaccatcaggcgttgtgaccatatcgatgtcttcgtgggcttgtgacaaagccttttccaagacgatcatggcaaaggctgatgtaccagctgacacgttagctgtacgttgcttaactgagttcgtcgcaaccattcctgtaccagcgtctccttcaggtgctgcggcaaccgcaccaccaaccagcaaaccgcttggatccagcaacttagcaccctcatccgttaagcgaccagcttcttcaccagctgacttaaccgttggcaagatgtcgcgtaacgtccagtgatattgttggactgacttcaactcgttgaacttgttcaacatgccttcgtcgtaatcgaccgtgtttgaatcgattgggaagacccctgaggcatccccgacacccaataccttttcaccagttacttgccagtgcacgtaaccagccaacgtggtcatgaagtcgatatccttcacgtgcgcctcttggttcaagatggcttggaacaagtgggcgatgctccaacgttgtggaatgttaaagtcgaacaactctgtcaattggctagcagcctgacccgtgatggcgttacgccaagtccggaaaggtaccaacaagttaccgcccttatcaaaggccatgtaaccgtgcatcatcgctgcaaaaccaattgatgacaagttacggataactgtgccatattcgatgttgacttgatccgccatatcgcggtatgcatcttggacacctgaccagatatcttctaatgagtaagtccacacgccattttcaagcttgttttcccattcgtgacttccaacagcaattgttgagaagtctgtggcaaccaagacagccttgatacgagttgagccgaactcaattcccaaagcggcttgaccgttcataatttcgttttgaatttgttctttattcattattccgtttcccctcaaacgagaatcattttgcgttttgtaatcgtttacatgaattatattaaatcacttgtccgtacaaatcaagaacaaattcgaacaattcacaattgggacatataaatcacagttaattcacgttagttgtccggatgaagccgtttaaaacgcctattatcgggcgtttctttaattccggacaaatgtagcggttgttttaattttgcgtacaaatgttggttttcgtgtgtgtcgtcgcgttgtgacgaggtgtggtacactgtttcgcagagaggctagtgatatgactaacgaaaacaacaacttgccccgattgattgaggagcaaataaaacaatacccacagaacagacgccgacctgtaaataaggtggtgtatgcgaatcgatacttcgcattggagaataacattaaagagaacacattcagcatcgttgctaatgatttggtgttctctgcgattccctatgacacagcccgatactatatcgagcgcgccgcgcgttactcaatgttgagtccagagaaaactcgacgatatttagaaagccacgaagataacatcaaaacatacattggcaaagctttaatgcagaaagccggcgttatgcatccttatggaccagatgttgatgcgttcgttgctaaaaacgaagcacacataactactgagtaccataaaatcttcgaacatccattatttgaaattcaggtccttgggcgcttaatgcaacatgactcaaccggtccattatctgctaatcttgccggtaagttcctgtacgacagcaatcgattcacaggtattatgggctacatctcggaatacatgaagtttatcgcccaggttactaatgatcttcagatttctaccgacggttcaggcgttatgttgttgtctgaagggaggaattttgaggatttatatgtgtctgcggatacagacctgacccgcgcatcagaattattacctgcgggaacggtggccgggtttaactcgcgcgctgtatctaatataaccgaaggtcaatatgacgatcccgacacgcgaattttgttgaagtctgttgttggcgcagaattgtctaaagcacgtcaaaactatacggcacactcagtaaaccctaaacttattgatccgtactacaaaatcgtgttgccaacgtcaaataacaataaaatcaacgttgtatccgacattcacgccggtctagtaaataaggatctgacttcattaccattcagcaacgataacttcaacattattgccgatgacgcgtccgatggacgtgtgtctgacaaaaatattaaagggatatacgttattggaaaccatgatatgaccgatgtgttagctggcatggtcgtgtcgaaagacgacacattggcaaagtatcgtgactatcaatggttccaattgttggttgccaatctcggaaacgatgcatggccattacttcccgctggcgacaacgacatctattcctatattgccgatgacgttcagtctagatttccacagttaaaggtactgaacaatgaaggaatgatgtacgatggcgtacgctatgccggtttaacggtcccaattcgttttgcaaaccaagcagctgagcagcaatggattgctgatgaattgattcgcatcctaggagatgacatcactacaccaacagttgtagttagtcacgcccccgtcttcaatgagttgagtatgctgtcaaaaaagagcaaatcattcagcgataagtacgctttgtccaataatcagctggctaaaatattcacacagtacaacatcatcggcgcggtccacggacaccatcacattccagctgctcaagcaggctggcataagatcgtcaaacagttcggacgacctatgtttgttatcgactcaatctacgccaacaacaatacgggacaagaattagaaaaagagttcactcgtcagcgtcgcgctgcggagtcagaaaaacagaacaacccaaatcaactggccgcacgaaaagcccgcatcgaatccaagacccgtaaatattctgtagatgacgatattaaacaagtcgtcggcctgacttatgagaaacctcgcaatcgctatactgttaataaaactatcgacggcaagcacatacgtaaacatttcttaaataaagccaaagcaattgcttatctgaaccaattaaacggacattaatcaaagccaccgcaccgtaccaagtgtggtggctttttacacacagtcaatccgaaaacatttccatgatttagtcatcactccacaaaaagcggattagataactagcaaaacccgcatcttaatcgctgcgtttactgatgttagcccggtcatttgtaatgtctaacaattttcagcaacatcggcaagacgatttcaaaacaaattgacttcatcaaaaataacaagtcgctgtagttgcactttaaatttttggtttccaaaggcactttatgagcgtttactattacaaataggtatgtatttcgccatttggcgtagatccaaaattccgctcaaacaaaaatcccagcaagcctcgctggacttactgggataattttggaattattagcctaaaaaatctctcacaatttttaagggttaatcggcgttacgcctgggactcagttacctgctccactgggccacccgctgcctcttcgactgggttaaccttcttctcacgttccaagaagaatacggctaccaacgtaatgaccataaccacagctgacatcatcaagtacgttgattggtaaccaaccttgtcgtacattgatccggcaactgttgagaagataaagactgagatttgcttagcaaagttagatgccaaagcgtagaccgttgcgtacaaacggatgtcgaaggcacctgagatgtacttcatgattgaaaccaacaacaatggcatttcgaaaccagctagcaaacggaagaagacaatccactcccatgatggtgccatggctgatccgaagatacgcacgaacgtcaagaatccgtaaatcaacaaaccgttacgagcaccaatcttgttgatgatgtaaggcatcggaatcatcaagcacaattcaatcactgtttgcgctgagttcatgtatgagtacatgattgttccttgtgagtcagtctcaaagaacgtcttgaagaagacgataaattgttggtcgaacacgtcgaacaaagctgaggcacccatgtagaacaaggccaaaatccagaagttacgcaacttgaagattgagaagatatccttcttagtcaacttttcatttgaagcacccattgcagcggctgcgtttgagaagttaatcttcgttgagaacaacaacaacatggtcaacaaaaccgctgacgccgagcaggcccaccagatagcgtttggctgccacaagaacaaacgaccggctaccaaagctgatacggctccggcaactgatccacccatacgtgagtgaccaaactcgaacttgtttgccaatgaggcacgttgtacgtactgctcaataactgacacaccaccattcaagatgaaggccaacacaataccagttacgattgacgccaaaactgggctgatggccaagattggcatgaaggcccattggaagtaagggccgataaagattccagcaattgcaatcgtaattaacaacgtctttttaaagaccaacttatcggaaataactccgaacaacggttggaacagcaatgacattccagccatcaatgagaagaccacccctgattgcgcgcctgataggccagcttgttgacctaaccaaagcgtcaagaatccatatgtaatcgcccaaataaagaagtaactaaagtgtgaagctgcaaatccccagaaatgcttgctctccttaacaacttgactcatgataatccccctgagttttcattcaattagttaaaagtaaatggttgtggcttgccaaacactgggaagccctcatcatcccactcaaatggttgcaccatcgtgtggcggtttggatcgtacaaaggatcacccttgatatccaagtagttacgcacgtggtaaaccaacaaatcggtttcaccatcttcagcaaccgtaaatgagttgtgacccggaccgtacaaaccgttttccatatctgattggaaaacagggtggtccaacttatgccagtttgcagcgtctaagacatccttgtcatcttcgatccacaacatccccatcgcgtagttttcatcagtggccgagccagagaacgtcaagaacaccttgccgttacgcttcaagatagctggtccttcgttcacccagaaaatcttagtttcccagtcgaactctggctttgacaacataaccggcgccgtcttcaacgtccatgggttttccatttcagcgatgtacaagtttgagttacccttaatttccgggtccttttgcgcccaaacgtagtacaacttgtcgtttaattcaaatgacgttgcatccagggcaaatgaatcaaggtgcgtttcaatttgtcccttttcaacccagttttcttctgtttccattgggtcttctgcgtcgcactcgatggcaaacatgcggtgttggaacatgccgttttcatcaaacgccgttgtatgtgaagcagcatagtacacataccacttaccatccgtgtagtgtaactctggtgcccaaatcaattcgctttgtgcgccggtacctgaatcgtgcttacgccagattgtgcgtggcattgcgtgagccaaaccatcaatcgtcttcgcacgacgcaactcaattaagttgtaagccggtaccgaagcaacaaagtagtaataaccatccgtgtgcttgtagatatatggatcagcgcgttggatgatcactgggttttcgtagcgaactgtcatatctgttaaactcctaaaatttcttgaaagcgttttctttcttttacgagtattattaaaacacttgtacggacaacttacaaccccaaaagcattcagttcacgttcaattcacattttcttaaactttgatacatttatcacaaattaaaaatacggttttttagttagaaaaacgcctatttataggcgttacgtataatttcaggcctgttttgtaccagaatgaaccttacgctagtgattgttgtccattattccggatgcgcttacatttgtacggacaataattgattattgcttatttacgtctgtttttcataacaattcacggttttgtctaacacaaccggacaattacttgtataatgaatatcataaataaacacgacagagagattgggtctaatatggatacgaaatacgatatcgttaagaaagggcttcgagatgatatactttctggtaaatacgccattggcgacaaattaccaaccgaagctaacttaaccgaacaatatggcgtcagtcgttataccgtccgtcgtgcaaccagtgatttagaacaagaacatttcctctaccgcgttcaaggtggtggtatgtatgttgatgattggaataaagcgccggcaacaacttctgacaataaggtcatcggggtgattacaacccacctagccgactatatcttccctgagattatcagcggcatcgaccgcgtgatttcagatgaaggctactcgctcttcattagtaatacgcacaacacgtatgaacgtgagcgccaaagcctgatgcgcatgattgaaacaggcgtgaacgggttgattatcgaaccaaccatgtctgctttgccaaacgccaataaagatttatatgatcaaattcgtgaacttggcattccgaccgtctttatcaattctacttatgaacatttcgacttcccctacttagaggtggacgataccaattcagaagctgatttgattaatcacttaatcgcacaaggtcacgaacgcattttgggcgtgttcaaggttgatgacgtacagggtgcgcaccgtatgcaaggtttctacaaggcatatcaacagcacccggcgattgcgttgcacagtaacatcatcatgtatcaatcaaacgatgaggctagcaatgcacaaatcttgaataagattgaaacgcacttggaatccgctgatcgaccaactgccttggctttgtacaatgatgccttggccattcaaacgattgatttggtgaaatcacttggtttgcgggtaccagaggatattgcgattgtcggatttgacgattatgcgatgtctcactacatgacgccaagtctaacgacggcgcgtcacccacaaggtaaaatggggcgtgatgctgggcggatgctccttgagttgatcaagggccaccccgtggaaaacgtccgctacgatagcgacattatcattcgcgattcatctaactatcacgtgaattaacacaaaaagagctactgttggtagctcttttttgttctctgtcaaaccgaacgcctcatgagcagattatttgaaacaattctgtaacaataggataattgatgtacattaacgtgagtcattcttatataggagggtttcggttatgtactatctggttaataaacaagcaacaacgttaacattctattttgaagacggcacacaagacttcggtctcgaacaattatttaacctgagtcggcacgcatttgctgaaacgattgccccctatgggattggcgagcacatcgaagaggcaatggccttcgaacaaaccttttcggcttacgagcgcaaggatttggagattgcaactaaggatgaattgattgaccttgtcattgcgggccaagaagaagccgttgccattcgcaagtctaaggaagacactctcgccatgaccctaggtttggttgtcgcagggccatttatctttctattagttttgctggttcttgaaagtatcgggatgccaaagatggcggctgagatttgttccttggtcttaaccatcggcttgattattgcctggtttatcctggtttggagcaagtgggggcgtcgtttggagacacggttggaggattcactggccgatcattttaagcggccttcttaactgtgtgttgtcgtgttgtcgcgttgcgacgaagcatggtggtggggaattaacttcgacaaagattccatctgggcaactccgccggcgcgagcaccggctagctcccaaataattgggataaggatcgggttcctggcgccttatctaaccggcggtcggccgaacttgtgagttcacccaggccaatcgctacgtcacaccccaaccgccacgccagcagccaaaatattctttgttagtttgattttcatatgcatgaaaaagaggtcagaaccttgtgagttctgacctctttaatttagtttgcttaatctaattctggtattgcttcaggtgtaacttcttctgttgcgattttttgctttaattggcggacaaccttaatccaagctgggaccaagaaaatcagcgatccaatccaagctagcgggttggctagactggctccgaagaaaccaaaccaaacgaccaatgaaaaggcagcaactgaacgaacgaccatttcaccgacaccggcaagggttggcgtcttaacatcgcccaaaccttgcaaagtgtaacggagtacaaacagcgttgccaagatagcgtagagcggtccgtttgcccagaagtacaattgcgccaaatccatgacttcatgttgaccctgaccaacgaacaacgtgaccaaatcgcgaccgaaggcgatttccaagactcccaaaatcgtcccaacaatcatccccatggccaacgccaccttcacaccctgcagaatacggccgtattgaccagcaccaaagttttgcgcggtatacgtggccatcgtcacaccaaatgacatcaccaccatgatgatgatttggtcgaccttagaagccgctgtattggcagcaacggcatccgttcccaatgtattcacagcagcagccaacgtgactgacccgatggcaataattgattgttggaagcccattggcacaccggccaacatgtgctgacgcaattcaccctttggcagcttaaaatccgcccaagtcaggtgcaacgtgtcagtataacgactaatgtgccagtgcgaagcggcaatcgacacaaactgcgccatcaccgtcgcaaaggccgctccttcaacgccccaaccaaactttaaaatcaaaatcaattcaaccgtgatattgaaaatcatcccgacaatcaaatagtacagtggcgccttactatcaccaaccgcacgcatcgcgtttgagataatattgtagcccatcgtcgcaatcgtaccagccaagataatcgcaataaacacgcgcgcttcgacaaaaatgtcagcaggtgtttgcatcaagcgcaacagcggattaatgaatgccaagctcaaagctgtcaaaataactgacatgataatcccggcaataatacttgttgcatacgattggcggacaccgttcatatcgtgggccccaaaacgctgggcggtgataatcgacatccccgaactaaacccttgtacaaatcccattaccaaaaactgaatactacccgtcgcacccacggcggccagtgactttacccccagcgtttgtccaacaaccaacgtgtcagagatgttgtataactgttgtaccaaatacccaatcactagcggaatggtaaacatcataatcaactttgctgggttccccttcgtcaaatcttgcatgactacagacatccccctcgttcttttaaccttattaattcatagtatagagactttttgtgtaaagtgtgaaaattcatgaaattagtgcaggtttgtaatgaaaaagagacgtaccgccatagcagtccgtctctttttatcattaattacaatgtaatgttcttttcggcaagttgcttttgcacttctgggtgcgccataaactcgtcgtaagtcgtctcggcacgatcgatggcaccttgatctgaaaccacgataatgtgatccgcaatcgtttgcgcaaacgtgtggtcgtgagacgtgaagatgataccacccttgaagttgattaaaccatcgttcaatgacgtgattgactccaagtccaagtggttcgttgggtcgtccaaaaccaatacgtttggcttcgtcaacatcaacttagacaacataacgcggaccttttctcctccagacaaaacatccaacgtcttttcagcgtcttcacccttgaacaacatacgtcccaacaaaccacgcaagaacgtgttgtcgctttcttccttagaagcaaagtcacgcaagtagtccaagattggcatttctggcttagggaagttaacgttcatgtccttagccaagtaatcgtgagacgtcgtgacaccccaagtaaccgtaccttcatcgggttcgtcgttaccggcgatgatgtccaacaatgccgttgcggcaacgtcgttttcagccatcacaagggccttttcgttaggacgcaccgtgaatgacacgttgtccaacaactttaccccatcaactgtctttgacaagttttcaacgcgcaacatatcgtttccgatttcgcgttgaatttcaaagttgatgtatgggtacttacgcgttgaaggttggatatcatcaagcgtgattttctccaattgcttcttacgtgaagtggcttgctttgactttgaggcgtttgctgagaaacgggcgataaagtcttgcaattccttgatttgctcttccttcttggcattcgcttgtgattgcaaacgttgcgccaattctgaagattccttccagaagtcgtagttaccaacgaacaacttaatcttaccgaagtcaacgtccaaaatcatcgttgaaacggcgttcaagaagtgacggtcgtgggaaacaacgatcacgatgttttggtagtcagccaagaagtcttccaaccaagcaatcgtcttcgtgtccaaaccgttggtaggctcgtcgaggatcaagatgtctgggttaccaaacaacgcttgggccaacaagaccttaaccttggttacttcgggcaagtcagacatcatcatgtagtgttgatcttctgaaattcccaaaccttgcaacaattgggccgcttcagtttcagctgaccaaccatccaattcttcgaaacgagctgacaactcaccaaccttgataccgtcttcatcggtaaatgggtcgtgcgtgtagatttcgtccatttggttcttcacgtcatacaattccttgtgtccttgcataacagtgtccaagaccgtgaatgcgtcataggcaaagtggtcttgcaccaatgatgacatacgttcgttagcctccattgagaccgttccagtcgttggttgcaacttgccttccaagaccttcaagaacgttgacttacctgctccgttggcaccgataacaccgtatgtgttaccaggcgtgaacttcaagttaacgtcatcgtatagcttcttaccagtaaatgatactgatacatttgaaacagttagcatatttgtttacgtttccttttcttcaatttaatgtcattttccattatacagaaaatgtgaacatttttggtggtgggttttccggattagaatttttattggcacattgcaaaatctgccgataatctaaagtatattttagattatcgagattttatccttaatctaaagtatactttagattacagaagttttcgcgttaagttaaagtatattttagttcacaggagccccccatgattgaacgtccaaaacgctagacgaaacggtcaagtaacatacattcaggtaacttatcaaattccggaaaactcaacccgcgaaaccgacaatctccttcacattcgagataattatgagaaactgttgattacacaaaattattttggtaatcctgatatcgacggcatccccgtcatcaatatcatcgactggttggttaacgaaaacgactaaaaataaaggggttcgggacagaaatctctgtctcagacacaaagccaccaatctgccgatttaaaatcggcggattggtggcttttaaacgttttccgacaggccgaacctttactataacgtcatcagcggattcgaagtgcctgtcggctcactctctttaactattcgtgcttatttcttaccaatcaagctgacaaaataaatgccggcttcaataatggcaatgaaaaatgagacgggtaggttcagcgtgtatgacagcacaagtgccacccagaccccaaccacggcaaacaaaatagcgaggccaataatctgccaaacagtccgcccccagcgcattgctgagctggccggtagaatcatcaagatgaaaatcaataacgatccaaccacctgggcagaaaccgccaccgttgtagccatcaaggccaagaacgccacttcaataaagcggatgttcttcaaactaaacaacgccgtgctgtagtcgaaggcaaagtggcgtagcggccgaaacatcgctaacccgattaacaaaaccaagatggctagcacgaccacttcaaccacatccgtccgactgatgctgaaaatcgaaccaaacagaatccccgtcgcagcggtggcgttcttctttgataaggccaggaaagcaatccctagtccaatcgcaatcgcactcactgctgaaattagcgattcggaccgactttctttaacacccatttcaccaacggtcatcgaggccccaaccgaaaataggagcatccccaccaagggcgaccaactcatgtatagcgcaaatgacgcaccagcaaacccaatttcactcaatgtgtgggttaaaaacgacatccgtcgcgcaaccacaaacgtgccaacaaaaccactgacaatggcaatcaacgtccccgccacaaaggcattttgcataaatggataattaagcatgatcttgattacctactttcaattttgtcatatcaagttggtcaatcggaccaaactcactcccatttggcgtcaacaacaaatagtcatccgcatatttaccgatgatatccaagtcgtgactgaccatgatggtcgtcaaatcgtgatggtcacgataatcgcgcaccacgttcattaattcatactttgccacattatccaaattagccgtggcttcgtccagaatgagcacgtttggattttgcaccaacgcttgcgctaaataagcacgttggcgttcaccacctgatgccgtgtcaatccgcgcattcgcgatttttgttaaatgcgtatcggctagcacatgctggagacgttctttttcagttgtcttcaaccagggcaaaatccctttgtcgaaactcaacgatacaaaatcagttactttcagcggaaacgcctgcatatctgggcgatactgcggtacgtagctaatcatgcgggttttagcgtcaatttgccagtctaattcaccggcggttagctctaactggcctaagatggcacgtagtaacgtcgttttacccacaccattatccccaatcagtgcgagcacgcgacctttttcaagtttaaatgcgacatcttggtataaccaccgctccccaaactgaatgcctacccctgaaccagttaaaattgtcattactttaatgcctcgtccaatgctttcaattgcttatattgccactctgcatacgtatcaccctttggtcgtgtttcagtcgcttgcacaaccggcacgtcatgatccttagcatactgcatggcttgtttggctagcttgcccgttgattgtggattgtaaatcaccaccgccaccttgccatcatcaatcgcactattccaagcgcgaatgtccgctggcgtcggatcttggtgttcatcaaccgcctttgagaatgattggttcaagaccgtggcccccaaatcaatcaacgtattatcaaacaccggctccgttgccatcacgtccttgccctttaaatcagccttcacttgcttttgcatggcttgcaagtcggttaagctggccacgtatttatccgcattggcttggaagtaagcttttttacttggttccaactgcgcatatgtcttaaccaactgctttgataggcgctcagccgcatccgtcttgtaccagaagtgttcgttaccgattgtgtcgtcatcatggtcatggtccgtttcatgatcgtgaccgccatcggtatagtgatataacttagctaatgatacagctttggcatctttattttgcttagcaaagttcagactccaattatcaaagccaccaccattcgagatgatgacattggcttgttgatagagcttagcgtctgatgttgtgggctcaaattcgtgtggatccatatctggatcatccatcacactggtcacagaaccttggttacctaaaaccgcctttgcgatttccccataactatctaaactggcgacaactttgattttgccggactgtcgatcagtggcattcttcgtagcggcttgataaatcacgccaccaatcatcgcaacaacggcaacggccgggattgccaatacccagcgacggttctgtttcttcatgtctatttcctccgtgaagtcggttgtctatcaaccaactcacttcctctcaagtcaattaactcgcaatttcaccataattacgcaagcttgaagttaccttaatggcgtcccttcacccctcataattatcagttgtccgtgtctccatgcaaccgatcagcgaccagcgtcaaaaaatggctaatcgccgtttgatcagattcggtaaagaccgcaaagacattttgatattccgctaatgtctcacggtggcgttgggcgtgagctgaggccattgagatgcctagtcccgttaatgaccaacgactcacacgcccatcatcaggatctggaatggcgttgaccattggatcttcttcaccagtcaggcccttcatcgccttcgtaattgcggcaccagacacacccagtgcgcgggctaactctgaattcgtttgcggtccattctgagcaaggagcatcaaaacgtgaccttgcgttgtcgtaatcgctgaatttgactcacctaacaaaatttcgcgttggttttctgccatcacgcggacatcatttaaaaaatgatctaactgttctgcatattcctctgttgccatgtcaccacattcctttaccggttaattaaccagttaagaataacacggacttacttttttgacaacagcaaaaaaacgcctgtatcgctacagacgttttgtttatttcttactattagccattgccttagcaatctcagctgcgtattgtaccgaaccatttggatttgggtggacatgatcgtcacctaaccaatcggcgtgatccttaacagcatcataccaatccacaatgtgcagatttggatactgacttgcttggctagttaggaattggttgtttgtcgcaatccatgaacgatccgcataaccgttaacccagtatacttggcggtcaccgactgtattcatgatttgcttaaagacatcttcaccaattgtgccgttcgtaccaatcgaaatgatgacgttcggcgctaagaccccacgaccagcatatgattgcaagatgcctggcactgagtaggcctgacgaccaaccgccgcatctgcgaccgtgttcggcatcaattcttgcaaatctggcgcgacgtcaaccatgaccgaatcaccaaccgccgtgaccgcgttaccgctaatcttgccaagttggtccttggttagaccgtacttacttaacaaggctgggtcaaccgccttagctgccgccgaactcttcttagctgacttcttcttcgcatttgatgcctttgcagcctcaagtgcacgcttgtttttcgcactaatctctgatgcattggcgtgaagacgcttttggagttgcgtttcagggcgtggctttgctgattgcttagcagccaccgcattaaccgttcccaacaagaatactgctgcgacggtcgccataattttcgcctggcgactggcaaagaagcgcgccttcagcgttacgcctggttgcatagctggcttcttgaaacgacggaaaacattttcgacgtagcgataactcaattccgcaattcccaaaacaaccgcaatcttcaataagttcacgatgaatgaatcattatgatgcgtaaacttgtcgaagaacacaaagactggcaactgatacaaatagatactatatgaacgcgttcctagataattcagcaccttgttatccaaggcgtgactcaggaaggatgccgggtgcgacgtaatcgcaatcaagcccgcaatgactgccgtaaagacaaacatcaagcccatgtatgtcgctgaccattgaccattgagccagaagaacccaataatcgttagcactaaactaccaatccccagcatatccaagttgcgtttcacacgtggtgacaacgtcattttcatgcgatttgaaggccacgtaaacgccaaggccgttccaaacagcaccgcgaaaatacgcgtatctgtcccgtaataagcgcgattgatattggctgggtcatacatgacacccatccaaatcgccgataacgtggcaacaaccaaaattgcaatcgacaccttcgttcgcttaatgcgcaacgccaacacgataaagacaataattggccaaatgaagtagaattgtccttcaattgataatgaccataagtgggtaaatggcgaagcaccaccccatgaatcgaaatatgactcaccgtgcttcgtcgcccaaatgttatatatgtacagcatattgctgctaataattgcgcgtaaattataaagtaaatcgcgtgcgaatagcccaatcatcgtcgccgtggcaaataacatcaccaccaatgctgggtatagtcgtttgattcggcgtcgataaaacccaatcaagtcaattcgtccgttgcgatcatattcttggattaacaaatccgtaattagatacccggataacacaaaaaacaacggcacccctagccaaccaccagttaggcggttaggccaaaggtgaaatacgataaccccaattacagcgatggcgcgtaacccatcaaaacctgtaatataccgtcgctttcctgcagaattttgccccatttttcttctcttcctacattcagttcacttattaaaaccaaattctataataacgtgactatctagctacaagcaagcaatattactggcttttagggtttcctttaggcttgaaactttttacagcagttagacgtcacgttttagttcaccagtgagtcgaatcggagcgccacaagccctacaaacataccgtaattcgttaatccggcgttggcggtaaatttcatgaccatttttgcaggtatacacccataaatgtttcggttgttggcgcgctttagcttttgacgtcgccggcgcatatttcaaaccagcaatccgttgtaactcactttgaaaataacggtccttatgttgataaggtagcccttggatgtggttatggtagtgcaccaactcatgcttaatcacgccaatcaaggtgtcttcgttaaactcttcaatcatcaaggggttaatttccaaattgtgcgtttgtagcacatagcgaccaccggttgtccgcagacgccggttaaaggtcgcttggtgttggaacggccgaccaaaatcagccaccgacaatttttcaacgagttgttgtagttcagcgtttgtcatccccaacgatccccacgataatctttcggtatgcgattcggaatcttcaccgcctgacgctttttcaccttggcagtactaaattgacccaacgtatcagccgttgctgcctcgaggagcgcatcagtttgccaaacgctatcagcgccgtacgccttcgcaaactgcgcttcatagtaacgggcaaagtaattcatcaccgcaatgccagtatcactcacaaccatctgttcaccacgtggcactaacagggcaccgtgctgtaactgcaacgcgacattaacttgctcagccgacacaccgtcgtgctgatctcctttggcaacaagccaatgcttaccgtgcttctcaagcgtttgcgtcagaccaggttgtgaccaccaacgtaaccaggtgtacatttcaaacgtaaatggcacgaatgattgaccagccaccactttgcgtacccaatcaccgacttcagtagcttgttgtaggaaccgcatttgaataacgggtagtttttgccaatttggccctaaatgatgcgcaatacggagggtctggtaggccggcttttcatgctgcacaaaactcacatacacactccccgactgccgggcagattgcacgctcaccaaatcgacatccggttccgttacccgggccgcattttgctggataaattgttgccaaatccgccgactggccacttcttgatggtcgagaaagtcgatttgaaccttttgatccgctttcgggtgggtatagggttgataaatgtccgcccgcgtatccgtcacatcgacccgaatggcgtaacctgcatcattattacgaccaactcgcacacgcggtggtcggattttcttataggcagcgactttcttagccatcaagagctcctttactaaaattgattcaaaatatgttcattaaaattggcatcacgaagccaactcgttaagaattggtcgcgattacgcagatataacttaccgaattcgtcaatcagcgcatgaaactcacgcgcttcatctggtgtgaaatcagaattattcatcacgactttttggaccttttcataagtcaacttctcagggcctcccaagaagttcattaaccggcgtgaataggaatccgcaataaattgcgcgcgcccaaatatgtataccagccacacatccgccgtctcgttaccaatcccgttcaccgcgcgaatgcgtttgcgtagttcagccgtttccaacgcttgcaatggcgccaagtcaaaatcatattgaccaaagaattctaatgatgctcgcaaatactttgccttgctacgataaaggcccgcttcaaaaatgagttgttccaattcttcttgtgataagccaatcaggacttgtggatcaaagccggtttcacgtccaaccttctcaatgactggatcaacggtcttggctgacgcattttgaattaaaatactgccgacaatcgtttccatccagcgttcagccggccaccagcgttggggtcccatttgattatagagttgctcatacaacccccgtacatctaacgtcttcattgtctcaatctcgctttaatctcaataataaaaggctagagtaaaccctaaccttttgttgctatctattatagttcatcattctcatcaactggcatttcggtgtcaccagctgggcgacgcgcaccataacgtcgttcgcggaccacttccatgtagaactccgccatcgtcgcattgtaatacggaatcacgtagattgcggcgattccaaaggtcaatgccaccaaaatccaccaaccgataaagctcaactgtagccagaaaaaacgtcccttgtagccttgcatcaagtcttgtgagcgtgtcaaatattctgacaagctcgtgattttagcaccatttttaacgtcttctgcgaaaatcaagcccgcttgcgagtatgcaaatgacttaataatccccggcacaatcaacaagaaggtccacaataccgtgaacaagaaacgtaggccatacaatacaaccacatcaaccaatgtctcacggccccagaacttcaaactcgcttgtacggggttcgctggcgcttcttgtgaacgacgccattcaacaaaggcccacaccgtgcctagcccaaagacaccaaagatgatttcactcaccatgcttgttgtgaacatcccgaacaaatactgaaccgactcaccaaagcccaaagaacttggatctggtgtgcgttggccatcccagtacgttgagacaatttgccacaaaatcaaaatcaatgatattttcagcgaaatgccaaaggccggtcctttaacacgcgaccgcgcgcgcatcttcaaatcataattgcttagcatacccatatccttatctatatccctttactctagctattagtttaacatactcgacttagcggggatttacggttagttaacaaaaaagacggcgtgcattactgcacaccgccttcagtagctgggatagctggattcgaaccagcgatacacggtaccaaaaaccgatgccttaccacttggccatatcccaatcatttttcaacgaatattataataacgctgcttacttttcgtgtcaacaatttttgacagacgttttaacggcaacaaaaaagccggcaagcgtactcgctcaccgactttcatcagctgggatagctggattcgaaccagcgatacacggtaccaaaaaccgatgccttaccacttggccatatcccaatgatgcgatgggggctataggattcgaacctatgaacccgaaggaatggatttacagtccaccgcgtttgaccagacttcgctaaacccccgcaacaacaagatatatattaccaagtatcacacaagttggcaaccccttttttgaaattaaatcatcttattcacgaaatgcgattaattcatgaaaaaaagagaccggaaatcacttcccggcccctattatatacctgctaatcttctgtccaacccttagcgtgagcccgtgaacgtaagcttgcttcaatttgttcaagtgattggttgcgagtttcaatcgtgtacttgcggacaaaccaaatggccacaaatgacaataccgcataaccaatgaatagcgaaccagtaccaaatgcattcaacaatggtgggaacgtcaatgaaacaatcgtattcgctgtccagttcacaacagagccgaacgagttacccaaaccacgaatgttcaatgggaatgactcaccaatcatcacccacataactggtccccaagttgctgagaaaaatgcgatgtaaatcgtcaaggcaaacgcagcaatgtatgatgccacatgtgagtgaccggaaaacttcatcgcaattgacatgaccatcaacgtaattcccatgccccaggcaccggcaatcaacatcgtcttacggtcaatcttatccatcactttcatggcaacccaagtcacaatcacgttaaagataccaatcccgatgtgagccatcaacgcggcgctgacaccaaaaccaacatcagtgaaaatagttggtgcatagtacagcactgtattagcgcccatgacttgttggaaaattgccaagcccatggccatgattagcacgggacgtgacataaccccaaagagttccttaaacccagcgctcttcattgaagcttgcaacttaatatcatccaattcagcttgtgcttgttgatcattgctttgcaactgcttcagcacagccaatgcttcctgatcatccccttggcgtaccaagtaacgtggtgattcaggcagtgcaaccccaccgaagaacataattgccgctggcacggcagccaagcctagcatgaagcgccaacccaaatcaaagtctgacaaaacataatttgaaatgtaagccagtaaaattccactcataatcatcaattggaacatcgtcccaatcccaccacgcttttcagccggtgctaattctgatagatacgttggaattaaggccgatgcaccaccaaccgcaataccaagcacaattcgtgaaatgaccaagagttcaaaattgtgtgctaatccagaaccaatcgccccaatgacgaagataatcgatgacaacatcaataacttgcggcggccaaatttatctgacgcaggtccaatggttgctgatcctaaaatcgccccaattagcacggccgaaacaacccagccctgctcccaagaacctaaatgcaactgcttttgaatgaataggatggctcctgagataacacccgtatcataaccaaacagtagtccacccagtgccccaaaaaagtaaatcaagctggtcgacatacgcttcttctcgttcattgtcttttccccctaagacagtcgtttaacatcagttggtttatctctccaactaaccatgaacatatgatagcgcttacaattagtaaatacaagtgttttgttacttttagttagttacgcatgcgaaaaaagtgctcatctaggtcattatttcccaaattacggaaaaagaccaggttaccctagtctttttctgaaatttattacgctgctagcaagctcttagccaagtagaagcagccaagaactcccgcattatcaccgtttcccacggtaacaatgtacttatccaaatcatcaactggcaagtaatcagctaattgttctgcaaacgccttgcgcaccattggcaacaagacttcacggtgtggcacaccaccaccgaaaacaatgcggtctgggcgcaacgtgacggtgtatgtcacggctgcttgggccaagtagtaagcctcgatttcccaagccaagtgatcatctggcaatgacttagctgattcgtgccaacgatcttcaatcgctgggccggcagccaaaccttctaagcaggcatccccgtggaatgggcagtgccctgcatagttatcttgtgggtgcttacgcatcataatgtgcccagcttcagggtgtgagttaccactcaacaagtgaccgtgttggataataccagcacccaccccagttccaactgtcagatataccacgttttcaacgtctgcggccgccccagaaacgtattctgaccaacccgcaccgttcacatctgtcgtccagaagtaagggatgtcacgccaagccttcatggcacccaagaaatcataacctgaccaaccacgcttaggcgtatccaacacataaccataggtgcgactgtctgggttaatatcaattggtccaaaggccgcaatcccaattgccgcaatatcctcgtattgatcaaagaatgcgataacttgcgccagggttcccgcaccatctagggttggaaaactctcacgtgcaatgaccgtatccggatcattgacgtccgcaaccgcaacaacaaacttcgtaccacctgcttcaatagcccccaaaagtgacatgatttattcctcctataacactgacaactttgaaatcaaaattgcccccacaattaccaataccgttccaagcaaaatataacccatttgacgcttcgtcttatgctcaccaagaataaagatggccccaaaggttccaacaataattccggtttgtgacaatgtcgtcgccgttgcttgaccaacgtctggatttccagttgagatgaacataaagacatttcccaatgcccataccaaaccagtaataacttgacgtgccgttccagacttcatgatgttgtttgtttccttaaagtagaacgccacaatcaacaaagcccctagaatttgaccaactgattgtggtgccacaatcgctgtcatatagtccaatccattattttggttgtgaacggcatctgagatgtaaccccacttgttaagcaagttaggcaacacaaagtacatcataaaggctagtgttgaaacgataaccgctgaaacaccacccttgaagtcacgctctgggtttgtttctgccggcgcgttcttatcgcgaacggtcgtcaacaaagcaccacctgttaccagcgcaattgacaagaccccgaagaaccacatccgtcccgtgtgccattcaccaagcacagccgcggccatcaaagcgttaccaacgatttgcccggatgtcgaaagcggatttccaatcgacacccctagtttcttaaatccaatcagttggccaacctgaccaaccgcccaaatcaaacctgaaataaatccaacaatccaaatccgtgaattaaatgcataatccatcccggcattcggaataacgaagaaggccaaggtaccaaaaccaagtatgatggcaccaatggtcatccccataattccttgcgccgcagttccaccagctttagtcgtaacgattccaacagaaccccacgctaatgccggcactaatgcgattaaaattgacataatagctcccctaatcaaaaaatttgccactcaacacctactacgctacctgtttgaaaccgcttacacaattaacgttttttaatttcccgtcattttttagataatttagtcaaaaaacacccgatttctgtaagcaaacagacaatcgggtgtttaaaaattaattgtatttaattaagcatttttacggtcacgcataaagagtgcggcaccgattgcaccaataaagactgtaattgctgcggtaacgcccacagcaatcatgcccttatcataagcatgtagcacgacttgttggaagtcgtgcgcgaacggtgccttagtcagacgatcgctaaaggcaaccgcgtggccagaaaatggcccagcttcaaccaaggccttgtgcaagccagtcgctgccgcttcaggcatcttgaccgttccgaggtgcgcattcaagtagtcttcatagtgattcgtctgggtcaaaccaagcatcacgacaccgaatgatacaccgaattggcggaaaacattaagcaatccagctgccatccccatttcatatggcgcaacgccttcaagaccggccgtattcaacattgggttaacgattgcattcgtcaatcccatcaagaccattgctggtaccaattgaataaacgttagcttcgtcgtcatggcgttggccagcaacaagaagccaattccaccaagcaacaaagcgcctgaaatcatccacttctttgagaacttgttacccaagataccggttaccggtcccaaaatcagtgaccaaattgaaatcactagttggcgcaaaccagtttggaatgccgtgtagcccatgtaattttgcatcaaccccgttagataggcgttgatggcatacacaccagcgcccaacgtgaaggcaacgattacggcacccacaaagttaacactcttaaacatcttcaagttcatcattggcgtcttcacacgcaactcaaccaacacgaagataattgccaagacgatacctgcaatcagccaaccggcgatacgggtgtcagtccacgcccagtgcacgtggctttccttttgaatcaagccatacacagctgagaataaagcagccgctgacaagatcatgcccacgaaatcaatcttttgacccttaccatagcttggcgtttctttaacgttaatccacgtcatgataaccgcgatgataccaacgggcacattaatatagaagattgatggccaaccaaaggcttcaaccaggtaaccacccaccaaggggcctgacgccgtcgacaaaccaatgacagaacctaggattcctagcgccgtaccgcgctcgcggccttcaaagtttgaagcgaccaatgccattgccaatgacatcaagcctgagcctccaatcgcttggaccccgcgcccaatgtcgagcaccgttagcgacgttgccatcccgttaaccgctgaggcaataacgaaaacgaacatgctggcgataaatatcttcttacgaccaaacatgtcaccaagcttcgacacaatcagcaacatgaccgcaaacacgatcgtatacgcatttagaacccattgcagattgttaaacgttgtcttaaaatcaaccgccattgttggcaatgccacgttcacaaccgtgacatccaacaaggccataaagacgcccaaagacatggctgccaaagctaaccacttcttgtatgacttctcttctgtcattctcttccacctaattcctatttttttcgacaagaattgattataggcgctttcacttacttttccaacagaaaaagagcagctgatggaaaatcatcaactgctcttttcgtttactatttaacaccggccatcaagcgcttgatacgtggtaccaagaataccaagaccacaccaagcacaactgaggcgattccgaaccaagcgaagtaagccacttcgttcttagggttatataacgttaccaactgggcgttcaacgctgaaccagctgatgaagccaagaaccacattgacatcatttgtgacatgaatgccttaggcgctagcttcgttgtaactgacaaaccaactggtgaaatcaacatttcaccgatgataaccaaggcccatgagccaaccaaccaaagcggcgacaccttaccagccgtaccaaacattgcaccaggcaaggccatcaacaagaatgacgcaccggcgaacatcaaaccaatcgcaaacttcattggtgaagatggttggttcttttgccacttaacccacaaccaggcaaagaatggcgtgtatagcatgatgaacaatgggttcaatgattggaaccatgacgctgggaaccatgacgtatcaacacgttcggcagcaaaagttgccaaaacgattgatccttgttcttcaatggcccagaacaacacagctgccaagaacaatggaatgtatgagacaacgcgtgaacgctcttccttgttaaccttagctgacgtaatcatcaacgtgaagtaaccgattggcagcaagatagcgacaatcgtcaacaagttaacgaagttttgcaagctcgtccagcccatcaaaaccatcaacaagacaaccaacgcaaaggcaatgacaccaaggacaatcttcgtgaccaaaggcttcacttcttgcggttgcaatgggtctggggcgtacattgaatcttcgtgcaagtgcttgccaccaaagtggaattgcaacaaaccgaagaacataccgatagcggccaatgagaaggcgacgtggaagccggcctgttcttgcgtccaaccaactaacaatggggcaataaatgaacccaagttgattccgaagacgaagattgagaacccagcatcacgggctgaatcaccatctttataaagtgacccaaccaatgatgaaacgttaggcttcaacaaaccagttcccaacacaatcaagatcattgaggcgaacatggccggtgccccgaatggcaatgacaaggcgatgtggccaaacatgatcaaaacaccaccccagaagaccgtgcgacgttgacctagcaaacggtcagcgatgaaaccaccgacaacacctgataggtaaaccattgacgcgtagatggccatgattgacgctgccgttgccttcgtgacgttcaaatcacctgtcgcaatcaaatgccacatgtagtaaagcaaaatggccttcataccgtagtaactgaaacgttcccacatttcggtcataaacaatgtttgtagaccgcgtggttgtcccaggaatttcttttctgattccatagaaaagctccttacgaatttatatttatttgttttaacataactaattcattagaaaatacttattaagtttacttgaatttcttcatttccacaagaaggtatcagaaattgattttactttttcctacaaggatagtttcgcgtttggtacaatgaattgatatatcaggaaagaaaggcgatatcatggttaaaatcgctgttacaagtgacaatcacttggacataaataagcaagaacccgccgaaattttagcgaaacaaacacaaaaaattctagaaatgaacgttaattattacctaattgctggtgacctttttaacgattttaagaaatcaatggcatatgtgagtgatttgcaagaaaacctgggtgaccagaccaaagtcttgtttattgctggtaatcacgacatggggcgtggcacagattttgctgagctcgaatcacccgtgaatgacttttaccttcataataagtacgtcgacattcccggcacagattggcggattatcggccacaatggttggtatgattacctatttgcccggggcattgacccagcagatgttgccgccttccgccgtggtttttactacgaccggattattgaacaaccaatgaccgatccggagcgcatggatttagggttggcccaaatgaaggtgctcctcgatgacgcacaagctgccggtaagcaagtcattttcatgacccactttgccccaattggggatgaattaattttcccaatcggcgatcgacgctgggcaactgtgaacggcgtcttagggtcaccacgcactggcgaactactcgaaagttatgataatgtgcgtcatgtcttttacggccacattcacgttaccgtaccgccacgtaaaaaaaatggggttacttactacaaccccagcgttggttataaccgtcggcgcttgcaagaatggacggctgataacttctttgatgcttggcaaaacaaagttcaagaaatagtgttgacatctaaataaatattctgtatagtatatattcgttgaggcgatacatatcgctaaagcgtttatatgatgggggtttagcgaagtctggtcaaacgcggtggactgtaaatccattccttcgggttcataggttcgaatcctatagcccccatttattattgggatatggccaagtggtaaggcatcggtttttggtaccgtgtatcgctggttcgaatccagctatcccagctaacgaagtcgatgagcatttgcttgtcggcttttttgttatattttttcagtctacagcttgattaatgcggttaatttcatatttgtcctgtttttcgcactatttttcctgtacaatggtaagcgttctatcttcaaggaggtcacatgaaacttaagtggactgtcatcaccctaatcgcccttgctgcgactgcagccgggatctactggggtgttgatgcattcaatgaaaacaaaagctatcaaggcaatatgcgcaatgcgcgtaatgccgtcgcggcccacaactggtcagatgccgctatctactactctgcggcccgtggcattcgcgtttccgtcgaaaaccgcaccgcccttgagcaacttaactaccttaagcgtgcggacaaagaaatccgccacaacaattggcaatcagcgttaaacctgtatagcctggtgttggcaacgaacggcggtgttgatttgttaaacaaggccgccaaaagtggtgaggattacgtgacggcactcaagaacgccgacgaatcagcggacaaggcttcttcgctacaagttgcgcttgataagaagtcatccgaactaactaaggcgcgttcttctgcagaagcagctgttaaaacggcgaatgatgcagctaaggccgcacaggactctgctaagagcgccgtagatgccgcaaatgataatgcaaccgatttatcgaaggcgctgtcctcacaacaagctgctgacaaagcagccgctaaaagtgaagctgccgatactaagacatcaaaagtcgataatcataagaaagataaagcaaactaataaattaaatagccgcaggatcatttaacatcatgatcctgcggctattctcatataatcaactattaaaatgacgctttcatttttgcagcagtggcaactgaataaatcgcaatcagcaccccaaccatcaacattacggccgcaccgatattgccaacaaagtgcgaggctgacaccatcaccccggcgacaatatttcccagcggccgtgtcgcagcaaatgcgcctgagtaagccccgagcttctcagggttcatcatatccgcacgcaacgtctgacttgatggcacattaatcatctcaccaaccgtgaagacaaccgccgtaaaggccagtggccaaaagtcgcggagcaagaaggccatggcaaaaccgagcccttgcaagaacgtcccaatcatataaccgcggattagcggccagcgatttgtcatatgattaaatgctgacatcgttaagacgattaagaccgtattaattaccagcataaatgacagcatccgttggccataaaaatgaatgccaaacagcgtgtagtcgcggaacgactctgccaagtgcgctgccaaatagaaatctggttgtgaataaacaacgaccgagaaaatcgttccgaacatgaatagcaagtaacgcttatccgtcagcacatgcccgtatgacttgatagcactccagactgacgaattcgtcttaacggttgtcatatccagcgtttccgacatcccccacttgataatcgccgcattgataacgccgacaatcattgagcccattaacaattcaaagaggtaatcacggaagaaccaaccaccaacggccgccccaatcatcacaccaatgttaatgatccagtaaatcaacgcaaagacaaacttacgatttttcaatgttgacgagtcaatcatcatcgcttgttcggccggatcagcgaatgacgccccgactgaagcagtcaggaacccaacgaacgtgatgtacgggttggtataccacggcgaattcatgagcatggccagcgcatagccgccaataatcatggccgatccaatcaagatggtctttttacgccccaacacatcggccaagtgaccaccatacaagccggcaataaaaccggccactgagacggcaatcaacaaaaagccggtaatgaaggccccaaaatattcaacgtaataaaccgttacattcggtccaattgaactacccagtaagactgttagaaaaacagttaatgatcgtagcttcaaattacgatccaactgcatgaaatcttgcaactttccgccctcctttttctgtcataatctaattagcataacacaaagaaaccgctgttcatacacaaaacagcggttatattaaaattcaattagatacaattacttcacgtaagcatgtgatatcaattggctatcaatctcatcagttggaatcgtcatcgcaaccgcaccaacatacatcggtgcaatttcaccgcgctggaaaaccaatactagttcacccttattattaatatagaacgtctgcttaggtccaatcgctgcgaccggtgtgtcatactgcttcgacgctgcgatttgttcattgacataatttttcaaaattgcctgataggcgttcgccttaaatagcattggcagtgtcacgaccagcccgttttgcttatcaattgttgtgtaacgcagcttcgtagcggtatcggccgacgagatatcctgacgacgttccagtacaagcagctgctcgttgtttaccttttcagcataggtttgtgtcatcgacttgggcgtatcattggtcttattcatgaaggactcgtataatgcgcgaccctcttctgcataggccgtatttaacttatcagataattgccggtcacgtaggttcgtcaacaaaggcaccttaatatccgcatacgacgtcttgtcgacatgcttgtactcgcggaacaataaaactttcacggcatcacgcacaactggcacccgttctgatgcattcgcgaatgaatacgatgtgttaagcgccagcgtaaaagctgctgctacagcaccgacaccaatcactgatgattgccaccagttcaagagcttgcgctttggttcagttgctacaatcgcttgattgataacagccgtcaacttttcagttggaatatcctgttgtgtatactgcatcttcaaatctgctaaagtcatgttaaattcccccgtccatcaaggcttccaatttcttcagactgcgataatacgttgttttgaccgtattttctgacaactgcaatgtcagcgcaatttccccaaaggtttgatcttcaaaaaaatgcaaccgaataatcgcctgttctttatcagacaaatcactcaccgcttgttcaagtgccaagcgggtttctggtgcaactcccgccaaagctggcataaacgttaagacatcatcaccaatttcatgacggcgggcttgtttacgttgtgcatcgatggctgtattaatcaaaattcgaaacaaccaggttttgagatattgtttttctttcacctgtcccacctgacgtaacgctttttcagcactgatttgcacgatatccagcgcctctgcttccgtgtgaacgtagcttaacgcaacgcggtacaacgctgtttgattttctttcagcgttgcgattaattcttcacgcatgttacgttccccctaactttcaacacttattagacgctgtgatgtatggaatagtttcaaaacactataaatactaaaataaataaaaaagtcgctgataatatctaccagcgaccttttcatgttatatgtattggcgctctaaacccgcaccacgaggctaattaaaatatagcaacaataggtatccttgtcaaatacaatgtcattgcctaaataacgacttagtttgcttttgctcctccttttgcttaagaaacagcaccttttctggtttttctataactccctcagattgaacacggccattcaaaatattcagattagacattacctgatccgataaaatcttttgcttatccttttctttgttatacgcaaagttcataattacaaaatatgccgtcacaaaaggaaagaaatattttacagtgtaatgatcattgaaccaagcaaccacaccttgatagtcgtttgtacaaaaacgaaaatatacataaatgccggtcaaaatcacaagcataaacagcacagacttaaaatactcaccctcagccttcatcttccagaccttatttaatcgcattttatacgcacatttaaagatacgtcccctggtatatctaattaagattggtaatgtgaatacaatcaacattaacgtggaaataataaagtacacttttttctccctgtaaaaatatttttagtataagtatattttaccaataaaaaaacacgccgttaagcgtgttttttattactcagcgtcgccgttagcttcttcttccgcaacagctgcttcttatgccaagacgcgtgctgacacgtccatgacgatattatcttcatcacggattgagacaatcaatcccttgcccaaccatgagtggtcaccagagtaaggcatttccatttcttgttggaaatcaccgtcgtgttggacgaacatcacacccacgatactatctgtgtagtcatccgcaaaccaaatctcaacttcagggaacatgatggccttgtagttcatcattgtatcaaacattccccaaactgcagtctgcgcttcctcaggtagtcgcttagcaagttcttcagtaacaacgcgtgacttagtagattcaaacattatatatagttcctcactctagatgtggtaaaattaattcatataaagtataccacggaaggacaatctgccaaatgaacgaatatctatcatggcgcgaaggcctaaaggaagtcgaattcccacactgggaggacttgccaacatttgacttgtatatggaccaggtcgttgaatatgtaaatgaagtcctggcacctttaaacatgccggctgtcacgtcaacgatgattaacaattacgttaagcaaaaggtcatcttggcacccgttaaaaagaagtaccaaacgatgcaaatcgcggatatcttaattatttcattgatgaagcccgtcttctcactggaagaaatccgtgcagccatcgatcaagtaacgattggcgattaccctaagaaggcgtacaacgcgttcgttgatgcgttgatggctcgtttacaaggtcctgtgccagttgaattcgatcctgacaacattgatctccagctaatgcgtgacgctgccaacgtcgtcttccacaaaatggaagctgagaagctattggccatcatgcgtgaacgcaacccgattaaggaagtgcctactaagaagtagtcttctggttttgcgagttgttttgcggggtcgtcgcgttgcgacgaggcatgggtgtggggaagcggctccgacaaagattgcatccggacaactccgccggcgcgagcaccggctagcacccaaataattgtgctaagggtcagggtccgtatcgccttatctaaccggcggtcggctgaacttgtgagttaccctgctacaatcgctacgccacttccccacccccatgccagcagccaagatagtctctatttgtttgattatcatggattaggggtgcacgtccattcatgtttccccttctcaacactttgatagtcaaagccaacagagaacaacttaattgctgcaacagcacgacatatgttaaccaaattcaaaaagcacaacacctgcattaggcgttgtgcttttttggtatttattcaaatagactcatgatgacgcgcttcgcatcgcggtaccattgtacaacttgtgatgcttgtgcaacatcgcgggtcatgatcaaatctaccttaggcggacttgctaaatagtcattcgctgcgttacgttcggctgttgtgcccccatcaacgaaaaccgtttcttggtgatcaacaacgtgcccctttgcaattggcgcaatcatatcgttatttgaccgaatcgtcatgttgagtttgccgtcacgtaatgcggttggcacgaacattgaaaccgccgtcttcgtagcgattgggaaacgttcttccccggcacgcgcttcttcaacttgcacccgttgaataaccgttcccttagccaaggtcttaactgtcatcgccgacttgaccgcatttaacatggccaccgtttgggagaacgtgtggtcactaccgagcactacggtcaccacttggcgaccttccaaggttgttaacccgatgaacgtactgtggactgacaaggcatacccagttttcaaaccggtaaacttatatccttggccatcagccagcaatttatctgagttttcaatcgtttcagtcccggtagccccacttgggacctccgctgtttgcatactcgtaatttgttggatttcagggtaatcagtcaccaaatgacgaccaacaatcgctaattcacgggctgatagttcattttccacatccgcacccagcttaggattcgttaacgcccccatatcaccgttcgtcaaaccagcaccagatacaatggtcgtatccttgatgccccagctggttagcaaatcttgaatttgttggttaacacccgtatccgtaccagacacggcatagcccaacgctaacgccgctgcattcgctgatttaatcaacgccatttccatcaactcttgaatggtataggcacggtccgtactaagtggcacattagccaaagctggctcgttactaatggcgacaatcgaagctggcactttaatctgtgactgcatcgacagacgcccctctttaatggcttgttcaaccaaataaaccgtcaataattttgaaattgaggcaatcggcatccgctcgttaccatttttatctgctaacacctggccagtctgcacatcggccaccactgcactttgcgcgtccactttgggcgtcaccgttgcagctgatgctgacgtagcaatccctgtcactaacaggattcccgccagtaagcctgcccacacacgctttgtcatatctcttaggcctcatttcctagttctggttgtaaaggcaactggacaataaagctcgtcaaatcatcatctgattcaactcgcaccgtccccccatgcgcctcgacaaccccattcacgattgctaaaccaaggccggtcccacccgtcttagtattccgtgaactttccacccgatagaagcgatcaaacaaccgcttgattgaatcggctggaattttttcaccgttattttgcacgcgaacttctacataattttcgcttttgttagtcttggctgtcaaccgcacaaatgttgcgccatcgccatacttcaaagcgttattgatcaaattcataaagacacgtgccaaacggtcaggatcaccaaccatttcaatcgtatccggattggtaaccgctgagacaacaacgtgcttattcttagcttctaactcatagttaaccgccaattgttgcaacatggccgctaaatctaacggcgcccagcgtaacttgaaatcaacttggtggacctgtgtgtaatcaaacaaatcttcgaccaacgatttcatttggcccgccttcgaaaaggccgtgttggcatatttcaccaaatccttgcgtgctaacttttcatcttcatcattaataatcaggcctaagtaacccaaaattgatgttaatggtgtccgcaaatcgtgcgacacattcgtaatcatttcgtcctttgaacgctcaatttcacgttcttcagccattgcagcttgtgcggcatcaaaaacgccattcacattcgttacgaggggccgcaatcgacgtccccaacgcttttccggcaatccttcactttctgtatcacgaacacgtggtgccaaatcactcaccgcttcgattaagcggttaagcaatactgcttcgtagaaatggcgaatcaacaacagccacaacacaacgaccactaagccaacgataatgacaagtggttgctgttgcgcccaagctgcttgtaattcaagcagccagttggcacttgtccaggctgaacgggtgactaagatgcccccaatgcccataaatacaaaaagcagggccgaaacgactgccttgaccacccacaggagccaatccagtacacttagtttcatccctacttctcactttctattgcatagatgcaaatctataccttacaaaacttcaatcttgtaaccaacaccccaaacggtttggaccacttggttaccaccagttgctgcttccaacttatcgcgcaagtgtgaaacgtgcaccataactgtcttagcagacacaactgattcttgttgccaaacgcgttcaaaaatatcgtcagcactgaacacacgatttgggtgtgaagccaacaagtacaagataccgaactccaacgccgtcaagttaacctcaacaccgtcagccgtcttaacttcgtggctatccttgttaatcgtcaaaggtccaatgtccaagacttctggcgttgcttgtgccataccgttttgggcacgacgcaacaacgcacggacgcgggccatcacttcaagcggattgaatggcttcgttacgtagtcatccgcacccgtaatcaacccttgaatcttgtccatcgcacctgacttagcagacaacatcaagattggcacggggttgtccttacgaacttccttcaacacttccgtaccgttcatatcaggcatcatgatatccaaaataatcaaaccaatatcagggttcgtgcgaatctttgtcatcgcttccctaccatcactggcaatcactggctcgtaaccttcgttcttcacgtagatttcaagcaattcagcaatttcgtgatcatcgtcaacaatcaaaatcttcatggctaatccctcactgatttctgtgcttacttcgtgtcttgacgtggacgtgttgcactacccaagaatccaccttgaatacccgtcttaacgcgccagaagcggaagccgatgaaggccaataccgcaaggatcaagtagacccaacctggcaacaatgggttgatgattgatggcaagtaggcgaagcccatgtatgccaagaaccaaaggacaaacgcaccaacagaaaccacaatcttcttccaaagtggtgtctgtacgccatccttgcttggtgcaagggtcatcgttacggcggcgaagaagacaccacccaacaatgacgtcaaaacaagtgatgtgataccggctgccccagcactaccggcttggttagccttgctgaacatcaacgtcaagccaaacataaagctaaacatcataaagaaggcaatggcattatcaaccatcaatggccagaagccgtacgtggcataaccacgggcaggcgtttcagccgcttgctttgccttgaagcccaatgcttcagctggcgtgttaaacaattgcttcgctgtggcacccgtcttttgaccgtccaacaactttgccccaacttcggcaatcaaaccggcctttgatgcatccccatcaacgagttgcaccatttgccaaataaattcttgattacgcttcgtcaaaccagatgttgccaaatcggcacgcgttggcaacgctggttgagcttgcgtttcttgtgattctgtcatgtagtcccccaattaaacgttgaacaagaattcgatgatatcaccgtcttgtacaacgtattccttaccttctgaacggcgacggccagcttccttaacggccttcattgaaccatattcgtccaagtcagcaaaagcgaccgtttcagcacggataaagccacgctcaaagtcagagtgaataactccggcaacttgtggtgccttcatgccggcacggaacgtccaagcacgcgtctccttaccaccagcggtaaagaacgtccgcaagtccaacaagtggtaggctgaacgaatcaaacggttcaaacctggttccgtaatgccttgcaattccatcaattcagccttatcttcatcatccatgccggccaactcttcttcagcacgggctgaaataccgatgacatcagcattttcagcagccgcaaattccttgatttgttggaagtactttgatgattctggatcagccatatcatcttccgccacgtttgctacgtacaagacgggctttgacgtcaacaagaacaagccacgtacaatcttttgctcgtcttcgttccagtcgattgaacgggctggcttaccctcttccaaaacaggcttcaacttagccaagacctcaaattctgccgcagcatccttatccttagcttgcttagccttcttttcaaccgtcgcataacgcttatcaacagattccaaatctgccaaaatcaattccaagttaatggtgttgatatcgtcgattgggtcaaccttaccgctaacgtgagtaatgtcatcatcatcgaacgcacgaaccacgtgaacaatggcgttcacttggcggatgttctccaagaacttgttacccaaaccttcaccctttgaggcacccttaacgattccggcaatgtcagtaaattcaaaggtcgttggtacgatcttgtcagctggcaccaattcttggatacgagccaaacgatcatcaggcacttcgaccattcccacgtttggttcaatcgtggcgaatgggtaattagccatttcggcacctgccttggtgattgcgttaaacaaagttgacttaccaacgtttggcaaaccaacgattcctgctgtaagagccatttttatatacctatctctctaaattaatcttgttgttctgacgccttgcgcaaaatacgcttcaagcgcttatcaaagtcgtggcgtgtcatcatgacttggtgaccgcagccttggcacgtcaacttaatgtccgcaccaacgcgcataatttcccactcatttgcgccacacgcgtgtggcttcttcatttcaacgatatcatgcaagttgtacatttatccaacccccacttagtcctcatcgaatgaaatgcccaatacatcaaagatgcggttcaaatcatcatctgacaagtatgcaatttcaattttaccagcgcccttgcgattacgcgtcacattgaccttggtaccaaacttatcttccagggcagcggtcgtcgccttcaagtatgctgatggttcatcagcgcccttgctggttggatctgactgctcattcaacttattaaccagttgctccagttgacgcacggtcatgccttctgcgatggcgcgcttggccaccggcacaatacgacgcttgttacgcaaaccaagcaacgtccgggcttgccccattgaaagttcccctgcattcaggaggtccttcacttcatcaggcaagttcaacaaacgaaggaaattggccacggctgagcgggcctttcccaaacgcttggccacttgttcttgcgttaacttcaacgcatccatcatatcgcggtacgcttgggcctcttcaaggggcgtcaagtcttcacgttgcaagttttccaaaatggccgcttgcaacatctgatcgtcatctaacttgcgcacaatcgctggcacttcagtcataccggccaattgtgacgcacgccaacgacgttcacccgctaacaattcgtattgggcattgtcttttggattgtggcggacaattaccggttgcaacacgccgttttccttgattgaagccgccaaatcttgcagagcgtcttgatcaaaaacatgtcgcggttggaacggatttgccacaattttatcaacagctaggtcacgaacagagtcgttcgttgcgatggttgtatcaagaccttgtgaatcaaacagggcgcctagaccgccaccgttaccaccaaggcctcccaaacctgacttcttagcgttcgccatgagcagccaagacctcctttgccaagtccatgtatacttcagaaccctttgacttagggtcgtaatcaataatagctaacccgcgtgatggcgcctctgatagacggacattacgtggaatcacggtatcgtacacatcactgccaaagtactcacgcacattcgcaataacatcggccgacaagttcgttcgtgggtcaaccatggtcatcagcaccccttcaacttccaaatctgggttgaagtgttgcttgaccaacttcatattgttcatcaactggccaagtccttcgagcgcataatactcagcttgcacaggaatcaaaattgaatccgctgctgagaatgtgttgattgttaccaatccaagtgaaggtggattatcaatcagcacgtagtcatacttttcacgaacacctgacagcgcgtttttcaaacgtaattcacgggccatcgccggagccaattctagttcggcaccagccaaacgaatcgttgctggcacgatgtccatgccttcgtgcgaagttgacaaaataacatcagccaatggcacatcgtgaaccaagacatcatagacatctcgctcaatgcttgacttttggacgcctgatccagacgttgcgtttccttgggcatccgtgtcgataatcaacaccgacttacccaaactcgccaaggccgctcccaaattgaccgtggtcgtcgttttaccaacaccacctttttggttagctaatgcaataacgtgtcccattgatttccccttcctacaacggcttacgaaccggatcacccggcttgcgtggatacttctttggtgtatttttcaccttttcaatcacaataactgaacgtgggtcaccgtttggcaagctcacatcgatttgatcaccaattttggcacccaatgtcgtgatagccttcttagcctcttgcaactcctcatcagcggcactacccttcatggccagcagaacaccaccaaccttaacgaatggcaatgtcaattcgcccaaaatatttaggcgcgccaacgcacgggctgtcgccacatcatattgctcacgagctggtgcgttcttgttaccaaactcttcggcacgggcgtgttctaccgtgacaccttccaagcccaattccttgaccaaatcgcgtaagaaattaatgcgcttattcaacgcatcaataatcgtgatttgcaattgcgggaacgcaatcttcaatggcaatgatgggaagcccgcaccagcaccaacgtcaatcatgtgcaattcttcagtttgcaaagctgggtatgcccaggccagtgttaatgagtcataaaagtgcttcatgtagacttcatcgcgttctgtgatagccgtcaagttcatgtgctcattcaccgcaactaaacgctcgtagtattgctgatattgcgctagttgttgtgcattcagttcaacattgtgctcgcgtaatgccgccgcaaattcttcgggattcattatcattctccaaactgattccaataataaaagaataccgcaaaatgcccgtctattcaatagtcgcacgggttttaacggtgtaattgtttcacgtgaaacaggatgttaaaaaggccaccgcacggttagcgatgaccttttggattacttcataaacgttgcgacctctgacataaaccaggcgttaaaggctggtacatcaatatccgtcgctaccgccacattggttgtgtcatgatgcgaccccaacacatcggcaaccgttgcgcccaaggccggaccctcagtgatgacatcaacccaataattcgttagcgtaaaggcttctgggtgagctagatagaacaacgtgttcacgtcgtgcattggcttaccagtggcttcgttgtctgcataatgttgcaacaacgcttgcagcatcgcccctgattcattcacgtctgacaacttggcgatgttgtcatatgacagcaatgctttcatcgtcacatcaagaccaatcatcacaattggcaagccggcctcaaagacaattttcgcagcgtgcggatctgtataaatattaaattccgctacactggacatattaccaccagtgagcgaaccacccatcacaactaagcgatcaatcttcgctttaacctctgggtacatacggaataacaaggcaacattcgtgaaagcccccgtgataaccaacgtcaactggtcggtgctttgcatcaaggtttcacgcatcgcctcaacggcatgttgggcgaccggctgggtcgtcaccgctgggaaatcccaaccaggcatgcccgactcaccgtgcacatatgatgcgtcctcgtatggcttcagcagtggcattttcgcaccagctgccactggtacttgctcttgtacaccgaaaaactcgacaagtttcaacgcatttaatgctgtcttctctacgccgacgttaccggctactgtcgacaacaattgaacatcaaactgtggatcagtcaaagcgatcgcaatcgcagctgcatcatcaattcctggatccatatcaagcataattttttgtgccatggttatttcctttcaaacgtcaggttattcctcacgcgccccgtctaaattgtataaccatattaccacattttgcttgtgtatatttttgcaatatttacttatatttttgcccaaatcttctcttgaattttaggttgtggatcagcagccaagtctgtctttgggcgccaagttccccgcgtcaaatcctgttcagttacttccgccgtcagcacagtgaccgtccatttttggtgggtatacacgtgcgttactggtcggccagccaacttcgtgagcgttgctttaacgccgtaatccgtcaacaaacgctgctcagtagctgcaatcatttctgcaattgtccagtcagcatccggatcgttaacgaagtcggtcaacgcatagagtggcatcgtccaaaaattcgccagcaacccgtcggccggccgttgttcccacaaatagccagctggtgacttaaccgccagcgcaaaatacgtaattggcttaggcttgggcgcctttgttttgaccggataaaattcttccgtcccatcagcatatgcagcgttaaattgcttgaccggtgaatgttccgaatcaaaatttttcgcactcatatatgatgaccccaaatccataattgcttgattaaaatcacccgggcgggctggatcaatcagttgcaggcctagttcaaagaacactttgcgcgtcttaggttgggcgatgtccgcatcaattttgaataagcgcgcaaacacacggaacgcattcccgtcaatggccggtactggttcattaaacgcgatactagcaatcgctgccgctgtgtacggcccaatccctgtcagtttttccaaagccgccatatgatctggccacacgccttggtaatcatcacgcacttggatagcagccttttgcatattgcgtacgcgtgagtaataacctagcccttcccaagcctttagcaatgcctgttctggtgcgctagctaagtcgttaagtgtcgggaacattgacataaagcgattgaaatatggaataaccgtctgcacttgcgtttgttgcagcataatttctgacacccacacccggtaaggatcatggttttcacgccatggcaaatctgcccgtcctgcttcatcgtaccaattcaagagtgtcgctctaaaatcatgaattttatcttcgtcccacatgtcaatcatgatgtatcccactttcttttttcatcgtcattccagtttaccagattgtccttaccatttttcaataagaactcatttgccttatcctgcctaaataagcgataatagaagtaacaattctaatgaaatggaagttggccccatgaaagatacaaacgaacttaagaaaatggctggttaccgtgcggcagaatttgtcgaggatggcatggtcgtcggcatcggatctggttcaaccattgcatacgtcattgaagcacttggcaagcgcgtttcagaagaaggtttgaacatcattggtgtcccaacttctgacaagacacgtcgcactgccgcaaagcttggtatctcgatgcacaacatcgatgacgttgaccacattgatttaacaatcgacggtgctgacgaaatcgatcctgattttgctgccattaagggtggtggggcggccctgctctgggaaaaaatcgttgccgttaattcaacgcgtaacatttgggtcgtcgacgaaggtaagttagccccaaagctaacccactacctacctgtcgaagtcatcccatacggatcagaccaactattcaagcgtttggatgctaagggctacaagccttcatggcgtttggatcaaaatggtaaccctgtccgaactgactcggctaacttcttgattgatttacatcccgctgatattacggatcccttcacattagggcgcgaattgacgagcatggttggtgttgtggaacacggtttgttcctaaacatcgtggacaccgtcgtcgttggtcgccaagatgacgtcgaaattttcgacgctcacccacaaccacttatctaaaatcattaaggcaccgttaaatcggtgcttttttatatgaattgtttcatttttatgacaaaatgaacctacaaagtatgaggaggtattttgagatggtgacaatgtggcaagcatttaaaaatttctggcgtgggtacgtcaacttcacgggacaatcaacccgcgctgaatattggtggatggccctctggcaatttatcatttggacagtttgggtcatcttgttggttgcttccttagtggctgatgcatctttgcacgacgttgatgacaaggtgattaatcatgccgattttggtgacgccgtgcactttatgttcaccagcacacccattttggcagccgttctaattattggcgctatcttgtatttggccatgattttgccaaatatcgcgctattgattcgccgttaccgcgacgccggtacggccacttggctcgcttgggtcatttggattttgagcgctgtgggtggcgttgtgtctaacgtcaactctgatcaacattttgcaatcgcctttagtttcactggactattcggaattattagtttcatcttgaccgttttgcccactgattcactggctggtatcactgggattggtcgtccgcaaaacgagacaccatcatcattcaacgatgatgataatgaactttaataaataaagcggttgggacagaagtctcaaccgctttatttattagtattcatcggcaatcaagttatattgcatcgcaatacccaaattaccattcgttgtccgcaaagcatcaataaacgctttttcatcaaccccggatttcatgcgcaacaagtattgtaactcgaacaacgaacccaattctgtggtcttaacacgcttgagcacaaccttttgcgcgtactgtttcagcacatcttctaccatttgcttatcatacatatcttccggcaccgtcaactttaataattgatcggttgtttcgtgaccgccaaagttcaagacattcatcagcaacatcgcgactagcaagataattgccgaaatgaccgcataagctaggtaacccagcccagaagccaacccaatggccattgtcatcagaacatacgtaatttcagctggatcacccggtgctgaacgaaaacgtataattgagaaagcaccagctaaagaaaaggcgcgggccacattattacccactaacatgataatgaccgcgattacgaccggcaataaaaccagcgtaaatgaaaacttctgtggtgacacgcgtgagttataagtttttagatagacaagcgcagtcactaaaccaagcaacatcgccgtcgccattgcaagaataaacgtcggtaatgtgacgctcgtccctgaacttgttgtcgtaaaaattgaattaagcatgtgtaaaatccttttccattagcatttgatacgcagtcgcatgacgttgaaacccatcctttagaccgcgttcgaattttgaaaatcgcgttggccggagcttgtattcgcccaaaatttggcgcaaaaaacttggcatccccaactcagttttaatctccatcaacaccatccctggttttaataattgatagccaatcgtctcagttgcaatatctagttcagccatgtcatatcgcacattccggtcaaacgaaatccgcaaatcactggttgcctgggtcgcatgcaacgctacgcgatcgtaagcaattttaatcaccgggtcttgttgttggacccgcagcgcagccacctcgcgcgtaatttgattcgttggtaaaacttgcgtcattaaaaaggccgtcgccgtttgataatcaaccgttacgcgtcgcttatacgtcttcttcaagaacttcttcttgatttctagaaacgccggctcactcgcacgagccggcccgtacgttcgcaaacgtaggcgttgtttaaattcattcaattccaaccgcaatgcctgctgtgagacgacatccgtaattgacgcaaagtataacgattgaatcgggtaccaatcaccggcctgattatacttatcaagtcgcatcttaccggaattaagtagctgctgaataattttgtcgacctgatcagccgtaattaaatacttcacttcatatcgattaaatacttgcatgactcttcccccgttattgcggcatgccacccattgggccaccagccataccttctgtcaaaccagacccggccgtaacagcagtcgttgttcccgcgacactcacttgatacgaattaccagctgtaatacccgttgcagcaactgctacggtatcaccgtcagcattggccgtaaacgtcgcaataaccttgccggattcatcgcttaccttaaccgcatcaccggttttaacaccgttcggtagcttcacataagcgccatcgaaagttgcacctgtaccagttccaccatacagcaacgtcccaccggtaaatgtcatggtaccgtcaagatcaaccgcttcattatcaggcgatgaattgatcatcgcgttgattgtaccgcctgaaattttcacatcaccgttcgaatctaagccatcaccgccagctaagaacgccaatttaccagccgtaatatttaagattggcgtcgtgtagctcccggatgcgttaaccgcatcatccgtacttgaaatagttgtatcaccaccattcaagtcgatctcatttgcctgcagtccttcatatgaactagttaccttgaccttaccgccagaaataactaacttacgctcggctgaaataccatggttaccagattcagtaccggtcgctaccgtaatatcgccgcccttaatttcaactaaccctttggtttcatcattgtcttgattcgattcgatagcatcatccttagccgttacattgaccgttccatctgtgatatgcacggaatcatgtccgactaagccatcattagctgccttggcaaatagagtacctgatttaattttcaaatcgtccttggtatatactgcgtccttagcatcgccattcaccgccagtgttccgtcacccttaaacgtcaaatcgtgggtcgcatagatagcccctttaacctcatcagtatcggcaatcgtcccaccgtcaattaggttaacggaattagcggccgtttcgataactgtcttatcggcattcttttcataaatagcagctccttgactagcggttaaatcaacgccattcataataatcgtgaccgcttccttgtcgccggcatcaacaatgatttgagcgtccgttgccgtccccgtaaagtagtacgtcccaccttttgaaattgtaaccgtcttccctgacaccttgactccttcacccgaagttgtcatcttagacaaattaacagtccctttggcggccaccttgttagaagcatccccagttttagcactcgtgggataactggtcgttaccgcaagattcgtctttttagttgataacgaacttgctgtttgcgatgtttgattatcaccttgtgattgctgcgttaccgcatacccggcaccaccgattactaatacgcctgccaacgcaagcgttgcaattgttttcttcgttgtcataattattacctcgtgattaagtatctttactatgcgggagaaagcttaaacaacgacttaactgggctgatatgaaccttaaattttttgaacaaaaaatgacgatattttttcgaagcacgtttaaaaagagagtgagacgaaaggcgctttgaacctgatgataacgttgtttgacccgcttatgccttggcgcgcagcgtagaggtgtgagtgggtcaaatggcgttatattaagggttcagcctttcgtagcacgtttaaaaggccaccaatcggccgatttcacatcggtagattggtggccttacgcacctttaattacctttagatcgctgtttcaacccgccaccgacgccaataatccagaacaagacggcaaaaataccataaccgtatagatattgagagcccgttcccgcaatcttcaagataccttgcaggactaaccagattgttattgaccaaatcgccaaattcgaccattgccaaaaatgttgtagggcgaatcgctgggtaacctcgtttttcgttaaaatcagcaccccacgaatcaacgcgggtattaacggtattaaccacgcccaattcaggctcgctgattgcacaccgtgaccaaaatgattatacacaagatggaagataaaaataaaaattgaaacgcctacccattttaggaccgttttatatcgttgcatcttttgctcctttaatttgcgtaaccaaaatacagcatatctgacactgcacgttcggatgactgaccagaaccaccaactggattattaatcactttaccgttcaaaaccattgttgatgagccaccaccatccaaattataagcgtaggtcgcaccgtgatcggccatcacattagctaactgatagagcgacagacccgttgattctgacgtacgaccatctgaaaccacgacaatatagtgattcttgcccacctgaccaatggccgtccgtgggtttgacgcctgcgattgtccgacttcctcagattcagaaaccgtcactttactattttctacaagggtcggtccgaaactcaaaacttgctgcgcaccatccttcagtaatgtactagcgctagtatcagtttgattaactgacttcatattgccatcgctatcaatcactaacgcatccgtgtccgcagcagctgtatcacggtacagcgtaccgtttcgaacgacatatccggtgtcgcggaagccgtaataatcaccattaatggcaaatattgcctgatgatcactcgccatcgatgacgtggtttctgtataatttcggccatacgtattattagccaaggcagtctgcaataaactcggatcatcgaccgtaatatctgccacataaacactcgtgccagatacacgttctgttgtgaccttaattttcatatgactatcttcatacgacgttgcagtcgtcttaaccgagctcgtttcttttttaaccgtcgtcttgacctgctttgtactcgttgcaatggccgtaccagagtgttgcagcataaacgtatctaccaacgtaaaactcgtataaagcgttatgatggttgcggttattaaatttaatttaagactcatgaatttgctcctgacgttgcttaaatactagttgcttttgaatcaggtaactaccaataaagataatgacatcgaccatgattttcacaggaattggatgcggaataaccgtatcaacaagttgtaatagcacagccgacaaaatcatctgaacactaaataggatgagatatcgtcgacgatcacccgcgacattctgacttcggaacacccagcgctgattcaaactgaagttaacaacgccagaaaccagacgcgctagtacagaggctagcaacaatgttcctgttgacgcattatgaaacacggtcattaacaacaatgcgaataacagtacgtcaacgccggctgaagttaacgaagacaagccaaatttcaagaaacgtcgatagactaagagcgaatcacgcactggatgaaagtgcgttccttcattttgcccttcgtaaatggtctgaattggaatcatcgtcagcttgatttgcaacgactttaattcaagcagcatgttcatttcatattcaaaacgctctccttgcacattagccattgcaggtaaaatcgccatcggtagcccgcgtaaacccgtttgtgtgtccggaatcgtcagacccgttgccaacttcgtcatcttactcgtaatggtattcccccaatacgactttgccggcacttgccctttttcaaaatttctaacgcccaacacaagaccttgttcgccagcctctaacacctccgccatgtgaacgatatcgtcaatcgcatgttgaccatctgaatcggccgtcaccatcccgacactgtttggaaaatgttgttggacataaccaatcgctgttttcaaagcggcgcccttcccccgattggtctcatgagttaaaacaacagcgcctaactctgccacttgaccaaatatggtttggaagtgaatgcctgatccatcatcaaccaccacaaccgggcgacgtgacacttcgcgaattgccatcataacagtaataaaattttcagttggttcaaatgccgggataacaatcacggcatgggtccctgtttgttcaatcttcataagcagttcctcgctttctgttcgtggaacatcttatgatttgtaaccgaagcgaaacttcaaccagccacaaacaaatcttaaacgcaaaaacgctcgaattatccaaccgttaatcggaaaattcgagcgttcgcaacacctgatttattttaatttttggtttttcggcatcgtcatactaaagattgtcccatgcggttgattatcaagcacttcaatcgaaccacggtgtccctgcacgacccacttggcaatcgctagcccaagaccgtgcccacccgttgaacgggaacgtgctttatcaacacggtaaaaacgatcaaacagatgttgcttatcggcatccggcacgcctttaccagtatcagaaacttgcaatttaatattattaccagccgcactcgcactaattacaacgttggcgccttcaccagcatacttttgcgcattatcagtcaaaatcaccaataattggcgcagacgttgggcatccccgaccatcggcaacgtttctggtacatcaaccgacaatgtttggcccttttcttcagcattaaattcataaatatcaccgacttcacgcgcaatggcggccaaatcaacgtcggcaaacgcaaacaacggcacatcagcgtcagcttgcgacagcgtcagcaagtcaccggtcaaattattcaaatgtcggacctcggttaacgcattcgcgacgttttccacttgatccatcaccgtgtcatttggccgttcaagcatcctttccaagttattctgaataaccgtcatcggcgttttaaattcgtgggcggcatcagccacgaacgtccgttgttgtgaccacgaacgcataattggtcgcatattggcccgagttaacgcaatcgccatcaataacaacgcaatttcagacagtgcgaaaatccataccagtcggttctggaacgcatcaaccatctcatgttcggtcgtcacatcaacaaatgccatttgatcaccatgccggtagaaaaagtaccaacttccccgatatgacttcaaataaaccttgccttctttcaatgccaacgcatcttggaacgtttggacatagtcagtcacttgggcagtttgcaacggccggtcaaacccactttgcgggtcaaatgccttttcgacacgttcctgcgcattgccatacatcacaacccggaactggctaatggtaaacgtcccaattaacgagaacaccatcgtaaaaccgacgaccatcaaaatagtcatcttcacctgttgcggtagcgaagcgcggattctttgcaaccacttgggtagttttattttcgcgaaaaacgccctgattttttcaagcatcacggcgattttcgactgtttttcagttggcaccattaagcttccgtcgctgcatttagggtgtaacccacgttacgcaacgtcttaatgtttacttgggcatccgcgttgcgcaagttcttacgaaggtttgacatgtaaacctcaacaaccgtcaatgacgtatctgagtcaaagccccacaaacgatcaaaaatttgatcctttgtcacaatctggccaacgtgttgcatgaggtaaaccagcagaccgaattcacggccttgcaaattaatctcttcattattaatgagaacccggtgttgatcgatgaaaacttgcacattcccaacttccaaagcgccatcttgacccaaaacacccgcgtgacgcaacaacgtcttcaaacgcgccaataattcttccttatagaaaggcttagtaatgtattcgtcggcgcctaagttaaagccttgcatcttatcagacaattcgccctttgccgtcaacatcaaaatcggcaacgttgggtaaagctccttggccttcttcaaaatggtaaaaccgtcttgacctggtaacatgacatccaagaccacggcatcataaacaccagattcaatctcgtaccaaccttcatcaccatcgtgcacttgtgtcacttcaccaagatctgaaattgtttcacgaaccgtatcgttcaatgcataatcgtcttcaactaccaataatttaatcgtatttcctgccatctcactaacctcgctgcacccaaagattttttcatttcgtatttaatgacttaaatatagtggctgaaccttaaaatcggcatagtggcaactttgccgaaccttaaatatttaaggtttctccttcattataatcatttccattccgtaagtcttggtagaatgattaataggaggaacaactatgttatttgataccattcaccacattgccatcaacgcatcaaactacgatgccactaaaaacttctatgttaataaacttggcttccaagtaattcgcgaaaacgtgcgaccagagaaaaatgatatcaagttggatttgcgccttggcacacaagaactcgagatttttatcagcgataaatttccaacgcgaccatcgttcccagaagcacgcggtctgcgtcacttggcttttaaagttgccagtgtccctgacacagtcgcctatttagctacccaaggcatccaaagtgagcccattcgtaccgacgattacactggtgagaaaatgaccttcttttttgatcctgacgggttaccacttgaaattcatgaataggttttgaaaccaaaggaaaaaggcaccaggttcgccacctggtgcctttccgaccatacttcttaaattgcaatccgcatggccgtccggtagttgcctaccgggctaaatacaattacgtatcgcccttgtttcctatacaagggcgatacgaatcgtttgattgctataatctgacaaaacgtatcaccccctttcctagattgactataattatagaccctaattttggaaattcaagtatgaaagtcattcttttttctgctgaataacacccacggcagctactgttgttaacagacccagcccggcccaagttagccatggcgtcaccgcaaaatccgttgctggtaacgctggtgtaggcgcctgcgtaaccatttccggcagagttgctacaagctttggcgctgggtttagtttctgattaactaagttagtcgggcgacgcacattctgggccactaacttagctggccgtgacgttacttcacgcggtgccgactgggccggttgcaatactggttgagatggcctcactaatcgacgtgtcagcacatcttgttttggcggtgttacacgaacggacggcagtgtcactcgtcgacatggcacttgccgtgtctgttcaactggcacactaactggtgtgggcgtttcaactgggccaattattttaggctgtttatcctcattgtcaatttcaactgcaggtgtcatcgcgacatcatcatcaagcggaatgccatgttctgtgcgatcaccgtcgccatcgtcatcccccgcaattatttcagcaggtgtttcttcgacgtatgaatcgtacacatacacaaccgcgatggtttcattggctttaccgtaatgtccgtgggcattatctgtcacccgaaccatgcgataagccggcaaggttttagctgtcgtcgcgtaggtcgttcctggattagcaatggttgtttcggtcggcgcgacttcatggccaaattcatcaacgtgaaacaccttcaaacgggcttgaccattaatatcaaccacatccggcgtggtttgggcatacaacggcgcggcgaccgccaacaagtcaccgttaccatcatacgttttcaggacgctaacggccacattaactgctgtgttatcagcaaaccggagatagaactggtgcccatgtgaccctgtcccctctgacgggtggtcaccaccagcccggccaatgttcgcatcaagctgttttaggtcggctaatgtcaacgcccccgttgcctgatgttgctgcaaaaatgtcgagaatgaaccatcatgaaaattatcaatgccccactcagtgtatggatttcccatattataggccaaggtatacgagccatcatcgttcagtcgcgttgtgtacgcgccacggccattccgtgccaactcacgcgcaatcgttgcgtctgacgcagccccatcaatggtcacgaacgtttgcgcgtaagtcggttcggtattcatttgacgggtggtcgctgaaatgactgtcgcttggtagtcaccatttttatttttatcgaccacatagtacgtcgagtagccggacgacgaattcactgataacaccgtacccgcttcaattttcacctgttgaatttgcactaaatcacttgtcgcaaactggccattttcgcgaatttgggccgtcttagtcgcatccccacgtaacaaggcattcatatacccatcatcttggtaataactaccaacccccatctggtcacttttggtaaaaatatgttgcgttgcgacgcccggcgcatcagtctgaaaacgtgatgcgaatgcaaaatggcccacaacttcagcctggccgaacacgatgcgagcggacccggtttttgctgcccaaattggcgcttccggcagtggcgccgcggtcgatccagtaatcgttaaatgtgaatccacccgtccaatcggggttgcttgtagtgtcagccgtaacgcttgtcccacaacttcatatgccccgatcatctgtttatcatgttgtaacacaccattcgcgcgcaccaaatcatatcgctggcgattaaccgcgttatccgaaatcatctcaccatacaacgggatcgtaatcgtgtcaccggcctggtattggccgttggtattatcaatggttagccccactgcaaatccattcacaattcgcgcatcagccacttgcacaaaacttgtaccagctggcaaaaccgtcccggcggcattaacggcgccactaaccgtggtcgtcacagtttgtgctactaaattatcggtagaccaatcccaatttttagggtcgcgagttgccacattaggtgccaccatcatggtgaccttgtcttgttctgccgctcgaactaccggcattatccccaacaccgtcatcgtcacacccaatagtaccgttggccctttaagccctaatttgggcatttgtcccactggccattcattcatcaacgccattcgcactcccataccccctgtttgtcggacgaaaatcaacttcgatcattatacgtaagtccattacgaacagtctagcgaacaaaaaagaagcgacatagaccaattcgctatatcgcttctgctttagttatttaatttcgtgtgcggtagtcagttgatcccgcaatttgtggcgttgaatcttgccactagccgttcgggggaaagtttccgtctcaaagaatcgtaccggcactttatagtgggccaatcggtcacgaccaaagttacgcaacgcctcaaaatccatcgtttgttcgtctttaaacatcacaaaagcgaccggaacagcaccccaacgatcatcgggaataccaacgactgacagttgggcaatcgcatccgcttcaccatagaccgattcgatttcgtcagggaacacgttttcaccacctgacgaaatcatatcgccttcacgcccttcaacgtacaaaaagccttcatcatccaaccaacccatgtcaccggtatcgaaccagccatcgacaaacgcctcggcatacttatctgggcgattaagataacccaccgctaaggttggcgacttgatttgaatgcggccaactttgtcagcatcattaactttttggactcgcacttcaaccgggaataaaggcttccccgccgatcccaacttgcgcgttgcactgcttgcatccagtgcaatcacttgcgacgctgtttcagtcatcccatatgattgcacaatctcaatgccggcagccgtcgctttttccaaagtcgttaaatcagttggtccgccaccaagcaacatggtccggaaacgttcatggtagacagctcctgccggtagctgagccaataactgtttcaacatgactgggaccactgagatggttgtcacttgacctgttaataattcctggttaatccgttcgacatcaaaacgttcatatagcacaacacccattccataaatcaatgagcgcatcataattgacagcccactaatatggaagattggaaccgccgcaagccagacatcatttggcgtcagccccaaattgagcgctgaaccaactgctgaatagaagtgattcccaaacgtttgcatgacacccttaggattaccggtagtaccagaggtatacataattgacgtcactttatctaagtcaaacgccgcaaccggcacgatcggttccgcttcagttgctaaaatcgctgaaaagttaagctggtgaacattcgccaattcgccaacaaaggcatcatcttgtaaaaccgttgtgattgcagcatccgctagttgaaaggccatttcgcggggtgacaaacggcgattcaacagcacaactgtcttatcaagttgttgaatcgctaaaatcatgaggtaacccgttaaattattgggcgtaattaaggcaatgcgctcattatcatccacatgtttcgcgatttgtcctgcaatctgcaacacccgcttgcgcatttcagcaaaggtgagcgttgcatcaccaaaccgaattgccatccggtcgggcgttaaattcgcgcgcttggttagccaattttccattgtgcttcctttcaatagaaagccccacatcacaaaatcattgatgcggggcgtctgttcttttgtctttaaaaatgccgcttatgggaacttagggaactgcgtaaagtctggctcacgcttctcaaggaaggcattcttaccttccttaccttcgtccgtcgtgtagtacaacatcgtggcatcacccgcgaattgttgcaaaccagccaaaccgtccgtgtcagcgttcattgctgccttaatgaaacggatagcagttggtgacttcttcaaaatttcgtttgcccattccatcgtggcatcttcaacttcagccaaaggcacaacgcggttaatccagttcatgctgtacgcttcatcagccgtgtagaacttcgtcaagaaccatacttccttcgcgcgcttgtgaccgataacacgggccaagtaacctgaaccgtaacctgcgtcaaatgaaccaacctttggtccagtttgaccaaacatggcgttgtcagccgcaatcgttaggtcggcaaccaattgcaagatgtttccaccaccaacggcccaacccttgaccatcgcaatgactggctttggaataatacgaatcaagtgttgcaagtccagcacattcaaacgggcaatgtggtctggtcccacgtaaccaccgttaccacgtactgattgatcaccaccagatgaaaatgccttatcaccggctcccgtcaaaatgataacgccaattgaggcatcatcacgcgccattgaaaatgcatcgatcatctcttgcaccattaccggtgtaaaggcattgtgacgggctggattgttcatcgtaaccttcgccaccgcatccgaacgctcaaacaaaatttctgagtattctttgatggttgtccattctacagtcatttatatatctcactttctgaatttcgagtttcaattcccttggtctcaaaatatgcttcttaaattatagcttttttctacccatttttccaaaaactcgttaaacttatatttaccactttaaccatttgtgtgactttttgttcgtgttcgctttattttggtgtacatacaaaatacatacatttaaattgaaaggttgattatcacaatgaatgcaattgaatatttaaacatttctactgaaaaactaacctcggaagaagtcattttgaccatgccaatccgtgatgaagttaagcaaccatacggcattgttcatggcggtattaatgcgttgcttgccgaaacagccggtagcttcggcgccaactacggccttgataacaccaagcaagtacctgttggtttggacattcacacgcaccacatcgcacaagcgacagaaggcacattgcgcgccatcgccaagccaattcacgctggtcgtcaaatccaaacttggcaaatcgatacattcgttgttgaaactggtaagcacacttcctcatcaactttaacggctatgattattcccgttcggcgctaggtgatttgctaattgcgacgtataatagtcaacaaacagaaacgtcatttttcagttcaactagaggagattgccatgaaggctttgttgattattgattacacaaatgatttcgtcgcaccagagggaccattaactgccggggagacagctcaagcacttgcaccacgattggtcgaacttgctgatgaatttttagctaacggcgatgccgtcattttgccaactgatttacacgtgccaaatgacccctatcaccctgagacaaaattgtatccagctcacaacgtcgccaacacaccaggccgcgactattatggcgtcctagctgattgggtcgccgcgcacaaggatgatgctaacgtgtggatttatcccaagaatcgttacagcagttttgccaattctgatttagataactatttgcgatcacgcgatattaaggatattcatttgaccggggtcgacactgatatttgcattttgcacacagcggtcgacgcctacaacttgaactacgacattaccgtccatgccgatggcgtcgcaagttttacccaagaaggtcaccgttgggcactttggcacttcaagaacgtgctcggtgcaaccgtgacaccggatattaattacaatctagactagaacaaaaattagaaaagccactttggacaaattttccaaagtggctttttctcattattatttaatcccaaaatgtgctgcagctgctccaaaattaaaacgttggtaggcaaccgtcttgaaaccagtctcacgcatcaagtcagccaaagctgtaaatgacatgaattcttctgtcgtcttttccaagtagtcatatgaatccttatcatgagcaaacaccttacccatcatcggcatcacacccttgaagtacatcttccagaatggcttgataaccggattgtcaggttgtgatgtttccaagacaaccaactgaccaccaggcttcaatacacgatacaattcttgcatccccttttcagcatctggcaagttacgcaaaccaaatccaatcgttaccaaatcgaaggtgtcatcttcatatggtagttccatggcattcccttgcgttagggttacccaaaaactcacgccggcttcgcgaactttttcgcgggcgacagccaacatttctgaactcaaatcaaacccagtcacatggcccttatcacctaattctttagccaacgcaatcgtccagtcacccgttccagcagcaacatctaaaatttggccattctttggaatatcgattgacgccatcgtcttggcacgccaactgcggtgtgtccccaaactgataatatcgttcatcttgtcatagtcttttgccaaaccatcaaagatgccttggacacgttgtggcgctttgttcatgtcatatccctcaatcatttttagtgtacctacattatacaacgattacccaggcgacgcattgcgacatctcaaatccattgtcacgttatttgtatatagcaataagcgttaattaggcaatcgaaacaaacaccccagtatcatttgtatcacctgataggcgccaacgctttaacatcaatacgtcacagtcataatcaatgacgattgggcgtaactcagctacatccgcttctttttgttgcgccagcacgtcgcatcgtacccaaccgcgtaagcgcaaccgtggcatccactccaacggcggcaacatcatcatcggtttaatttgaccatggagataatcttgtagttgcttcacttcttcttgcacctgcggtttacgcgtctgtgacacatgcggaatcaccaacaccgtcgcacctaaatcaaaaatgtgcgcttcactcccctcccccactgcacgatgccaaactgcatcaatttttcctaaatgtatgatgccaacacctctttcaacatcacgcaatcgcgtcgtcgctgaccaagaccatactggccgctccccaaattcacgaaacgccgcctctaaactcactaacggattgtctgcgcgcaattgcgatacgccatcacgcggtaaaatgccgtcgccaatttgctgtggcaagccggccgacacatgctgactagcatctggaatcacaaccattgtcacaccttgcgacaacatccctgccaccattcgtccccaattcacactgcccgcggccaaacgatccatttccaacactactaaacgcatattttcatccccccaaaagtcgctaatatagctcagtctagcggactacaagccccggaacaagggcatttctgcacaactatcatgcaaaaaatgtaccatcaccgttaacaataaacgggttaaacaaaaacgtgattagccagtagcaccggtctaatcacgtttcgtattttatactttgatgattaatctgcataatagtcagcataatcaacaaaaatttaatttcataaatcgcccaaacgaccccacttaggtcgcgcgtccgcttccgcctctgcttcagattcagccgccactttgtcggcataatacatatccgctaaataatcatgcgcagctggttgctgcattttcacctgcttatcagttggtgtggcgaccgccggttctgattcaaccacctcaggcatctcaaattggccatcacctgtcgcaagcacttgtcccaataaatcatgcaacttttcaacttcttcgcgggttagcgttagccccttacccattttggcatgatccggtgaccacgttcgcaaatcatacttcggtttgttggcaccccattgcacgacatttaattgcatctcccagccagacttactcgttgagagcgtccccaattcttctaaaatttcatacttcaaatcagccatttcaacctcatttctgcttgtaacgcctgtaacaggcaaattttgtctcactaattgtattatacaaaatctaagtcgtgcgcgattggtgtttgcataagcgttcgaactgtctcaagctgtcgcgtctgacctagcacccacattagttttgccacgattgcttcggtgttcatatcaccagccgtaataccaccagcatccgcaacccgcttgcccacttcatagagataaatatcttgtccctcttctaaaatctgggtcgtaataataactgggataccggctgccgtcaatttttcaacacccggaataagattgcgacgctcgaatggcagaccgccattaccaaagctttcaataatgacaccatgcatattagcggccaaataatcaaaaatatcgaccgttagacccggaaacgccttaagtacaaacaccttggtatccagattaatgctaggtgtcagtaccggcgtttcaggttcaggttggtacaacggcaccatgttaccttctgatacgctagcaatgtacggataattaatactttcgaacgcatcataactctttgatttggtcttcactgcccgtgttcccgccataacaagaccattaaagactaaataaacaccttgcaggtccgtttggctagcaaacgttaacgaatcgtgtagattacgcaccgcgtcggtttcagccataccaagtggcacttgcgatcccgtcaaaacaaccggcttatcaaagccatacagcaaatatgacagagcagcagccgagtagcccatggtatccgtaccatgcgtcacgatgaaggcgtcgtacgcctggtgatgcgcttgaattcgttccgcaatttcaacccagtcttccggttgcatattggttgaatccttactcatcacgttttcaacggacaaattcacccccggtcgacgttcaaaataactgactagcacttctgccgccaacccaggcgccaacccgttctccgtctttgttgaggcaatcgtgcctcccgttgtcagtaccagcacttctttcacgctactaccctcccctacgcttctttctagatatccttacattatcgcacagaccgcattgtctattgcgattaatttcagcatatccacaaataaaaacgggtttaacaaccaacgttgctaaacccgtttaattcttaatattaatctttggtactatgctttgcgccataggccacgtataccaacgcacctacaacgacccaaacaagggtcaaaatcaaggcatccttgttcaaagaaacgaacaaaccgattgaagccaatgctgaaataattggcaacactgggtaccatggcatcttgtaacctgagtggtcaatatcttgacgcttacgcaacttcaaaacacccactgaggcgacgataaaggcgatcaacgttccggcagaaaccaagtttgccaacatcccaactgggaatacggcgcccaacacgacggccaaaattgtcaaaaccaatgtaccattctttggcaacccattcttatccaacttggcaaaagcctttggcatcaaaccgtcacgtccaaatgagtaaaccaaacgtgaaccaccaatcatcaaggcaatcaaaccagagaacataccaaccaacgccacaactgacaacaagttcgctgtaaacaagtgacctgattgacgcaatgcccaagcggccggctcagcattaccagcaaacttcgtgtagtggaacatacccgtcaagacagctgcaacaccaacgaacaaaaccgttgcaatcaacaacgtgccaacgattgcacgtggcattgtcttttgcgcgttcttaacttcggctgagttggcagcaattgtgtcgaaaccgatgtatgcgaagaagacttgcgcagctcccatcatgacaccgtgcatcccaccgaagtttgttccaggtacgtgcttcggtacaaatggtacccagttttgcaactggacagcagtagcacccactacgatgaacaaaacgataaccgcaatcttaccaataaccaaccagttttcaaccttggcggcacccttcacaccacgtgaaaccaggtgaccaacaaccaacaacgctaaggcaccaaacaagtcgaaccacgtcccgttacctagcgagaacgatgtcgtcaacgcctttggcaacgcaataccaaagcttgataggaagccttggaaatatgatgaccacgaggctgaaatcaacgccaaggcaatcaagtactctgctaggaccgcccaaccggctagccaaccgacaaattcaccataaatgacgttagcccatgaataaattgaccccgcatatggcatcgctgatgcaaattccgaataagccaaggctgataaaccggcaataattgctgcaataataaatgaaataacaaccgctggtcctgcataatcagctgccacgatacctggcatcgtaaagataccagcacccacaaccgttccaactcccattgcgatcatttcacgcaaaccgagcacaggcttcagatggccgtccttatccgcgtaatttcgcggatcttctttgcgcgccatgcgcgcgaacaaacccttttgttccataaacgtttcctcgtttcaactactcatctagctactagatttactcattcaatcattagaaaataatgtgataattctacattcaaaaccagttactgtcaactgaatttaccaccacaaatgcccatttctcggaacttaacgcattattattaaatacttttcataaataattatcgactatgcaaaatataatgaatgcctttttagcttgcgtacctttagtaataatgataaacttctaatcattaagtactaacaagaaagaaatggaggtcgtcatcatgattaagcaataccgtcacaacagcattactgtcatcacgacgaccaccacctcaaccaccattttggctggttgggctctttaaagtactgttaaataaagattgttaacaggccgtccaatcagttctacaccccattgcggtgcatggctagttggacggtctttttgtatgcttaggagaaaaagaatatggcaaagaacaaagataaattacctgacggccagttacaacggtcgctaacgtcaaatcaaatgcagatgattgccttgggtggtaccatcggggttggcctatttatgggttcaacttcaacaattaaatggaccggtccttccgtcctattagcctacgctttcgtcggcttgctcctgtacttagtgatgcgagctttgggggaaatgattttcatcaatcccacaaccggatcatttgctgattatgcaaccaattacattcacccgcttgctgggtaccttacaaaatggagtaacgttttccaatatattgtcgttggtatcagtgaagttatcgcggttagccaatatctcaattactggtggccaaacctacctggttggatttccggcgtggtcgttattgccactttgacgctagcgaaccttgcttcagcaaaggcatacggcacgatggaattctactttgccatgattaaggttgtcacgatcattttgatgattgtattgggtgtgatggtcatcttcttaggattgggtaatcactggcacgcgcttggcctatcaaacttgtggtcacatggtggtttcttcaccggtggcgtgaagggattcatcttctcgctatcaatcatcgttgggtcataccaaggaatcgaagtgttgggtatcacagctggtgaagctgccaacccacgtcacgctatcgtctcatcagttaagtccgttgtttggcgtattttgattttctacatcggggccattttcgttatcgtaacgatttacccttggaaccaactggcagccgttggctcaccattcgttgaaacgttctcaaaagttggaattgccggcgccgctggaatcattaatttcgtggtcttgacggctgccatgtcaggcgccaactcaggtatttacagttcaagtcgtatgctattcaagttgtcacgcgacaaggagacgtctggtgttttccaaaagttatcttcacaccacgtcccatacgtttcaattttggccatttcaggtggtatcttacttggtttgattttgaacacggtattatcactttatagtaagtcaacggcaaacatctttgtcctggtttatagttcaagtgtgttacctggtatggtgccttggttcgttattctttggtcagaacttagcttccgccgttcaaacaaggaattacttaaggatcaccctttcaaaatgccactctacccattgacgaactacttcgcaatcttcgctttggtcttgattgtcatctttatgttcatcaatcctgaaacacgtatctcagtttcaattggagccggcttcctcgtgttgctatcactattcttcttcgcaacgaacaagcacaagcaataaatcaaaagcgtcctcgcagcagatgcgaggacgcttttttgatttattgcttattttttatagtatagataaaccggaataccaacagccacaaacacaaacgaaatgaggaccattgtaaaactagaaatcaacgtattaatcaagatgaacaacgcacctaagatagccaccaaaggcacaaacgggaataacggtacgctaaacacttccggatcacgtgccaaaccggcccgtttgttacgaatacgtaagatgaaaataccaaagaatgttgccgtatagaacaaccagatgacgaacacagccatatctgatagccaatctgcctttgacgtaaacatcaacgcaccggctaaaacagctgtggtccacaaagcgccaaccggggcctgcgctttattcaaacgggctaagaacttgggcaacatgccatcttcagccatcgcatacaccatacgtgggaaagctaacatcttaccattcaaagttcccgccattgaaatcaaaataccaatcgatagtagacgaccgcctagctcaccgaaggccgactttgctacttcataagtcacattattgccaagtttaacaatttgatcggcaggcatcgcacggtacacaccatatgaaacaccaacataagccaacataacaatcaatattcccccaataattgaacggggaatattacgccgtggattctttaattcaccccccaaattggtcagcgttgcccacccatcgtaagcaaacaacgttgccaaaacggccataccaaagtttcccgttgccgttgatgatagctgggtaaccgtctgacccagcgcgtcagccttaccgaaaaacaaaccaaataccatcaagactgcaattggaatcaacttaatactggtcgtagcgacttggaacatcgaagcaattcgattatctagcgaattcatcaatgtgataagcactaacgttcccaatccaacccaaatcaccgcactatctggtaggccaaaaaaattagcaaacagatacgcgaagtatgcagcaatagaagccacaattgccggcgcataaaccacaacttgcgtccagccggtcaaaaagccccaaaacttaccgtacaacttatccatataaatatagataccaccggtctggggaatgtgcgcgccaatttctgaaatcgttaacccggctgccaaagtgattaccccaccagcaacccaagcgagtaacccaagtgttgtgctaccagccgtttccaacacttgtccctgcttgaaaaaaatccccgatccgataacggttccgattacaatcgagatacccgtccaaacacccatcgtccgtttcaaatgatgctcttgccctgccatatcctataccctctactttcaaaataacccaatatcacacaaaaacacgcaatcgtcacgacgaaaatttcgtcagttaacgattgcgtgttcgattaagcgcttaataatttttgtacgctaaaatcctcaaccgttaaactggacggttgagtcagaggacgtcgccatgatgatagctgtgctaattcgattattcataagtctgccctccttttggcgtttttgtatgattagaactttatcatcatctcatcgtttgtgcaataggttttctcattctatttttaatatcttcaatgcatccccagactgatttagaattcgaatctctaatcctggctgcgttactccaccagcccgcatggcccccagcaccttatccgttaacttttgaacctgtgcttgttcatgcttcaagccaaaattaatgagttccgtcgacacattagttgtccggatggtgtatataatacgattctgatcatcggttgcattagccgacgtaaccatcccctgcgacagttttaatacgcgacgttggtaggtatttaattgcgacgcaaccgcatgcgcggatcctggttgcaagttaacctgcaaatctgcttgtgatgccaccggtaatttaggttgcgtctgcgaccaaaccaccaacccaatcaggatacttaaaaagaggagaccgctgattatccacgctatttttttcataacatgcctcatgcctgtagtaaaaaactcactaattcatctactgtctcaaacgatggcatatcagacggaataatccccattgccttcgcttcagcttcgacaaaacttttccgctggacgacatcatttatatgtggcacatcctcacttccgtcctttgaatcatatggtatcaaaaacaagtcctgattaatatcatccgcatcgtcacctaaatgattcaatttgtactgcgcatccgcatgtaacaacatttgcgctggtgttcctgtgattgtttcaatccgacttgctatctttggggaaataaatgctttaaaatgcaaaacatttgataaatacttttgcgatacgccaattcgcgctgcaaaatcttgttgtgttgcattaaaatatgacatcagctccgcaatcatcgttgcagcaccaaattcgccttgtacttttatcgttaaatcattatccattccatcgtcctcgctatataacctcgaataataagccgccaatttcctgttaaattaaccgcaaagaggccggcatacttccctttcaattcatgtaggcccgccggcggatactgagatagttgatacaaattttcctcttgttccattttccaaattcgtgttctgatttccgttgcaataaccgttccgaacctaaccaacaattttcgttcgtccattaaaattttcgttaacttcgttgtattacccgatactttcaaaatatcctctttctccattataccaaaacggtataatggcgtcagcccattgtcgtaacattaataaagataacgaattagctaatttgtccatttttagcaaattaaaaagccttaaccacatttcaacagttaagacttttactattaattcaatttaaccagcaagcgttactagaataccgcccaacataacgaagagggccccgatggcaataccaatgatttgcgtctttgttttacgttccttcaagatcaaaatcgcacccaacgttgaaacgataatgcccatctgtgacaacgttgaggccttcgcttgaccaactgcagggttcaagacagcaagacgaatcatcacctcaccagttccccacataataccagccaaaccattctttgccgtttccttcgtcaataatggcaacttgaagtttccaccattgaagatgaaaataccaaaaatcaaagccccgattgtttgaccgatggcgatgggcaacgacaaggccatcgtgttgtgcaacgtacctgtatcaacgtggaccaagtgtaacaaagcaactgtctttggaatcatgaaataaatcatgtaagcaaagactgaaatgatcgttaaccgtaccccatccttattcaagtgtgatggcttacctgaaatcaagaaaacaccaataatgacggaaacaatggctaacaagccgattgtccactggtgggcaccttgccactcaccaaagacggctgcaccaaccaacgcgttcaccgcaatttggccagctgtattcaaaccagacgcctgtgaaacacccatcttcttaaaggctgctaattggaagctcgttccggcagcccaagcgattcctgataagacgtacgtcaaaccagccatactgaagacaacgggccaagttggtccctcaaacaaggcgtacacgccaactacgattgagaagaccagcgaaccaagcgcgccacccaaaatttggtttgcgacacgaccaccagcccatccatttacaattcccattgctccccacaatacggcgggaatcaaagcatacataattgacatgtaccatttctctctttcaactcttttttatcaacgtaaattactatagcaccgggttttatgccgttaaattaaaaagggaataaaatagaccaatccaagaattggcgtataccatttctcgaattggtctagttatgacacttaattaattgccgcttcaccagcatttttaggcagcaacatcacttcaatcattggtacaatggcaaaaatacccagcacgacaaagccccatgcataggcgccttgcagtgtcataccatgacggaagatgtggataatcaccgtaatcaatgaaatacccaaaccttggccaagactctgcgtcacagccgttaaggtattagccccatttcggtgaattggggcaacatccgtgaattgtagcccattatatgacgtaaaggccaacgaccgccccacacccgaaacgagtgccaggaacataatcgcaattgccgtcgtatgcggccgaaccggcgccaatccaaatgaactcaatatcaacatcaaaaatgacgcaattaatgccccacggaagccaaggcgacgaataattggattcgtaaatggcttaatgccgatgttaccaatgaaaataaagatgacataccatcctgcgcgggccgctgaccaaccaaagaccgtttgcaacagcaccgttaagacgtatggcaagctggcaatggtaacttggaatagcgtcccaccagtttgcgacactcggaacgtcggtaccttcatcgtcgccaccgagaacaatggatgttcagctcggcgcaagtgctggtaaacatttacgcccaacacaataccaataacgaccataatcaaaccgtaccagacaaccacgcctgtacgtgctaacatttcagcacccgtcagcaacgccattgacgccagcgctaattctacgaaaccacgcacatcaaacggccgtggttgttgctgatcatcacgtggcaataaccggacgccaatcaaaaaagcgagcaagccgattggcaaattaatcaagaaaatccagtgccaagtaaagtatgtcacgaacataccgccaataaccggtgccacagctggtgccatcaatgacggccagaccaaataactaatcatctttaacagctgatctgccggtgtcttttccaacaccatcagtcgggccgttggcgtcatcatagcccccgcaattccttgtacaattcgcataatcaatagcacggtaaagtttggcgctactgcactaccaaaggaacttagcgtaaagagcacaaccgcccacaaccaaatgttctttttaccatagcgttgcgccaaccagccactcaatggaatgaaaacggccacggcaatcatatatgtactaaccaacaaactcgccgtcgccgcactaacattaaacgtttgggccattttgggcagagccgtggttacaatcgtgccatccatgacatccataaacaaacttgctgccatcaataacgcgattttaatttctttcgacacgctacttaccttcctttttctaaaactcacgaagaataagtgtatgcctttttaaaaaacgttgcaaatcaaaacgcgataccacaaccgatcttatgaccgccttgtagtatcgcgcttcattaactaatgttgtactgccaccttggtagctactgttgaatcaacttgttcaatgtcagagtccaagtcttccttatcctctaaacggaacgtgatgatgtaagcaatagctgcagcggctgcagctcccaaactcattgcactcataaataatgtcatcatcgtttccccctttacgttccttttgtatgtattaataataaggcctgcacataggcattgtaaacgatttcagctgtattaattttgtcagaacgtcaaaaaatttaatggtctataccggcaaattaatcaccttattttgtacatccccaataaaacaagctacaatgaagtcattaaatcaagattggtcaaacgaggaggtattcgtatcatgaaggcagttcaaattaaagagtttggtgacgttgatgtacttgaagaaattgacaccccaacaccaaagattttgaagaagcaggtgctagttaagaaccacgcggttgcaatcgatccttacgatgtaaagtttatccaaggacttgccggtgaagccgataagctcccattgattcctggatcaagcgtgattggtgaagttattgccgtcggcgaagaagtcacggatttccaagtcggtgaccgtgtcgccgcaacgcgccaccaccaaacctacgctgaagaagttcccgttggccaatctgcagtagctaaggtgccagctgaactagatgacgaacacgcggtcgctgccgtaatcggggctgctactggctatcaaatgattactgatgacttagacgttcaggctggacaaaaagtcttgattcaaggtggggccggttctgttggatccgttgccattcaagctgccttgaaccgtggtgcggtagtctacgcaacggctaagccagctgatttcgactacttgaagtcacttggtgatgtcacaccggttgattatcacacagcttatgaaaacgacttgtctgatttcgatgctgttttggacacaattggtggggccgttgccattcaatctgctaagattttgaagcaaggtggtaagctacgcaacctaacaagttacgatgacgaagccatgagcgcattcgacattgatgctgaacacacttacctaaagggtaagcgccctaacttggcagctttgtacgccgatatggtcgctggcaaaatcaacgtcaaggttggcgaaattaagccattcactgtagctaacttgcgtgacgcacatgctgctgctcgtcaaggttcagctgccggtaaagttgtcttaaccttttaattaaacgtaaaatttaagcgagcgaatgtttcatgtgaaacaccgttcgcttttgttattgactataatggaactattacttttttccgggagaaattactatgctattcacagaacgtgactattacgaagacgtcgtggcaatgctaaacgcacgcggggtaaacttagaagacattggcgaattggttttgttcggtcaaaaggccatcattcccaacctaacaatggcagacgccgttgactcagtacaacacgtcctacacaaaaccgaagtacaagatgcagtgatgaccggtctcgcaattgacgacttggcggaagctcgacaattgccacaaccattgcaaggtcgcatcgaccgtgatcatggtacttacggcattgatgagcaattggttatgtcaatccttggcgtttacggcaccatttcttggacaaattttggctacctcgaccgattaaagcccggtatcgttggtcgtttgaacgacgagcaacacgccggcggtcgtgtgaacacctttattgatgatatcgtatcagcgattgccgcagccgcccaagcccggattgcgcacgattaaaaatgaacaaaaataaagccaggcacatgtgtctggctttatttttgttcaattatcaattacataatgccgtttgccttggcagcttcgatcaaatcgagctccttagcactttgaacaggtgttggtgttccgtcaacgttaattgactcaatccccttcttttccaacaacttcttcaacttattcttctgtgacataaatccatacctccagcacatttttaatttgcgcgtcaggtgattggcccggcgtgtatgtctacccttatagtgtagtccttttttaccggtttgttaaatcaagttcacgaacgggctagctgcaattaatctggttggaaagtgcccgtctcaacgtcttgaataaaatgtcgcagattgtagaagaatacttctggatcatcgaccatatggacgtgtccagcatctggcgtgacacgcaaccgcgcattcggcattttatcacgcatctcccgtgctactgacaacggcattgactcatgaccaccaaatgttagtaacgttggtactgtgatttcatgtagtcgctctgcaaccgaccaatgggccaattcgccagtaatcacaaactcattatttccctggaaatgattatagacggccgtccccattgtactaatctgatgatgcggtgcatttgggtgacgcgtgatatatgcctgatcaagttgcgtggcgtaggcttgataggttggattatcccattcaccccggtcctcaacttcacgcataaacgccacaacatcagcatcgaattcatgttctcgaatggcattgatgttcgttacataatcatcaatattatcaatcattgaaataataatgagtcctttgacgacgcccgggtggcgcaacgcatattcctgcgctaataatccaccccacgaatgacccgctaaataaaattcaccatcttcataacctaattgctgcctaacttcttctacctcatttagatagtagtcataatttaaaaatcgttcaacgttagccggatcatcaaaatctggttgatcagaataccaagcccccaattgatcatattgtgtgacttcgacaccatccggatttaaaaattctggaaaacgctcatacggttcatgcccagcgcctggtccaccgtgcaacgtcagcaatttaattggcttgcccgtaccatctgtacgcgaccataaatgatagccattctcaagcgataaaatgtgcgtgccatcttttgtcatccaatcatccccctatttcttttcagcgtgcttccaatcaaaggttcccccgactggattgacgtaaacacccttaacatctggattctgtaacgccgtgatctttgagtacgtcaacggcgcaaccgcaccctgcttttcagcatattgttcagcagcaaccaaatccttgtaacgtgccgccttatcattagcatccgtgaccgtcgccttgcgatataactcgtcatactttgggtcagaccaacccgtcaaattccatgaagcccccgtaaccaatgtttgtagcatgtcaactgggtccgtgtaatccgcgttccaagtcgagagacccaaatcgaatttccctgccttagtcaacgcactagtctgcttagcgggcactgacttcacactcacttgcaaacccttcaaattcgtttccaattgtgactgtagatattgtcctgtttgcttagccgcatccgtatcacctgttaacaaggtcaacttcacggtcttcttacctgtttccttcaaaccagcagcccataacttagctgcttccgctttgttatagctaacgtacttcgtgtgggccgtgtcgacaaaatccttacccgtatttggatccttcgttaatccctttgccacaaaggtcttggctggttcagcagcccccgttagcacgtttttcgccaacttttcacgatttactgcataagacatcgcttgacgcaacttcacatttttcaacactggattcttttggttcatcgtcatataagtcgtcgctgcggtatggaccgtcgtaaacccatgcttgtgcttagagttacgtgcttgggtagcatttaactgcgcaaaatcagctttaccggcattatacaaattgaaacttgtcgtcgcatccgccgttgtggtgacatttacagctggcgtcttaacggcatcggcatcccagtaataaggatttttaacatattggtaggttgaacttgagccatcccacttcttcaagacatatggaccacttgataatgaatccttagccgtcgttccgaacgccttgccagtcgttgtgacgaaactttccttttctgggaagaagtacatcatcgccaactccgctttcaattgtggcaacggccgatccagcgtgacttgcaacgttgtatcatcaagggccttcacgcccaattggttcatatcagtaacttttcctgattggatagcatccgcattcttgataccgctaaagaacatcgatccgattgccgccgtcttaggattgtttgtgcgttgccaactataaacaaaatcatgcgccgttaattgtgatccatcggaccactttaaattgtcacgcaacttaaatgtccacgttaacccgtcatctgagacatctactgattgtgcggccgccaattctggttgtccacttgtaccaacacgatacaatccttcaccagtggcttgcaccgcattttgtgatgggatatccgctacgtttgaaggatctgttgtcttcaagtcccccgtcaacgtccaattcaattccttaccggccgcatgcgccacttgtgtgctagcacctgcaactgcaaccaaagcaactgacatcaatactgaattcttaacaaacttattcataacctacacgctcctataatttgggtgggacgagtaatagtttgagctcaaaaatatataaaaaaacggctagtattctgcgcaaaatactagccgttactcgtttacaaagtaattaaatttggctagccatgttaactgtgtagcagtttcatggctagcaagcatctcaaaaagccaaccatcactgcgaaataataataataatcgcaataataattggggcaaccaacgtcataacattcaatttttcaacagacacgttcttcatgacgtcgtcctcccttttcttgatgtttctaagtatacgcagtttatgataagtgtcaacactttattctaatctttttctaattaaatcaagcgccaccgtatacaaaaaccgcccatgaccagttcacgcgtcatgggcggtttattatttaataattagtcttcttctgaaccaagaccaaacttagcaattacggctgcaaccgcaccaccaagcaaaggacctacgatgtaggcaccgatgtgagtcaatgcagttgatgaaccgaacattgcaaagaatgcggctggggccaatgaacgagctgggttcaatgaaccacccgttgcttgcaaaccaagcatgatcaatgcacccaacgtcaaaccaatgatcattggtgccaaagctgagttctcagcgttcttctttgacgtaaccatcaagattaccaaaacaaagacaaacgtcaagaatgcttcaatcaacgtagctgacaagaatgaaactggtgtgttgtagtctgtttgaccaaaaccaacttgcttgattgttgcagcagttgcaccaaaggccttcatgaagccaaagataacagctgatccagcaaaagcaccaatgatttgggcaacgacgtaaccaataaattcaacccatgagatacgaccgttgatggtttgtgccaaagaaacggctgggttaaagtgaccacctgagattgggccaaaagcgtatgctccggctgcaaccgcgatggcgaatgccaaagcaactggcaatggaccagcttgagtaccgacgaagataacaactccagtacccatggcaaccaacatcaaagttccgaagaactcggcaagatacttgcgcatgttttccatgattaaaaactccttcgagatatactttgtacgactgtacaaaattaaaaatttctgaccctactatataacaaaaaccgacttaaattcagctttaaagttccgccgttaacgtaattttaatattagcgaccaataatcttgctggctgcacgatccaacgctaaccaagcattcattgagtttgccttaaattgttcaataaatgagggcttaccttcttctggctttgcctcaccttcgaatgaattttcgataccaaagacttgcaaggcattaaattcttcatcccaacgaactgtatagtagttaccttccatgcgttcatcaacaatatcttggaaaccaagcttcaaggcttccttaatgacatcatcctcgctgactggaaagccacgtgcggccatcaatgcgacacgatccgcaacctgtgtcatatcctcaggaattgaatgctcgttcataatctttactccttctttcagtgacttactttgtgttcagaattaaacacgttactaaacacattttagcagtgagttgcgatataataaagcagactggtcatgttagggcttttaggcccctgaccaggcccagtcaccgttatctgacgtattcgcagcacctgcttaacactgccagataacccgataatgtccaaaacaacgttatcgataacatttaatctactataaggaggttacttttcatggttgaagcagtaaccgcacaagagatgcaacgatttgaccgttatacaatggaagaaatcggtgttcccgccttggttttaatggaacgcgccgcaatggccaccattgaagttttggcagctggtacctttgatttagccaacgtgcttgttatcgccggacttggtaataacggtggtgacggtgtcgccattgcacgcatgttgattcaaaaatgcgttaacgtcgacctattgattcttggtgatgaaaatcgtgcgaccgctaacacagccacgcaacttaagattgcccgtggctatggtattcacacccaaaaccgtgtccgtgatttccgcaattacacggtcatcgtggatgcgctatttggaataggcctttctaagcccgttccaagcaaacttggtgatattattaaacgagtaaatgccgctaatattccggttgtctctgttgatgtcccatctggtttgcacgcaactactggagaaatccttggctctgctattcgtgccaccgcaactgttactttcgcctatcctaagcaagggttgttgcaaaacgaaggcctaaaacgcgccggcaatatttatgtgaaagacattggcatttattcaccggaagaattagcagaatttaaacaggaagagagcgagaactaatgaatatcgtattagtcggggctggtccacgtaacttgtctttggttgagcgtctaatggcgcacgccaagtcaacgaccgagcctgttgacatcaccctatacgacccatttcctatcggtggtcgtgtttggaacccagatcaagacccaactttcttgatgaacactgttacacaacaattgacgttgtttactgatccttcagtacctaaccacgcttctaccgcgttgtatggtcctaatttttatgaatggtctgtcacgttcggtaaggaatacgtgaagatgcacgacttcaagaatgaagcttacttcttggatgagttgacgcgtatcaaccctaaccgtttcacgtcacgtgctttgtttggtgtgtatggccaatggttctttgaacaccttggtgctcacgtccctgcaaatgtgacattgtcatatgaacgtcgcagtgtcactgatgttgttaagcaagataatcaatatacggtcacgattgacggcactgataccatcattgctgatcaagtggtgatggcattgggtcacgtggacaacagcttgaacgatgaagagcaagctttcgctgatgccgctgcaggcaatgctaacatgttgtacgttgccccaacgcacccttcagaagccgacctcgatgctgttccagcccgtgaaaaagttgttttacgtggtttgggattgagcttcttcgactacattgctaagttaacaatcagccgtggtggtcgcttcgctcgcgataacaacggtgtgatgtactacctaccatctggtaaggaacctcacatgattgctggttctcgcaagggcttgcctatgcacgcacgtggtgttaaccaaaaggttgcggctgaaggttatcaaccactattctttacgtcagagaatttggataagttggctgaaaagtcaaacggtcaagttacctatgacgaattctttacgttgttgcgtaaggaattggaatacaagcactatcaaaacacaattaacgactttggtgtcacatggccattcaacgctgccgaattcatggatgctttggcagccagtgatgatttgaatgaaactgcccgtaagtacggcatttctgaagaatacatcatggattgggatcgtattttgaaccccgttgatgatgtaccagctgaagttgaatacagtgacttcatgatgaattacctaacttgggatattaacgatgccaaccaaggtaacaacgatgcaccttatgccggtgcctttgatatgttgcgtgacgtccgtggtatcattcgtcactatttggatgctggctacttgtcatctgacgaatatgccaagttcctatcaaagttcaacccatttaactcattgatttccgttggacctcctgtcctacgtgttgagcaaatgcgcgctttgattgaagctggtgtcttggaagttgctggccctggcttggcagtttctgtccgtgatgaccactacgttgcaacggataaccgtggcaacacgtggacggtcaacaacttggtagaagcacgtttgttccctgtgtcattagctgcatcaactaaccctttggttgccaacttgcgtgatcgtggtttgttgagtgccgccgagtacacaaaggctgacggttcaacttatgttgttggtggtacccgtatgaacaaggaagatttgactgttatcgatgctaacgataacgaagttgatggtttgttcatttggggtgtcccaacggaaggttggtcatggttcacaacgtttgctcctcgttcaggggttaacgataagaacttgcgcgatgctgaaaacatcgcccgccgtatcttcggtaagtaattaagaatttttaaaacgcccattatggctaagacagcaatgtcagccataatgggcgtttttgttgttatacaggcattcttacaattgcaaagattttctaaagggtgtatattaggtttatcctaacgttagggtaaacctaatatatcattttgaggccttgcttatgagtcataatgtgtatgctaacgaaccacggcgtgctgtcatggtaatcgattccaaaagtttttacgccagtgtggaaagtgttgatttaggattaaatcccctcaagtccttgttagtggtcatgagccagcaagaaaacacaaatggtggtctcgtcctggctgcgtcaccacaggctaaaaaaatccttggtgtctccaatgtgatgcgtcaacgcgacgttcctcgtgatccacgtttggctatcgtccaaccacgcatgaattactacattcaaaaaaataaacaaatcaacgacatctatcgacaatttgtcgctgatgaagatttacatatctattcaattgatgaatccattctcgatttaacggacagttggcgctatatcgaatcaaaatttgggcgcaagttaacacttcgcaacatggcccgtctcattcaggaaaccgttcacgatgcaaccggcatttatttgacggttggcattggcgataatcccgcgatggctaagatggccctcgatatttcagctaaacataacaaggatttaattggggaatggcactacgaaacaattcccgagcatttatggccgattaccaagcttgatgacgtttggagtattggtagccgtactgccaaaaccttacgccgtttaggcattttatcgatgcgtgatttagccgcttttaatccttatcggctccgggaactgctcggggtcaaggggattgaattatatgcgctagcttggggtgtcgatcgcagtcggctcagtaataaatatcacgtcaaagaaagttcctttagcaacggccaagttttgccccgcgattacgataaccccgctgaaatcgaagttgtcattcgcgaaatcggtgaacaagtagccagtcggttacgcgcaaaacatgtcgtggccagccaaatcagtttaggcattggctttggctatcgtacgaccggcccgaatcacggttttagtggccaggtaacgattgacgccaccaatctaagcctccccattaccaacgccctacgcgaaatttttcgcacccactacgatggtgaggttgttcgtaacatttacgtcagcgctggtcgcttggctcctgatggcgtggagcaaatcgacctcttcacccctgtgacgattaacatgaagcaacgccaaattgacagcgtcatcgatacgattcgacaaaaatttggtgtcggcgctgtctttaaaagttctagcgtcgctggtggaacgatgctaaatcgcatcggattagttggtggccacaatggcggtaacgcttatggatgatgatatcgatatttttgcccaagctgcccgcttcttcgcgcatgactatcatgaaagaggcatggtgaaatggcaaggctactacctatctgaccacactgaagatgttcataaaaaccaattggctgcggcgcaggcggccacccgacgacgaatgccagaaatggatttagcagccattaccgcgttactttttgatgcgtacggacggcatgaaattgtccatgtgcaaccaaatttcagtgctactgatggtgtggtgcctgaaatcattaccggcttagtcacgggttacactgagtcagccgtaattatcggcaatgctcatatcccgctcgaccaattatggtgggctagcaaatgacgatatggtggctctttaggcttgttaagcgcaaaaaatcccggttcatgcaaacacacgaaccgggattttttaatattgtttaatcttccacttgatcaggatgattttcagcaaattcaacttctttacgttcttcttcatgcgctaaatcagctaaatggcgacgtgaccagcgatatgcaatcaacacaacaatcaataacgcgatggccgctgcttgaatcaatacgccaatcgtatcagcatgatataccaataaattacgcaataaagctgtaataccaatatacataaaattctgtaatgaaatacgatcttgcacaaaatactcttttgttaagaccacgaactcgaagaacaagaacgtttccaaaatcgtttcagtcactgcgtaaaaatcaacttctaaatcggtgtgcaacaccatcgtacctaaattccaaagatccttaaaaaagaatccgaccatggcaatgcccaaaatgagcatcgccacgtctagtacaatgccataacccttctcgataaattttcgattcatatggctaccctccaggagttcttacttctaatcataacaaaccccacctaaaaagtaccgcataacttgtctcaaactatttttcaaacaattccaagccttcacgaccaatgtaaatcgcaaagataacggccgcaaccgcatcagcccaccacaaaccaaataatgctgttaacagcatgcccagcaaaaccaaggccgctaacacggcacacgccacgttacacatcgcatcttcgcgtagggattccgagccaatttgggcacctaatcgtcgcttcatcgttgtcataactggcatcaaaaccactgaagcaatcgccacaactaagccaataccactttcacccggcacttcatgttgcactaaattgataactgacgtgacgataacgtaagttgccaataataataaaattgccttcacaattttcgaagcacgtcgttcaacagtcaatacccgctcattatcagcaccatcgtattctgcccgcagacgccaaatcaacacgccccccgcgatgacttccaaaagcgcatccaagccaaaagcaatcaacaaaatcgaaccagcttgcagaccggctgaaacgcctaacacaaattcaagtgccatccaagcgattgaaatcacttccaactgaatgcccctcgctaataatttttgtttcgctatcatttcccgttcccccaaaataatacatgtcattttcttcatatattataacataactttgagaaactgtgcacaaacaaaaagtaagcgcggtaaataaaaaaacggttgttccacgtggaacaaccgcatcctattaattcatccgtgaatgtttaataccatacgttaggtacaaaatcagtcctaacacaaaccaaatagccgctgcaattaatgtttcaacgtgtaattgcgtaatcaagaagaacgtaaatacggccgacaaaatgggcaacactggataaccgggcatcttataaccatcttgtttcacatcagcacgcttacgtaatggcaaaatgcctagcgacacaaccataaaggctagtaacgttcccatattaaccagatcaaccaatttgtccaacggtaccataccgccaaagaatgctaccacaatcgttgcaattcccaacgcgcggtttggttcacccttttggtttaacttccctaaattaccgggcaatagaccatcacggccaacagcatagatcaatcgtgatgacgcataaagcatcgttgtcatcatagtgaacatcccaatcaatgcaccaattgtaataattaaggccgcccaattttgaccgacttgttgtaacgcaaacgcagccggatcagccacatttagtttggtgtagtgcaccattcctgtcagcacgaacgcgactaatccatacaatatggctgcaataatcaacgtcccaataattccaattggcatgtcgcgcttcggatttttcacctcagctgctgaagccgataaggcgtcaaatccaagaaaggcaaagaaaaccatcgacgtgccggccaagacaccttgtacaccaaatgcgccatgcaaccgcgctggaatcattggcatcaaattactgctcttaataaagaagaaccccaccacaataaaaataatgataatcgcgactttcaacaaaaccattgcgttttgaattctcttcgattccttcataccaccacgtaacattaacccaatcaacaacacaatgattaccgcaaccagattcacgtacgtcccttgggctggattgtaagctcccgacaaggccgtgggtagtttgaagactggcgctatcaaattggcaaaataggctgaccagccggttgaaactgctgcgacccccaatgcatattccaaaattagtgcccaacctagcacccaaccaacaacttcaccaaaaataacgttaccatacgaatatgctgagcccgcaaccggcatcgctgaagcagtttccgaatatgccatggccactaaccccgaaacaattgcggcaataataaaactaaagacaacgcctggaccagcggttgtcgcagcaaccgttcctggcaaaataaagattccggtcccgatgaccgcaccaattcccaagccaatcaaatctttcgcggtcaacgttttggcaaagtgttcatcactttttaaatacgccgtcaacgattccttcttaaacatccgttgccacaactgcatcctactacctcctatgaaaccaataaaaaaacacgtatcggataacaccaaagtatccgatacgtgtttaaatgagttccatggtctgcccgcagcagttagcatgtctcacacactcggatactttaccgtcatccgagtgtccaacgcaaaataactttacgattgtttcggatgactaaccgaagaaaaacgtaaagttgaaaaacgcttgcgttgttgacaggtgcatttgcatgaatttcatttccttttctaattgtttaggttttaactccctaatcataagtgaggaattaaatttcgtcaaccatttctcagtaaatactcatactgactatttgtaactgcctcggaacaccttagaaatcggataatggcgcgaacagttggaaaaagcatataatgttaagtaagtattctaaataactgaggtggtttcatgtcgatccgcacatatcataatgcgcaagtctacgatgttgcgcaagcgaaattcattcctaattcatggttctcagttgatttaacaaccgggcgtattacggctaccggtactggcgctacgcctgccgatgctcaagaacttgttgatttaaataacaagttcatcacgcctggtatgatcaacacccacgttcacatcattaataaagtcttcccatacgggccaaaagcctcacgcgaacccttcgaaattgcaatgcaagcccaagctaacttaaatgaaatgttagcttcaggggtgacatacacccgtgttctggcaactgcgcaaagcttcgatattggtatgcaaaaaatgacgctgaatggtcaatggcgtggcactggcgttgtcgcatctggtcgtgctttctcaaccattggtggccacgcttccaagattggtgaagctttgtctggtccagaagaattccgggccggtgtccgccgtcggattgaacaaggtgcccatgcgattaagtacatggcgtcaggtggtattgcgtttgatcaattcgagcaacctgatatgccacaaatgacggaagctgaaatggctgctggcgttgacgtggcacaccgtcgcggcatcaaggttgcggcgcacgcggaagctttgcaaactgttaaggaagccttgcgcgccggcgttgattcggttgagcacgcttttgtgattgacgatgaggcactcgaattattccaatcaacgggtacatatttaacgccaacattagtggctccttatgtcatcatcaagcgcggtgatggtttgttgccacagtggatggtcgacaaagcctacaagtgggttgattcacactttgcagcctttggtaaagcagcaaagaatggcgttaatttggcactgggtactgatgctggttcaccattgaacggttatgccgacactgcccttgaggctgaactttggtcaattgccggcgcaactaacgcccaaatcttgcaggcactcttcacgaatgcagctgatttattgcaaattagtgctgattatggtgaattagttcctggcaaaatggctgatttcgtcgtctttgatgctagcccactagctgacattaaggtactccaagagccaaagcgagtggcgaagtttggtgagttcgttgacacaactggcttccaaaatccttatatcttacctttagataaaggacatttagcttattaataatagattctaaaaggtcccaaatcctccgcattttttgttcggaagatttgggacctttttatcgccatgttcgttgcattgctgagaagacagccaaagttgccttggcatccgccaaagcacggtgcttctgcttaccgatctcgacatcatacgtcgcagccaaacccgataatgaaatatcattaggattaccatttaaggccccgtggagctgttgcgtatcaaaaattttaccattcgtgtgccacttgcctaaatcatgatagcggagcccctctttgactaactgcacatccccatcaacaatcgcgtggccaacaaccggatattcgccaacaaacttcataaaccggctcaacgcccgttcttccgacaaaccgttatgaatcatatccaacgtaatccagccgtgttccccacccatggattgtgaaatgaatttaaatgacgccattccactgcccttgggcgggttattaacaatcacggaaaatttttcaatatctttaccggtggtaattttcaaagccccaatttcaataatttgattactaccgttcatctctaaatcgaaaacgacataatccttcaattctgtaaatagcattaacaatactccccgctcgtttgtttctctcaagtatacgcttcaccgacgaactcttcacttgcatttacttcaagtcagcgtaaagttaagattgtcaattatacagaacaggagattttccccatgaaatcactcgcaaagtacaataagttgcgtcgaaacttcaacatggaaagccaccgtggtctacagctcgacgaacacggtaataccgatgtttttgagggtgtccaagtcacggttttagttaaggatgatcaagcaacgatgattttcatcgattcagaggatgctgatagcgacgaagctggtcgcgcattcgttgccttcgagcacggcatgagctggtcatcgcaggagttcttcaacgcctacatggccgttcacgaaaaccccgacgaaccagctgttgcgacagcaaacggcatccaagtgacccacaaaatcgatgcaaacgggttgcacatcaaaattgtgccagcttaatttgcgcaaataaaatgaccgccaggctaaaattcctgacggtcattttatttatcacagcagctattggtcttattaatacgtaatcttcaaattcttaacaacagcttcggcttcattgaacaaaccttcaatgatgtccttaaccggacgcttgctgttaaccatacccgcaatttcgccggccatgactgaaccgttttcaacatcgccatcaaagacagcctttgaaagtgatgccatcgtcaacgattctaattccgcaaatgaagcgcctgcgttttcaagttcaagatacttggcaatcatggcattcttaattgttcgcaccggtgcgccgatacgttgtcctgttaccgctgttgccgtgtcatcagctgccaaaatcgcttgtttgaacgcatctgctaccggagtttcatcagctgccaagaaaattgtccccacttgaataccttgcgcacccaatgcgtatgcagcaactacaccacgtccgtcaccgataccaccagctgcaatcaccggaatatctatcgcgttggctacttgtggtaccaacgccattgtcgtcgtcccaccgatatgaccacctgattccatcccctcagcaacaactgcaacggcccctaaatcagccattttcttcgctaccttgacagacggaatgactggaatcaccttaacgccagctgccttgaaagccggcatataaggttttggcgtaccagccccggtcgtaactactggaacctgttcttcaataatgacatcaaccaaatctggaatattatccatcattaacatcaagttaacggcaaatggtttatcagtgccggccttaacgcgcctaatttccgcgcgcaattcttccttatcaaagccggcagatgttaacacgcctaatccaccagcatttgaaacagcaataaccaactcatgccgtgaaatacgtgccatcgatccctgaatcaacggatacttcgttcctagaatttctgcaacagttgccatgttatatgcccctttttaagtgattattgtttaatgtatcacataaactaaaacaaccccaaattatctgaataacaatcagataatctgaggattcatcttactactttttacatcattaacaggtgaatcaagccaagcgctagcaatacctgaatcacaccaatgaccaaaccaaaactcaggaagcgaacccccgaattcttgataattgaccattttaggctcaacccaatgccagccaaattaatgaccccgaagaaacttgccaattccttggcgacagcgactaccggtgctggcaagccaatcatcgtattcaccaacataaagatgacaaaggccgtgacgaaccatggcatcatgcgccaaaatggctttgctggtgccatcacagcttcttgttgcgtttgtccacgacgactcatcttcgtaaaggccataaccacaaaggccaacaataccacgcggagcatcttaaacaatgttgcgtacgttccagtcgcatcattgaccatcaaaccagcgccaacagcttgaccaaccgattgtaacgtaccaccaatcaaagcacccgataataaatcattgtgacctagaatagccggtccgatggttggcaaaatcagcaacagtgccacaccagtcaacgacacggtcgcagcagcggtccggcgttgcgtatcattagcgccaatcaccggcgaaacggcagcaatcgcgctcgtgccacacactgcattacctgcacccatcaacattgctgactcagatgacaccttaaaaaagcgcccaccgagccacatgacaattaaaattgtggccgtcatctgcaacacaataaacaaaatcccttgccagcctaactgctcaaccgtcctaagcgtgaccgttaacccaagaaaagcaatgccaaattgaataaaatacttttccgaccaatcgaccccggggttccagatttgctgacgaaaggcagtattcccaatcacaattcctaacaacatggcgatgccttccgcacccaaaaacggtagtaatggggttaaccactctgcaacgactgcgagggcaaccgtcaggccaatacctggcaacatctctctagtaactcgcatcgcaattacctcctttatttacaaccagttgttaacctagttcctttttccacgtatattttatcaaaataaaaaaatacggtccaaccaaacattttgattggaccgcaccaattagttgcgctaattaatatagtgaaacaccattatgttctgaatcaatgggtgccacattatccattagataatgttctacggcacgcttatatgattgatgactgcgcatcgcaatgcccgtcaacttgctaaactcagtcgcatttagtgcccaaacttgcgccaccgactgttttaacaagtgatcatggagcgtttgcgtcaaactaataaatcgttggaattcagcatgaccgataccgtagatacgctttaagttccccgttcgcttttcgatgttcgctaacatcaccaaaccttgcgcaaacgttgccgccgtttgcccaccaaagttatacatcgttggtgttgggtaggggtgaccatttggataggcccctgattcagcctcgtaagcatgcaacttggctaccacttggcctgccacatcaggtcgaatacctgacttcaccaaaatattaccaaattccaacatgaacgcctgcgtatgaactgtcatcgtcattatctaaatccctctctttgtactcttctcttagtcgccgaatactagtgtatggcgaacccaattagtgtacgcaaaaagttcacagaatagtacaaaaaagtgttgtttttgtgattaactcatctttagttagcgacaaaaaacgcctagcacctgcatgctagacgttcttagtcgcttatttcattaataccgtaatgaggacaatagccaacacaacctggaaaataatggtcactaaaccatagcccaagaatttcatccctgactgcttaatggtctgccactttaaattcaagccgattcccgccaagttgacaataccgaagaagcttgtaatttcgtgggccgttcctgtcaggacgtgtggcaaactgataaatgaattcaccagcatcaataccacgaacaccatcacaaaccatgggattttgacgcttgttttgggcgcagtcgcttcaattggcgtcagctttgaggcatgtcgcgccatcaaaatcacgacaaccgacaacataatgactcgcaacattttaaaaattggtgcgtatgtcaccacgtcgccaccaaccaatgaggccgttcctgatacctgaccaaccgattgtacagtaccaccaattagggcactcactagcaagtcattatgtggaaagactgccggaccaataattggcaaaacgaacaagagcaccacgccggctaacgaaaccgtcgcaacagacgtacgccgttgatcatcagtcgcgccgacggccggcgcgactgatgcgattgcacttgaaccgcacaccgcatttcccgcgcccattaacatggccgtttgtggtgcgaccttaaagacgcgaccacccagccacatcaccactaaaattgttgccaacatctgcaacaaaataaaaatgatgcccgtccagcctaatgattcaatgttctgtaacgtgacatttagtcccaaggcagcgataccaatttcaattgggtatttttcagcccacttcacaccggcaccccaccgttgctgggcaaaaacagtatttcctaatataatccctagcaccatcgccaaggcttcagcgcccaacgttggtaaccaaggtgaaacgaattttgcaacaagcgcgacagctagcgtcaacaagataccagcaatcatttgtcgttttatggccataattaatgacgtctcccactaaataaactctgctatccagtgtacgcctcttttatcgtttgtgctgatagattttcttcacaacgaaccgaataatagctgttaataccgctgccacaatcagtgacttaatagcgcctggccaaaatgaatcagcgtggaaaacaatcgcatccgacacggcatagatcagcatgaatagtaagctgacccaatctacatattttgtcatacctttcacccctaaagcgttaacttagctcaagttacgctgcatatgtgtgtagtggtgcgcaccaatcatgagttcgcccactgcgacaaacccttcgcgttcatacaacgcgcgggcctttggattaccatcatcaacatttaagccaatgaccgtttcaccttgtgctgccaccacttctggcaaagccgccagcaattgcgtaccgacacctttaccgcgtgctgattcagcaactgaaattgagtcgagataccactcatcgggcaacgtctcaacatctgggaacagttctgctaattcaccaaaccgttccgctagcaatcgttgcatcgttaaatccaaatgtggctcgctagctgacggatagccaaacgccacccccacaatagccccacctaattcagcgaccgttgcgtgcgtatgcgaatagcgggccgtgtcatcagccaaggcactatcatgcaataattgttcgatattatcgcgtcctaacttggctaccattggaatttccatttggtcaataatcgtcatttctaagtgcacaatggttgctgtatcagccactgttgctggtctaattgtaatcatgtttaaatcctcccccatctttgttactagtctactggctttaagggggaattaccactttcatttggtaaacaccttgaaaggcaactcaaaaccctttaatatgttattgtcccagtttggatttgcggaagatcgagccgcacgaatgaaaatataaggttaaagaaaggaattttgacatggttaaagcaaagtcagcttactggcaaggcgttgtcgacgaagcacaacagcaccctaaggcggccgggattgagaagaccccattcttctcacttgccccaatggaagccgtaacggatactgttttccgtcgcgttgttgataaagccgctgcgcctgatgtttactacacggagttcactaacgcccgtagtattacacacccaaaagctaagtttactgtacaaggtcgcctacacgttgataagagcgaaaaggtgccagttgtgcaaatctggggaaaccgtggtgaagacttcgaaaagtcatcccttgaattgcgtgatcgtggatacaatgccattgatttgaacatgggttgtccggattcaacagttattaagaacggaggcggatcagatttgattcgtcactacgagtcagcacaagaagtgattcaagctgccaagacggcaggcttgcccgtttctgttaagacgcgtttgggcttcaatgatttggaaacattccgcgagtggattccattccttttgaagcaagatattcaagttttgacggttcacttacgtacacgtaaggaaatgtcaaaggtgcctgctcactacgagtacatcgatgaaatcgttaagatgcgtgatgaaattgcaccagacacattgttgcaaatcaacggtgatgttaagactcgtcaagaagggctggaattggttcgccaacaccctggtgtcgatggtgtcatgattggtcgtggtgttttcgaaaacccatttgcctttgaaatcatgcctgctgatcacacgttggatcaaacccttgaattgctccgtttgcaattggatttgtacgatgagttcacggctgaatttgggccaatgaacttccaaaagttgaagcgtttcttcaagatttacgtccgtaactttgcgtacgcttcagatttgcgtgttgccctaatggataccaacacgactgacgaagttcgcgcacttttggccgaattcgacaagcaatgggcggctaagaaagctgccgacgctgttgcaattgaagctaattaattaataaatcccccagcgcatgcactgggggatttattgtatcttcagaaaggtcattacctatgcaattacaaactggtgatttaatttttgttggtgtcacagacaccgacgacttctctcaacgcatcgcagcgagcacacatcgcgagaccgctgttgactacacccatatcgggcttgtcgagaaaacgacagccacactcttcgtgctccacgcgtcacccgaaactggcagtacccgcgaacctttggcgaggtttttgaaccgccaaactggcgtcgccgatgtttaccgaccaacaatcagcaacgcaccctggccagcaattttacaaaatgccaaagcaatgctcggccaaccctataactggtcctttattaaatcccggcctggctattactgctctgaatatattatgaacgcctttcaaccagcccaaattttcaccgaagcgccgatgacattcggccccaacaatagcatcttacccgggtggctggattactacgctgacttgggtctaaccgtgccaaatggtgaacctggcaccaatccaaatggtcttgccaattcacctcaccttgactatctcggtcgtcttaacgacgtgaccgtggttgatgcttggtaatttgacgctggctaactggtgaccgacgcttggccgccacccctttcgcctgctctggtacataggcataccgggtgccgtgcgcagcaaataaatctgcaaaccaagcaattaaaatttgtgcgacgaccataatggtcccgaccaaattgagataaaccatcaataccaacaatgaccccagcgattgataaaagcctacgctcttaacggcaaattgtgcataaaagctaaaaccggcattcaacgcaaagagaagcaaaacttcaatcccagaaccggccacaagcgccttccaaggtaaccgtttagccggcaatgcgaagttgaacacacacatcaatacccagagcccaaatagcgcaaacaaccagctctgcttggccaatgtatctaaccatggcatatcaaacggcaatgccgcaataattgctggcatcatcgcacttgcacccatcagtacgccggccgttaacaaaatgaccatcaaccatagaaaactaaagacccgagttagcataccactaacccgttctggcacatcatgaaccgcattaaacgctttacgaataaccgccaacactgaactagcaccccaaatcgtgatcacgattgagaatgacaaaattcccacaccaccacttaggaccgatgtaataatcggtccaagaatcgacatgatgtttttaggcaattgttcccgcaacatactattgagttcctgggcattaatgccgaccagcccggcgatggctcccacactcatcaaaaccggcaccaacgataataatgtatagtatgtaatcgttggcccgaccatattgagattagcccggctcaaatacgtctggagcgccggcacctgaaattgtttcttcagtaacgcgagatcaaccaaaaatctacgcataagcatccccctaactgtccttttgattaagtatcgcaaggttgcccagggcgggtcaatgattatgtattttggtttgccaagttggttacacagaaaaacggtctgaatgtttcacatgaaacatccagaccgtttttcattgttgtcgattatctttgacgtaattccaaaagctccccaaagctgaaattaaatcaatgccgggcaaaattgcgataaagacccactttgaaaatggatctgttggtcgaaaaataataaaccaaacaatatcaattagcaattgcaccagtaattgttttggtgttgctcgaaaaaacgacttaccaaaagcccctatcatagtatccccttaatcagagccacttcgccaaaaacgctgccttttcatcggtgaattctggcgacatgtagtctgccggtccgtgtcctgttccctcaactaaatgcaacactgccttgtcttcagaaacaaactcacgggctccgttaatcatatttactgtctgttgataaggtaccacagcatcagccgttcctgcaaatgccaaaataggtggcatctctgcgttgaagtacatcttaggactgtacatcttcacacgttgtggaacgtctttgggtgcttgttgattaaacatttgtccctcgaacgactcagccgtacccgtttcagcatacttaggcgtaacgccactctcattgaattggtcaacaaattgatcaaattcgtatggcccatacatcgcaataatggcattaaccgtctctggttgattattgttatcacccataaatgggttttgcaacgcgtcaacagacgctgttacgccggtcatcacggccaagtgggcacctgaagattcacccatcaacgcaacacgattcatgtccaattgatattcatctgcatgcgcacgcaagaagcgcaaggctgccttaatttcataaatttggaatgggaaatccttttgatgaattaacgaatagtccacactaacaacggcataacccttatccagcaaacgcaaagccggttccaatttatgtgaactcttgtcaccgaaaatcaaaccgccaccataaatatcaacaattaccgggaaaggcccttgtccttcattaggcaagtacacatcaagcgtgtggcgctcaccatccatgtaagcaatatcgtgccattgttgcttaatgtaagccgtctcagcttcaattttcttataatcgcgatcaataaacttgtctgtcatatcagtccactcatttctctaggcataataaaaaaggtagctgcatatctgcatctaccttttatcatacactattttaatctttaactcggcgactaagggcaatcataatgacaaaccaagctagtgccagaagtgttgtgggcatcgttgatttcgtgaacaacaaaatcataaagataccaaacaagaatgctaacgttaggtaatccgtaaatggtgcaccaggcattaggaagcgcttctcaccattcttaaaatcagctgattggcggtaacgcaagtgagcaaacaccaacacgccgtagataaccacgaaggctgctgaggccactgatgtcaccaaatcgaaagcatttgatgggaagaatacgttcaccaagacagccaaggcaatcaagacagctgacacgttgatggcgttacgtggaatgtaacggcggttcaacttaccaacatagcccttaccatttgataacgagaacaacatccgacccgtcgtaaacaatgaactattcaatgacgaggctgccgcagtcaacacgacgaagttaataatgccggctgccgccgtaatcccgatacctgagaacacttgcacgaatggtgattcacttgcactgtagttcgtccaaggttggatactcataattgcaactaaggcacctacgtagaaaatcaagattcgaataataattgaattgattgactttggaatcgttgtcaacggatcctttgcttcagcggctgtcataccaacgaactcaattcccaaaaaggcgaagaataccatttggaaggccgctagcaacttgtgcccgtgatgtgcaatgacaccgtgttgccacaagttcgacaagcttgtcacgccggctgacgttttcgcatgcgtcacaatcataataattccagcaacaatcatcgccacaatcgcaacgattttaatcattgaaaaccagaattcggtctcaccaaacgccgaaactgcgatgacgttgatgccataaagcgcaaccaggaagatgatttcccaaatccaaaccggaatacctgggaaccagaacttcatatacgttcccacggccgttaactcagccatggcaatcgtaatccaaccgatccaatacgtccaaccaatgacgaatcccgcttttttaccaagatacttttccacgaacccgacaaaggttggcttgtccggatcagtcaaaagtaactctcctagcgcacgcatcatccagaacataaagagtcctgtaacaatgtatacaagcaaaatggcaggccctgctgtgctaattgaatgtcccgctcctaagaacaatccagttccgattgttccaccaagcgcgatcatttcaacgtgacgactagataggcctcgctctagcttctgctgtgaagcttcttgctgtgccataataacactcgctttctatatttatttctaatttacaatctcagcccctactgggatgtttttttacaacacttaatctagtatataagaattcccccatttttcaatattccttaccatttacatgagtgaaatttaatcattctcatgtacgtcagccacaaaaaaagagagtgagacgaaaggcgctttggacccgatgataacgtcgtttgacccgcttatgccttggagcgtagcgtagaggcatgagtgggtcaaatggcgttatattaaggattcagcctttcggaacacgtttaaaaagccgccaatcctccgattttaaatcgggagattggcggctcttttgaggctgagacagagacttctgttccagcctcttgattaataattgtttagtaatttggtcctgggaaatcgtctggtgtcaatgaatccaaacgttgcaataagcgacgcaaaatacccttctccgtcattgctgcccacataccttccaagcgacgctcaccgtaaatgacaactgatgccacggcgcgcacatcacggaagtctgaaccagtacgtgaaatttcatccacttcttcttcaggcaactcttggtgacccttttgcttcaacgtgcgatcaaaattcttgtcgaagaaatctgaccattcaaacgcctttgccaactcgatcatacgagggtcgtattgtgggtggccatctgcgacagcacccattacccaaggaatttccttgccttcaatttctgccaaaaaggcatcccacttcttaaaatcaaaagggtgttcctttgccatttgttgcctccttcttttgacgagcgtgttcgacaactaggtcgacctctcgatatcacgaaagctattgtaacactttacttccttttagtcagtaaataagactagtctacataccgttctgggaacagcgttgctaatggaaccggcacttgaatcgtttcttcgtggtcatctaccgccaacgttaagtcagtccgggtccaatttttaacccgaatacccacaaccattgcttcggcaacaagcttcgcaaactggccagtaccaaacaacgctgcaaattgcgcatcatgttcagttcggaacaactcataacgctgattacctaattcagttgcccattcctggagcgcttccggcgtaccagccgtcgcaataatccgagcagccggcgtcttagcaggcgtcaaaatacgctcagccaccaatgatagcccatcattaaaccgcatgccaaaatgatctgccagttgcgaaatctcactcataattgtcatggcgtctgccttgttaggcaatggacttacaggactttgcagcgcgatttgattggccaacgaatcactttgaattaactcagttgctgagtactcacggtcgctcatgacaaaatgcaacaatagtaaatgaatcaaattcagggcgttttcagaaataccagccggatcaaacggatcagcatctaaaattcgcaattccaaatattcaaccccgtgttgcaacatatcatcgtagtcttcacgacctttaaagcgcaccgtgccataaaattcatgatttgagaataattcaccacgtgcaatatgcgttttaatttgattaaagtgatctgccaagttcgtagcataatcaacccgaatgttaccatcgttggcaaacccaaattgactggttcgaattgaacgtaccggctggtccatgcgaggcacccgcgaatcagtatcattcatgctgaacggcgcagccccaaacagataaacaaataaccaacggtgcgccgcaatttgttgcgccaatttaaagtagacggcatttttaaacgtcacataatccgcttcatcactcaatgcaaacaacttttccaacaacgtttctggcaaagaataattcaaatgcaagcccgtaataatctcatgcgttgacccatatttcttagccagccagtcccggtaatcttgcatccaaggtcgatcgaacgtttcatcaacccactgcaaatcatccgccgttaacttaggtggcatgcttaatggccaaatcgtctcggaccccgacatatgatcccgcatgacccattgtaactgcaacaaaaaatcccgagctgcttcaaacgagccaaccggttccgttaccaattcagattgcgtctcactatagtcggtctgtaaataagggtgcgttgtccgtgagcccaaactcgcgggatatgttcgccgacttaaccgaccctcggcagtcacccggtgttgttcaatttctatgccaaactggccaccactcaactcacgatataagttattttcagcaattaatttgccaatttccaaatggttttctgccatttcacacatctaactttcatttagtatttaaaaactattataaacaaatgagacaattttaacagcctttttgtcgtgtccctttttatttgtcccaattcagaaaagcgcttatgattagccttgaaattagacgaatggagtcagcactatgaagattggaatcatcggcgcaaccggaatggccggttcagcgttcgttattgaaggttaccaacgtgggcaccaagtaacggcaattacccgttcagctagcaaggtaacacgtatgtttggaaacgaaattccagccctagaacgccaaaactttgaattgactcgtgaagacttgacgcaattcgacgtaatcgtcgttgcctcaacgttctcacgcgccagcgatcaccctcgctttgctgagtacctacacgaccaattggccggcacagacgccccaatcgtggtctttgtggttggttcatcaacattgcaaatgcctgacggttcagtcatggctgaccgtttgggtctaatgcgtggtcaagcaccttggattgaagttgccattgagcaagctgccgagtttaactacttgaagacggttgatgattttgcctggatggcaatttcaccacaacaagccttcatgccaggccctgcaacaccaacatacttgaagtcagatgatgcattgatttttaacaaccgtcaagaatcacgtgtgacgactggtactttggccaaggccttgtacgatgagttggcaaacccaacccacgttcacggtcgcttcactgccgccgataagttttaacaattaacacgaaattactgttcaaaaatcatataaatcctaatataatccaaatccatacaagaacagtaaaaaggcgtcgagcaatgctcggcgccttttcgttatgcttagaactttccgttggtgtttgcccactctgattcagcgggaatttcttcgataatatcccagtgttcagcaatcttgccatcagcaacccggaacaaatcatagaatgcgactggcttaccaccaaattcgccatcccccaaaaccaatacaaagttaccttgaccaaggaccttaaagaccttgtcgtaaaccatcgcaacgccctgttcggccatcgcagcaaaggctgtcgttaaaccagtcaacccgtcagcgatatcgacattatgttggatgtaatcttcacccgcgatatattctggcagcttatctggattttcaccgcgcaacacgtcacgaacaaagtcagcaaccagtgccttattggcatccgtcttgtccaaatcggttacttcagttacaccatctgtttgcgtgtgccctgatggatttggtgccacaacattggccacgttgtcccagtgctcagcaatcttgtcgtcttcaaaacggaagacatctagcgcaacttgatctccactaccagcaaaattaacgatactgtgcaaaacgacatactcgccatcttcaaatgaacgaaccgtcttcaacgtcgtcttaactggcgcttcttgcaaacccttaactgccgcaacgaatgcatcacgaccatccccaaaattcaaattgtgttgcttgtatgaaggcaaggcacttgcctcagccactgcaatatcaccacttacaaacgtaccaaccaatgcttttgcaatatctgtgtgtgtcatctgttttccctcccaggtgtgggtattcaataattgttttttatctatgccaataatataacgcaacgccgacaattgcataagtaggcacttcaaagtggtatagtttcgcaaaggaaacttttgtacgataatagggttaatacgaaatcattttaggagaagcacatgggctttactgttgaaatgacccctgccattgccgaaaagctcgtcacactgaatgagttgcaccgcaatcgttggcggccagacatcgttaatttattattggaaaccgacacgttacggtttggtgaattaaaaaaacaactcggcatcacgcaaaaagtgctgaccgaaaacttaaagtggcttgaagaaaatcaaatcgtcatccggacggtttaccccgaagtgccaccccgagttgaatattctttaactgaaattggcaaagaactccgcgacgtacacgaagcgatgcggatttgggccgactactacgtcacccatgccaaataaaaaatgcgttcgcagcaagctgcgagcgcatttttttgacactttaattttcttcagtaacggttggcttttcaatttgccaaagttgccaagcataaacaacaatcgtccgcacaacagcgtaaaatggcactgccaaaatcatccccggaatccccgcaatatttccggccgccaacaacaacacaataattgtcagtgggtgaatattcaacgaagcccccataattcgtgggtaaatcaaattactatcaacttgttgcacaatcaaaaccacaacaatcacccacaccgcctgcattggactttgcgtaaaggccacgaacaatgcaggtactaaaccgatgtacggcccaacgtacggaatcaagttagttaggcccgcaaaaacacctagtagcaaagcataattttgtccaatgatgaaataaccaatcgtcgtgaagacaccgacgaaaatcatttcaatcgcctgaccactgatgtattgcgcaatcgtgccattcaaacggcctaaaatttcggcaacccggccgcgggagcggtctgggaaaattttctgcagaaacggcaccaacttttgaccatcattcaacatataaatcgtcataactggtacagtaatcgcagtgattgtgacactcgtgaccgtcccgatcaacgtgctcaaactatttgcagtccctgagatgaacgtttcaccgaaattctcaatttgggtttgaattttagcaaaatccactttgacgccgatttctttaacccaactcacttggctcatatgtttaacccattgttgcatcgtttcgaccaacgctggtgcatttttcactagcttaccgacttgttcagccaaggctggcaccaacgacagcactgcggccacgattaaggccagcaataaaatcatcacaatggcaatagcaaccggtcggttaacatggtggcgcttacccactggtattttttgcaacgcttcaacgactgggtttaataagtaatataaaaatcccgatacaatcaaaggcacaaacaccgccccaatgaattttccaatcggttctagaataaaactaagctgcgttatgactaaaatcaacaacgcaaccgcgagtaattcaacggtccaaaaaagaattttagactgtttcaattgttgtaacataccgctacctcgtatttctatttgcctttcattatatcagaacatgcgacaaacgcccatttacgggcgtagtgaaaagtttcactatccaattaagtttaacctaacgcatttgtgcacgtgacagttgtcatgcgaacaaactttccacaagttatccacaggcaaactgtgtacaatataagtattaatatctcgaggcatgcattatggcattttttaactttaacggtagtcaactcagctatcaaacattcggcaatccaagcaatcccgccctcttattgctgcatggcaacaatggctcgcagcatgattttaagcggcatgttacttatttggtcccggatttttatgtgatcacacaagatgcccgcggccatggacaatcaacatcaaacactgatcatctgacgtacagcctcttagcccaagatgtcgaagccctgcgccaagaacttcatatcacgcattggcacatcgtcggctatagcgacggcgctaacctagcgttgcgctacacattggatttccccggccatactgacaccatggtcttaaacgccccaaatttaacgttgtcgggcgtccaagcgccagtcatggccctcgcaaccgggattgattggttactccgtcgcacacgctatctgagtaagtttctccatgcccgttggttgcagacacaattaatgttcgaatcaccccacattagcaaggctgatttgcgactggtgcccaaccggacattagttttagtcggtcagtttgacttcattaagcgacaacactctgaaaacattgcaaattcacttccaaatggtcagctgatggtggtaaaattccgtagtcatttattcattcaagtttccccacacgcattcacaaaaatcgtgcgtcagtttattaaggagttattcatatgaatcagaaatggcataacattcggcgagttatgattatcgccgtcgcgtttgtcgcgctatttgaattaggcgctgtcatcaaacgcatgccgttaaaaattttgttagcaattttcgctgaaatcccgattggcctattaattggtattttcgttatcggtatcctaactgccagcgtcggggttagttacaattgggcctataaacgtctgttaacccctacagattccaagcattattggctatcaagttgggtcgttaatgcgtttgataatgcctttggtgtagcggatttcgtcgtaacatggttgcaagaccgccttttcgatgacaaccgcaccgaacgcagcgcaaccttacatcgtggttggtggttatcgaccagcggtttggccgttgtcagcttgctaagtcttatcgcaaccggcatctactggtcacacactgccgttgttaattacgcaccttggctggttgttgccgtcgctttaccattcattgggttaatcgtcagtcgcttccgtcatcgtgacagcttacccttcagcgctagtgattacgcccgaattttcgccgcgtcgttagctacctgggtggctaacacagccggttttctattgatcggtgctttattccaaatgccaatcgccatctggtcagtcatgccattattcatcgctgcccggacttttggtattgtgacactcgttcctggtggttggggaacgtttgatattttcgcctttatcggcctgcaaacacttgggatggaccccgctgttattttcttatggattctgttctatcgtgtcgcttacacaattgtgccattcatcatcgcggttattatcgccgcaacgcgcgcactccgcgaaaccaaccataagttccgtggtgtacccagcgtcattgtgcgatcaatgctgcaaaaagcagtgaccgtcttactctacttttcaggtatcacattgattatcgctggtgccttaccagggacattacaatcgttccacctattgcaacatctcagcccatggacatcgggatttttgttgcaagtacccaatattttcatcgggttcatgctaattatcgctggccgtggcattgcaaataaggttagtcgcgcgtactggccaacgctaattttgttagctattagctttggctacgttgctgtttcacacgaacatatgcaacccttagttttacttggtgcgttgttcattgggacgttattcatcaagccaacgttaacccgggtgcaattcatttacagttgggaaaatcgactaattgacggtgtcatctacggtgggttgtttattgcttacctcaccattggggtcgctaatctacccgctgtctcacaccgtttccacgtgcgaacgtctgggttcttcttggtcccatcgttgcactggtggttgattggattcatcgcaattgcgattgtgagccttggtgtgcttggctttatcgcttacatgcaaggtcgcacgcaattactcggtgaagcccttgatgaggaacgcgtcaatcaagtattggcacgtggtgataatcactacaccaacctgattttccttggtgataagcgcttattctactaccggcccgaccaaagcgagacagatacggtggctatccaattccgtttggtgaacaacaaggccgccgtcatgagtgatccatttggtgatagtgctgacttccaagccgccttggccgcctttattagcgaggccgaccgcttaggctacacgccaattttctatgaggtttccgaaaagattgccatgatggtgcacgaattcggctataactttatgaaacttggagaagaagcgtgggttgatacaccatcattcaagacagctggtaagaaattcgcgaatatccgtagtgaaatcaatcaagcaactgccgctggcttcacatatgaagtgttgcagccaccattttcagacgccttgttgcaagaattgcgccaaatttctgacgaatggttgcacggtcgtgaagaaaagggttactcgcttggattcttcgacaaccactacttgcaacgtggcggtatcggcgtcttaaaggcacctgatggccacatcgtcgcctttgcaaccctggttacgtctgaaactgaaaatcaaatgaccgttgatttgatgcgtttcacaagcgaatcacccaacggaacgatggatgtgctattcgtaaagacattcgagtatgcgcgtgacgctggctacaacacgtttaatttggggatgtcacccctatccaacgtggggctccacgaacaaagtttcattcgtgaacgcgttgctaatttgatttatcaattcggttcaaagatttattcattcgagggtctccgtcattacaagcacaaatttgcgagtgattggcagccttactacatcggttattcaaaccattcaaacatcgcctttgtcatgattgcgttgttgttgattgataacccaggtgttgatttagattaaaaaaatgcgtcctcctacagctagggggacgcatttttcgtctatatcattattaaataaataaaccaatcaccaaaccgatggccaacgtcactgagatcacaacagcgttcttaatggcttgtgggaaattaggcttaattgggtttgcttgaaatgcccgggtgtttttgcgcacaatcgggaatgataccaacgccaacaaagccggccatggcaaaatacccaacacaactgacaaaatcaacatgagatatccggctaaataaatccaaccaaacaacttaactgcgcgatctttacccaaatgccaaaccaatgtgtggcgattttcagcaaggtcttcttcgtagtcaccgatgttgttcgccaacataatgtcaccaattgcgaaccacgaaattgctgacgctacgatagcgtgtaacagcaattccccgttaaagactggcgctacattgacgtatgtcgcactcaagaaaatcaagtaccccatcgtcaaaccagaggccaattcaccgaatggcgttcgtgataacggtagtggcgtaccagcataccagtacgcaaccgcaaaaccaatcagccccataatcaacaatggtatacctgtctgcgtaaccaaccaaaggccaccgacgaccacaattaacacaagaccgattaacgtcgtccaaccttcgcggggagtaatcccacccgatccaacgatattgttcacaccgttcttccactcgtcactggttgctgatttaaagtcctgcagattattccaaacattcacccccatctgcaatgcaaaggcgacaatcacaaagacaattgctggcactgcattcatgtggtgatacgtatttaccgcgtacaaattacccaagattaagggtaaagcgctagcgactaatgattgaatttcaacgaacttcaaccatgttttcaaagtcatgctcaaaacctccaaaaagtttttccgatagttcagcttacccgaagaacggcattgtcgcaagaattataccgctaaataataagtagggtaggggtgtgttgggatgcatcgcgaaaattgtatatagcaagaagttgctatataggcaaaaggggcacactttacacgtgttacatgttacagattgataaacggggcattcacctaaatttgtaaaaaattttcatattttcaacttccggcggcccccgaataactccccatgccgtttgtatgcttatacatttttatgcatattgctaatcggctatttatacattgcggactaaacacgcgaaaatcgtgtggccaaatttagtccaacgtccttactgtttgttaattgtcacatcccaactgacgattttttcctactatttttctaaacatcggcccgacaaatcaacactaaaaaaccaacccaatcaatcagcaagttgcacaattgattgggttggtttgatagtacctatttggcaacgctggttaacatccgtgtaagcacccccaacgtcaattgcgaactttctcagccatccccatcctgccagcaaaccagcgaaatggtatacctgattaaatggctttaaacacacgacgcgactcatcaactggaatgatttctgactccactgaatcaacgcgcccatatggggatggcgacactttaacaccgttaacaaaatctatcatcaccgtttcgtcagcctgcgcttcaattcgaactgatccatctgacgcattccaaacgacccctgtcacacccaatttatccgccaattgctttgtaaagtagcgaaagccaaccccttgaacgcggcctcgcacaatcacttttttcgctatcatcgtcctttacctcatctgaaaaacgacacaaaaaatcccacgggatacgtgtatcttgtgggattaattatagcctttaattacttcttagtcgtcaaatctgtatcgaaatacttctcagacaacttcttcatcgtaccatccttcaacaaagccttttccgcctttgtgatggccttggccaacttcttgtccttcttgttcaacattggtgcggctgtcgtctcgcccaaagccttagttaccttagcttgcaaatccgtctttgggtgggccttcttgtaaacgccccatgaatcttgtgagttcaatgtcacatcagccttacctgaatcaaccaaatccaacgcttccgcaaagccaggcgctgaaacaatcttagcccccttcttttgggccgtttgaccaaagtctgatgacgccgtttgtgcagccttcttccccttcaaatctgaagcgttcttgatgtctgaccccttctttgtgatcatgacagaatctgtgtacaagtatgcttgcgcaaatgtgtacgccttcttacgttctgggttaattgacatgttgttaaagaccacatcatacttcttggcattcaaaccagccaccaatgaatcgaatttcgtttgcacgaagactggcttaagcttcatttccttagctacagccttaaccaattccacttcaaacccagttaacttaccagacttattacggtatgagaaaggtgcatacgtaccttccaaaccaaccgtcaacttgcccttcgtgtgcacgctgcccttgtatgcagctgcagacgctgtcagtgttggtacggcaacaccaccgataaccccagctgcgacaagcgcaacggtcgtcttcatcatcttattcatgtctataatctcctaatgctatcccgctgccccaattaacagcgtcgatcccaaacttattgttacgactgaaacgctgactgcgacatttagtcgcatccaccaaaatcgttttgcataacgcacctgtgatacccgcatcattctcttctctttctactagctgaaacagaatgatacgcgtatcccatttttcatacaaacaaaaaaggagttgtttcggtcatttacaaataataaccaaaacaactcctaaattgcaaatcagcgaaccgatatgctcacggtcatatctttaattcgtcttactttgttggcttgtggctgtaatcagcttccaagtacttaactgagatcttcttcatctcgccgtccttgcgcatctttgcctcagcctttgtaacagccttatccaaagccgtcgccttcttgttcatcattggtgcagcacccgttacaggcatgtacttagctggtgacttaatagcaaccaacttcgtctctgggtgttccttcttgtaaacactccatgccgcagcatcgttcaacgttgcatcagccttaccgttctcaactgtcgcaactgcttcagcaaatccaggtacggcaacgttggttgaacccaacttttcagcgtacttcacatagtttccaactgctgattgggcagtcttcatacccttgatatctgtcacagacttgataccagagtccttcttcgtgacaaccacaccaccagtgtaaatgtacttagaaccataacggaacaacttcatgcgttccttattaggtgccatgtcattcaaaatgatgtcgtacttgatagcacgaagcccctcaaccaatgagtcccactttgttggtacaaagaccaccttaagacccatcttcttaccaattgccttggccatatcgacgtcgataccttccaaattaccgttcttagcacggtatgagtaaggtgcgtacgtaccttccaaaccaacagttagttgatccttgtgaacgaggccaaggtcttttgttgtatccgcattagcgattacacaccccggcgctcaacattgttcctgctgcaaatactgcagcggctagcttaatcccattaaagctgtgcttgtgcataatatcttacgccacctttcaaagtatgagcaaaatcataacccgttctcaaatcgttgtcaaactgttttgtcatagaattttaattgccagggaaatttcatcctaaaacgcttgcaataagtcagcgaaatctctacaatggacacatattaaagtcgtaaaaaaacgaaaggaccgttcccatcatgatgtcagttaacacacaaatcactgttgcttgcatcagcctagcgcgcttatcgcggtaggtcgttttggtgaactaatcatttcgatgaaccagtgagagcgtgctaggcattcctgtcgaaacagaaattagcctgcgcgctctttttttgcgcccaaacatccagaaagggaatcatcatgtttgaatttatcgctacttatgccccacaattaattgtggctggaattaagtacaccgtgccacttgcacttatttcatttgtttttgccgttatcattgccgccttagttgccgtgttacgttcatacgtgccacacgtaacgggcatcaagtcaattggttggcgcatcctcaagtttatcttgtggttctacgtctggctgttccgttcaacgccaatgctagtccaactgttcgtggtcttctatggtttgccaaagcttggtattagctggttgtcaccttcaggctgggcggcagctgtgtgggtattgtcattgaatacggctgcctacgcatctgaagccattcgtgcggcaatcacctcaattccagatacacaacgtgaagctggggcggcactcggtatgacggatgcccaaattttcattcgcatcatcttgccacaagctgcacgtatttcaattccaaccttggccaactcattcatttcattggttaaggatacgtctttggcatctgtcgtgaccattgtcgagatgttctacctctcacaacaattggccgcaaccaacttcgagcctttgcaaatgtacttgctcgtcgctgccatctacgcaattttcgtttcaatcttgtcgatcccacaacactacatccaacgttgggccgaccgtttcgtaaaggtacaggggtaattcattatgttgaagttagaacacattgataagcaatacgcagaacaccacgccttgaaggacatcaacgtaacgttcaatccacatgagacgaccgttatcgttggtccatcaggttcaggaaagtcaaccttgttgcgttctttgaacttgttggagcaccccgactcaggtttgtatacgattgacgaccgcacaattgatttgagtcaaccggttacgacggatacgttgttatgggtacgacgcaagacggggatggttttccagcaacctcgcatgttcgatcacctaaccatccttggcaacattatcgaagcacctgttcacgtgctaaagcaaaagaaagctgatgctactaagaaggcgcatgagttgttacaagctgtcgatttggataacacggctgaccgttacccttaccaactttctggtgggcaaacgcagcgtgtcgccatcgcccgtgctttggccatggaacccgattatttgttgttggatgaaccaacatcagctttggatcctgaattagaagcccaagttttacgtgtattgaacggattggctaaggaagaccaatccatgattatcgtgacacacaacatggaattcgcccgtgaagcggctgaccggatgttgttcctagaagatggcgaaattgtcttcgacggtacacctgctgaattcttcagcgaaccaaccgatcgtattaagcacttcttgaacgcgttcaagttcgaaaattaagttgactgaaaagagcactcgcagtagcgagtgctctttttgttgttaacgtgtcagtctgtcacgcaaaccaatacggctaactattttgcgtcgttaaacttggcaaacaggccataaataccggcaaccatcagcacataaagcacaatagcgacaactgtatctagccattctgcgtcacctaccattggtgacaagaagtcaacggacgctgacatcacaaccgaaaatacagccaagccaataaacaaaaccatcgctgtaatcgccacattggcccagtgtgatgatactgataggaaacggctcatccccagattggcagccaggccaatgatattaaccaatagaaacaagccaatcatgacaaacactgtgccaagaacaactttcccaataattggcatcacttctgacacattttgcggattaaatccgacaaatttcgcatttacgaacggtttaacaatcgccatgtacacaagcaacattgcaaaataaagaatggcgttcaccatcggcaccaaaaaacgaaccagcaaatttatcgtaaaaaaacggtgtttcgagactggcagcaggacaaaatgagcgtcttgccaagataaaacggcctgctttaacgccagtaacccatagacaaaatagaagaatcccagaattatcagaccttgtgtcacaatcgtccaaaccatatgaccaacggattggccccactgtgcatgaataactgccacagctaccaacaccataataccggcatagattttcaacacctgccacaatggccggtaactatctgcaattattaatttcactaattgttttgttgatgtcataactcaattcccccattgtcttctacatatcgttgcacataatattgttccaacgtcatatgctcattatcacgaatatcgtcgatggtctgatcaacaatgatatgcgcatcttttaaaatgaggacacgatcgacaaccggttctatttctgcgatttcatgtgtcgacatcaaaatcgtcgcatcctccggcacccattgaatcagtgtttgtaacaacttacgccgtgtcaggacgtcaacgccactaaacggctcatccaacatgaacaccttagcatcgcgagataccgtcaatgcaaaaatcaaccgttctaacatcccctttgataaggcagatacttgatcttgctcattgagccgaagcgttttatttacttcagtccagcgttcctgattaaaatccggataacctgcacgataaaaagccaatacatccgcaatcgtatcgcgcttacgaacccagttaaggtttgggataaaagccacggcggatttaagtgcatcgcccgttagaccatccaacgtgatatgggcccctttcttcggcaacacagcccccgcaatcaagcgcatcaatgttgtttttccaaccccattttcacccagtaccccaatgatttctggtgcgtcactctcaaagttgatgtcttgcaacactgagcgtcgaccacgcgcgtaatttaatcccgctactctaaacatgccccttactccttctgtactgacgctatagtttccgcaataatgcgccgtaactcatcttccgaaacaaacgtcaaactatttttaataaacgtttccgccatcgccctaatttttttcgttcgaatcatttcaaacgtcttttcgttcgatgttacaaagttccccaggccgcgacgcgtttcaactaaaccactctcaaccaaacggttcaccgcattttgcacagtacggccgttaatcactaacgtagccgctagttcacgaacgccaggaatctttgtattcattggatacttaccatctaagatttcccgctctaggaaatcggcgacttgaatatataatggttcactatcattaaattccatcattcgccctcctgatatagtgtagtataacactactacactaagttgcaagcgccattaaaaaagccaggctaaaattgcctgacttcgtgtcatttatctaatacttattttctaggtaactgtaactgccaacgctcattaaagaacttgcggtaagccataaaactagcaaaaactgatgaaataccagtcgcggacaacaacatgaacaccaccatgatttgatatttaatcgcatgaattggatcaacccccgccataatcaaaccggacatcatccccggcaatgagaccaaaccatacgtccgcactgaatcaattgtcggttgcatccctgttcggattgcctcgcggacaatttcacccgctgctaattttggtgatgcgcccaaagccaaccgttcaaacacttgaccttgctggtcacggaattgttgattcagactgcgataaacaagtcccaccgccgtcattgaatttcctgcgaccataccagtcactggaatcatttggtatggttcaaacttcagcacaccggttaaaaccagaatgctcatcgtgatggttgttgatagtaataagccccaccatgaaatcacaaacgctcccggaatgccttgacttcgcttttttccgttgcgggcggcgttataaataatgaatagttgcataatcagtgtcagcaaccagttatccacattgaaaataaacttcaataggtatccaacaataattaactgcacaattgcgcggacaaccgaaataattgtctctttctctaacttcaacttttgtcggtagctaatcaccaatgaaatgacaactaagataaatgctaatgctaacgaccagttactaacattaatttgactgttcatgacgtcgtgccccctctccgttttgaatcgtcaagatatcttgggcatcggcgatttcaccttcatcgtgcgtcactgataacacaattaatcgttcgcgcgcatgcaacgcatgaatcgcacgccaaataacctgcttggtctctgcatctaagcctgttgatatttcatcaagtaacaggaccttaggtggaaataatagattgcgcaacaccccaacgcgctgccgttcaccacccgacaactccgtcacagccttatctaaatagtccgccggcaaatccatctgctccaaccccgcaatttgttgctggtcattcggtgtttgttggcgcaccagataaggcaagtctagattgtcacgcaccgtttcaccaaataattgcgctgattgcgtggcatacgacacttgttggcggtaatcgccaattggtagacgcataacgtcttcatcattcaagaaaatatgcccctctgtaatatcctgcaaccccgcaatggcttttagtagggtacttttcccgccacccgacggaccaaccacggttacccaatcaccatcatgcaactcaaaactaatatcatgccaaatttgacgaccttcaacttgatagcccgcctgatcaaccactagctttgtcataaaaacctccccaaataaaaaaatgatacacaccatcctgtataccattttacacaattattctgctgtggttgttgcaatatcttgcgtcacgactggcagcatctccaaccaagtcgtttcaaataacgctttaaacaaattatcgtcccatttatctgcaaagaacgggtggtaaaaatacgtgaatgcttgcatgatggtcataccacgttgatgacggaatgtatcccaagccatgatattttcaaccgcagccgcaaagtcctgtagtcgtgggtcaatcaaaacactgcgatcggcaagttgttcctcatagaacgccatcatttccggttcgcggctaaacccttcccgccggcgcgaggccaatagccatagccaatcatgcaacgcggtctcccgttcctcctcaggcgcccggacattggcagcccacaccggtccatccacttgttcgagccaatctgtattcatcgactcaaacagtgcttctttattggcaaaatgcttgtacaacgccgctggtgtaatctccagtcgacgtgccacatccgccaatcttgatttttcaaagcctttttcagctaaaacttgtcgtgcagcgtcaaagatagattctgttgtaacctttgccatggcgctccgcctcctttgttttggcaacaattaactgccttgctttctacattataatcgaaccttaaaaaagtgcctaatcttttcaacttatttatatttttggtatagtggataagtagttatttgcttatttttagcaagtagcagagagagtcgcatggttgtttatgatttaaacaacactaatttaataggagtgtgaacaaaatggcaatttcatcattgactgacacatacacgctttcaaacggcgttaagattcctgtcgtaggatttggaacttggcaaacgcctgatggtgacgtggcttaccaaagcacgattgatgctttggctgctggctaccgtcacatcgatacggccgccgcttacggtaacgaagaatcaatcggtcgtgctttgaaggattcaggcatcgcccgcgaagaaatcttcgtaacgtcaaagttgtggaacgacatgcacggttacgagtctgctaagcaagccttggatgacacattgaagcgtttggacttggactacttggatctttacttgatccactggccaaacccaaaggctaaccgtgacaactgggccgaagcaaatgccgaaacatggcgtgctatggaagaagcctacgaagctggtaaggttcgtgccatcggaatttcaaacttccaagttcaccacttcgaagagttgttgaagacggctaaggtaacgcctatggttaaccaattgtttgttaacccttctgacatggaagacgaaatcgtggctttcaacaacgagcacaacgttttgacggaagcttactcaccattgggaacgggtaagatgttgacggttgccgcaattcaagaaattgctgacaagtacaacaagtcagttgcgcaaatcgcattgcgttggtcattgcaacacggcttcttgccattgccaaagtcaacgcacaaggagcgcattatcgaaaacggtcaactctttgactttgagttgacggctgatgatatggctgccttggacaagcttgaaggcgtagctggttcacacaacgacgctgacaagacgaacttctaatttactagacaaaaacaccctggctgaacgactcggccagggtgttttcgtgttaaggaacgattcaatctcggaatcattcacgtgacataaagcagatctctcaccaactacttcatatcgttcagtatttatttcttagtgcgtagcgcaactgagatgccacctacagcaagcaaaacaacagttgccaatacgatatccaagctaacttggaccattgatgcgttaccctcaaggctcaacaagtacatcaagccaattacaagagcgaccgttacaacaccaaaaattgctgatgccttcaaagacatcgcgtacttcatatcttgcacgataaaaacctctctcaacatatatctcacacgagtatctattataaccgttacttactattattcaagaggaaacggcaaaacccgtccacaaaaatggataacattgttaactaattataagcacgacttatatgttccatgtgaaacaaaaaggtgacgcatcaccttagcaatgcgtcaccttaattaatcttgtttaaattgcgttgcgacgtattcctgatacaacttatgtgttgcaacaagttcttggtgtgtacccgatccgctcacatggccttgctcaataaagtaaatattatctgcatcgacaatggtactcaatcggtgagcaatcaccaatgttgtccgtcctctcatcaaagactccagtgccttttgaaccatcgcttcagactctgaatcaaggctagcggttgcctcatcaagcatcaaaatcttaggatcgcgcaagaatgcccgcgcaattgccaaacgctgacgttgcccaccagacactttgacaccgcgttcgccaacttcagtatcaagccccgctggcatatcacggacaaacttctccgcaaacgccaaaccaagcacccgccacaaatcatcatcggtatagtcacctgccaatccataggttaaattatgccgaatcgttcctgccataatcgcagagtcttgactaacgaaaccaatttgggcacgccaatctgccaattgcacatcctgtacattcgtcgtaccaatactgatttgtccggccgttggctcatagtaccgttctagcaaaccaaaaagcgttgattttccacccccggaaggaccagcaaaagcgaccaccgtgttaggctttgcttcaaatgagacatccgtcagaatttgcttactgtcgtcataggcaaagtcaacatgcttcatagccaacgtctgcccttcaacatccataaccgcaccttgactaaaatcttcttccggctctgccaatagcgtttgcacacgctcagtcgaaccgctggccttagctaaatctgaaaagaattggcccagtgttgcagcggggcccaacagttggaaaagatacatcaagaatgagaacatcgtgcccattgtcatgctgccttgtgcgacacggtgagcaccataaccaagcacacccacaaacaagcccatcatcacggcggtcataagcggaccagcaattgaatcatagacggcctctcggagaccaatctgatacaactttttgattgtcgtgtgacctttggtcgtctcaaacgattcagcattcgacgacttaactagccgaatttcgctgagtgtttcaccggcctcaccattaaaatcagctaacgcattttggcgatcacgaccaattttatgtgactgacgcatcactggcatcatcacgagcatgaccaacggaattgctaacgccataattgctgtcatccgccaatccttaatgaccatcaatgtgagcgcacccacaaccgttagtaacgatgtcatcatacgtggaaatgaattagccaacaaatctttaatttgggttgaatcattaatcaaacgtgacgtcatttcccccgctttcgtgtcatcaaaataactgacccgcaagcgaatgagtttatcccacaaattattacgcaatcgactgacaacattttcaccaaaaatcccgagtaccgtgcctgataccgcactaataactgcgctcaagataaacatgccgataacacttgccaacaatgttttgttaattgccttaccaaagccgttaatcaaatcacccgctaaatgcggtacggccaattgaattcccgttgcaaccacacccaaacccaagccaagcgctaactgccaataagctggttttgtctgacgcaccaacgccataaatgctttcatgttaaacttcgctggtcgcgtatagggtgtatcacgatcgatttcacgattatccatgattaaatatcctcatcctcacctttggtggtcttattgttgcgattaaaccagccagcaaacggaaaatcaccatgcccgtcatggcgcatttgatgcatttggcgatgcatatcgcgccccatgtgatgcatgtcatgcatccccttaaactgatcaccaaatgcgccaaaagcctcgcgcatttcttcgggcgtaacttgaatgtcttctacgttagccgcaactcggcgcaacaatgactgcaactgttcttgctcagcaccagttaagacgttaaaggcacgttcactcaatgaatcgttgccattatgcaaaccagctaacgtttcttcaccaagcgttgtaataaaaattaacgatacccgaccgtcggtttctgaggctcgtcgttccgccattccagcgtcaaccaacgctttcacttgcaagctaactgagcttggtcgaatatccaacttttctgcaatttcggcattcgtaatgccgtcagtttttcccaacaatgacaataatcgtagtcgacctcgacccagattttcatcactattgcgcttcgtgcgattgttgagtgccatcgccgtcataaaatagcgagattgcagcaatcgtccaaacgttgccatcaagtcttgtgtttcatctgtcataatttaatttgcctcttttattttcaataaatatatcgttaggttttactttggttaacctaacgaaaaagaagtataaactgttagttaggtttagtcaacacaaacctaacaattaatcaaaaaaagcgactaacgccgaaacgtcagtcacttttttactagtcttcacgcaaccaaaccgcgtctgattgctcattatcattaatcacttgatgcactgttttttgggcttggggcacaaacatcaacggttctgggttaaccggcacatactgcacatgcaaggtttcatccccgtcttcctgcaattcgccggtcactaaagtcacttcaaaccccatcgccaatgtttcttgggcatcaccccaccgattttcagcaacaatttcagaagaaatcccaatcaaacgtttcacttgcaccgttagtcccgtttcttccttgaattcacgcacaatggcctgttgcggggtctcgccgtactccacgtaaccacccgggaagccccagcccttttggatatcagaccgcttttctaataagatagcgcgccgatcttctgaccacaatacaccaaaaactgtattgaaaatcatgccttcatgaccaacctttgcccgcatgcgcgcaatataattctgttctgccataatcaatcttcccccttattactagttatttaaccactacctggcaaaataacaagtccttaacgacgaagatgatgaaacaagctattcaaataagtgacggcgtaataaattcctgccggtacaacaatgatccccgcaatcaagacactaaaatgctgctggaagaatggaattgaacccagataatacccaattagcgttgatccaagcacccaaattaaggcgccaattatattttgacgttgaaaagttgcttgatcatatcgactttcaccagcaattaatggaataaaaataccaaggaccggaatatatcgcccaaataacatggctaatttagcatgctgattaaagaaatcaacggtatcatccatacgacgattgcgtgtattatgagctaatccacgtcggaatttaaagcgccagcccagatagaccactggcaaatagcctaaccataaccaccataattggattgggatttcttgatgcgccgctaaacttcccgccaaaaacatggtcgtttctgcggggagccatgcaaacaggacaaagtaactttcaaaaccaacaattgcccataaaacggggtagaccaaccaagggttcatcataatcggctttataaagagcactggattacgaataatcgcgagcacatctgttagctcaatcatccgttacagtccaatcatctggcaacacggtcataaagctaatgtatgttgtgatggtgtgctcatacccattattgccatcattcgccatgtgttggaacaactttgcatacacaggatgtgtcttaacataggccataacattcgccgtccgggctgggatttctaacccttgagcgcccaacatcaaatcttgcacccattgatagggggtcatcgtaccgccatcccaccacggcgtctccgcgtgataaaaatcgcggacacttggcgccaaagcataatacaactgttgtccccgttccaacttcgcctcatcttcaactaagtcgccaccgaacggccgaccattaatgcgctcaaattctgttcgaaccgcgtcataagctgacagcggtaagatatgttgttgcccaatatgggtaaagccccatgcttccaatggaaaagttggtgcaacatcaagcggattaataattgcatggacttgtgggtacgcgtccgcataatcttcatttgcaacctgcttgtaagttgtcgttggcgcaaacgcgtatgcataaactgctgtttcacccgcgtcaaccaacaatttgccgacaacctctgtcgcactaccgccacgcgaatgacccgttacccagaacacattttgctgttccggatcaccttctgtcagcataaaatcacgtaattgagccgccaccttttggccgatgaaaatcatattattcatgcctggcgcatcatcatcgccaatcatgaaatcaccagaccattctgcactttgtggcgttcctcgaataatcgcagcgaacaaattcatatcgggcaatcgcttaacacctaacgtgaaggccacattattcggatcatctgcaatgccatagttaaagtcactcgtcgtaaagcctaacttttgtaggtttgccgccgcatagccggttcccaccggttgactgtccttggtatacgttgaaccagccatcacgacactaacccgcgctaaatcatgctgatattgtttactatcttgtcgaaacaagtcatccgtatacggaacatctagctcacgtgcgctaggcgtcgcatttccgttatgacttgttgtaaatgttaatgccaccatgccatctcacctccgaattttttgtctctctgtggtcattatacattaaggacgttaaacgtcaccgccattaactacgttgccagtagaaaaaaggctaagacagaaatctctgtcttagccccaaaatgtcttttgtctcacacttcttttatcgttactttgctggtgtcgttggtacctcaacatcaccagccacgattgccgctttagctgatgcaacggtatccttttcttgcgcattcaagttcttagtcacgattgaaacaccattttgcttcaatcccaagacaatatgcttaccacctgggaagttgccggccttggccttatctgcaatcatggccaagccagttccgacacccttaaccgatgacgtcaacgtgaaattgctcttctcgccatccttggccgtataatcacccatatcagactggtccatatcaacaccaattacccaaactttttgcttggcatcagcatcaaccgtcacattattatccttggctgccgtaaagacaccgtttccagctggtccagccgcgtggaaaattacttgctcaccctttgtaatcatggcattcgcaattgtctttcccttcgctgcatcagtaaatgaatttgcgtattgcacatcaaccgtcatctttggatctaccgacttaacgcccgccacatagccggcctcaaaggcatcaatcacggcaccacgttggccaccaacaaagccaactgcattgtcgcccagctcttgcgccttagttgcagctgcaactccgaccaagtaagatgattcctctgacttgaacgtaaccgaagccacgttcttgtacttactgtcaaccacatcatcaatctgtaggaacttcgtgttttcatgctgcttagctgcattggtcaacgcatccttcgttgcataaccaacgccagcaactaggttgtagtcaccttcaacggcctgtgaaaagtttggggcaaaatcggcggctgtctttgactcaaagtacgtgtaaccacccttgccttcagccaacttattttccttaccccacttttgcaaaccttcccatgcactttggttaaatgacttatcatctacgccaccaacgtctgtcaccatcgcaactgagaattgcttttccgtatcggcatctccgacaatacctgattgataaacgccaacaccaaccgctgcaatcgccaatacggcaccaaacaacttaacacgacctgaaaccattttaaattcctccatagatgcctaccctcactgtgataggacttgaatagttccgggtttcccaaaacgactcgtggtttttgacacgttcctttcgaacaaccgtatataatcgtatattaaacaaccagtcactgcaatttgttcgtgttgaacaaattgtgaagaatgtgaacattcgcggaactccccaccgagactgacttagcgcatgcttttttaacaatcaacaaaacccgaaggacacttatttttcgtgtacttcgggttttaatcgtttttattacggcgcgagcaactgtcgttcgcagaattattgccgtttcgtcacattcataatcacaatcgtgcccaacgtcaacacaattcccacgacttggaatgcctgaaattgtacgcctaatagcaacgctgataggaccgttgcacttagtggctccaacatgcctagcatacccaccgtttctggtgccactttgcgcaaactagcgatgtaccaaacaaacgccacaattgagccaaagacgacgataaagaataatagcgttaaatcaatcgcatcaaagtggtaggctgggtggtacaacggcgcataaaaattagctgccaaaccaccaataaacatcccccaaccaactaccaaaattgcatcatattgttgcaataatctacccggaatcaatgtataagcaaccaagccgattgcggatagaataccaaacaacaatgttttgtcattaatttctagacgggtcaaattaccattcgtcactagtaagacaatgccgaccagcgaaagcacgaccgcaatcacttcttgtcgacgcggccatgtttgccgaaaaattgccagaaagataacaatcaatgccggtgccatatactgcaacacagttgccaccgccgcattaccataatagagcgtccgaacaaaattagattgcgcaaaataaataccaatcaaactaaacgccaacaagataccggcattcttgggactccgccaaattttaaaaatattctggcgtcgtagcaatgaataaattaataaaacaatacctgaaataaataaccgtaccgtcgttagccaatccggtgatacgttgattctttcaaacaggatatttgaaagaattccgttaatcccccaaaatagggccccgccagcagccatgccgacataccacttcttactcacacgcccaccacctaacttattaaaataaagtctaatgttgccagtatagcactaaaaaagacaggttaattagcaaattaaagcttccaattaatctgtctttttcatctatcgtttaaatgaccggccaacaataacaacaacgatactcaaccacccacctatgctcagccaaatgagtggccaaacataacctgctggccgataactaacctggatttcattctgacccagttgtggcacaacgcgtagtgcaccaattcgtgattgcgttggctgcgttaatcgccggccattcagcgtgacttgtgaatgtttgtaaataatcactggcaacgtcgccttgtgtgttgtggttgcccgccaagtcaacgtcatccgatctgacgcctgtttgacatttacatgaatcggattatttataatttcctgcatataacgatcatatgcattatcactggcacgaagcccatgattaacaacatagtccggcgttgctttttgaacatcctgcaagccagtcgccaatgggccatagcgccaatcggacgcaatttgcattggtgttttgtctgggttgaattggacatgcttcgtatttttaactagttgcgtggtatgcaagcgatgtgcattcttagcaagcatgttacttgagattgcaacggggacaaggaccacaacaatcgcaatcacgatttttgtgctgcgccgaatgcgactcgtaatcacgaccattgatagtaatcgtgctaacaaaaccaccagcgctaaattactgaccaccgctaagcgtgatggaaattgcatcgtatttacaatggtgggcattaattgctgaacgacatgccaggggaattctgccaacgataagacaaagaataacgccgccagcactagcatcacgcgatattcacgttgtaatttttgataaaccaacgtgctcccgataaaaataaccaccacccacaaagccagcacactgtaattacgtagacttggcaagcgatcaaaggcaacatgcatccccttttgaccaatatcagccggcgtaaacggcgtcaaaatccgatttgttcccatcacatcaagcatgccaacaattacattggcactcaagattgcatataacccgattgcgcataccaggcgaactagcaattgccgaataaccgaccacggttgtttcatgatgctaatcacgaaaaaaattgccaagaccaatgtggctagtaaggatgtaaataaatgtgattgggttattaccgctaacgatacagctaacccaatccatgaaaacgttgttggttgtttcataaaggcgatgccgtaataaataacgtaaggtaagagtgccgccccgattgctgagaacgcttggctgttttgccactccgttgttaacggtaatgccatataaacaactgcacttagcaagcttgcatagcgggtcgcatccaaataccgaaccagccgataaatgccgaaccccgcaatgactaacaccaccacatccgtcacaacttcaaaccaaaaccaattgggtaatagaaccaacaatgctcccatgagataggatagccacggtccatacaacggtgtcacaattctgccggattgttgatacccatactcggccataaaataactaaactgcccatgttttaattgctcagcaacatcatagaagcgattaaagtgaaataacgcatcaatgccaacgacaggtcgattagacaacagtaatggcaaaaccaatcccaatgccgctaagaatatgaacaaccccgcaaagcattgcgctcgaaaacgttgcatcatgcacctccagccaattttaatgttttaccttgctttatatataccaaattattccgacaaatatgcgaatatatcgtaatgtctttttttatcgcaaacaaaaaacccgtcagatgggcttctgacgggtttctcggatcaagtcgtttgggcaaacgacgatcttataggagttaggttgctcgaattaattattcgagcggaatatgagtagttgtttgtatgggtgctgttgattaggagttatcctcccttccaacataattaatcatacggcgcgaaccttaaagaagtaataacactaactttacgttaacttaaagagagaccaagacaatgatttctgtcttggtctctctaaattacttcgtcttctttgtaaacttcacaataccttcccaacgagcagtttgtgggaacatatcaattgattgaatgtattcaacgttataaacgcgcgtcaagtcgaccaaatcacgggccaacgttgaagcattacatgacacatacacaaacttatctggttgcgtgtccaaaatcgtcaaacgcaattcttcatccaagccggtacgtggtgggtcgacgactaatgcatccgcgacccagccttcgtttgcccagcgtggaatcaaatcttccgccgcacccgtgtaatatgctgcattcttaacgccattatccaaagcattctcattggcatcatcgatggcttctggcactgtgtccatcccacgaacttcaccagcgtgatcggctagtgtgataccaatcgtgccgacacctgaataggcgtcgatcaacttatcggcttgcgttaagtccaaggctgaaattgcttcgttatacaaacgttgcgtttggcgtgggttcaattgcaaaaacgcacggggtgacaacttaaacgtcttaccgttaatcgtctccgtaatgtattcactaccccacaacaacttcgtatcctcgccccaaacaagagacgtcttatccgaattgatgttttggtgaacagataccacctctggcaactcttgattaatacgggcaatcaattcatcagcacttggcaaatacttgccattcgtgacgatcgtcaactggacatcaccagttgtctcagatacgcgggcaatcaacgtcttaacaatgcctgagttcttgcgttcgttgtaaattggcatctccatatcagccaaaatatcacgcaccttacgtacaaccttaagtgtcgctgggtgttgcgttgataccttgggcaagtccactaagtcgtgtgagttgcgcttatacataccgaccgccaactgaccatttacttcacgaaccgggaactgggctttattacggtacccgtccggctcatccatcccaatggttgggcgtaaatcaaattgctcgtatccttcaggcttgtacttttccaacgcctgacgaatgacatcccgcttaaattcgagttgaccatcgtaagccaagtgctctaattcaaaaccacccacttcttgattatcaacaggttcaacacgttgtggtgagcgttgcttaattttacgaatacgcgcttcgataaacttttccgtcacattcgtcacaaccacatcgaccacttcatcaggtaaagcacctggaataaaggtaatcttacgcttataatatccgattccttcaccattgattcccaaacgcttaatggtaatcaatagcttgtcaccaacgtttacttcaacgttttgttggttgcgattatcgcgacgtggcccacgtgttccacgtggaacaaacttgccacgattttgattgttgccacccttaccaggcttaccttgataaggacggcgctttttttcttcagccatttcgttctacaaagacttaccgtctactctttctatatgataagtactattctaacatgtcggaagtgaattgacccgtctccaccattgaccaaaggtaagctttaggtctactgttaataggtgattttttaggaggatttagactatgcattacgttgccattgttggttcgaacagcaagacatctttaaaccgccgtttagctgcagccatcgccaagctctacggtaccgatgacgtcacaattgacgtcttaacacttaatgatttacccatgtacaacgtggacgatgaactcaccccagcacaagtggtaatcgactttaagcaaaccgtcaaagcagctgacggggttatttgggtcacaccagaatacaaccattcaattcctggcgtattgaagaatgccattgactggctgtcacgcgttgataaggtcatgattggcaagccatcaatgatcatgggcaccacccctggcttcttagggactatccatgcccaattacacctacgtgatatcttatttgcgatgcaatcacctgtcttgatggggaatgacgtcatggtcggcggtggccacgcaaagcttgatgcagataacaacattaccgatgccagcaccattgactggcttgataccgtaatgccaaacttcaaagcattcgttgctacacatcaataatgaaaaaacgaggctgggacagaagtctctgtctcagccttaaaagccgccaatctcccgatttgaaatcggaggattggcggcttttaaacgtgttccgaaaggctgaacccttaatataacgccatttgacccactcatgcctctacgctacgctccaaggcataagcaggtcaaacaacgttatcatcggctccaaagcgcctttcgtctcactctcttttcatatcttttaattaaacatttgaaccggccgaataatcagcgacagtcccatcaaagttgatgacctgtccattatgattttcgccatcggtcgcaaagccagcaatcaattcacctgcctcatctgaggtcttaacaaaatcgccttgaatatgattattcaaatccgttgaaactgcccctggcataacagccataatttcaactggcagttcttgttgggtaaattccaagccaaaatccttggtcatcacgttcaatggggcctttgctgcctgatatgcaagtgggtgccaccaagcatttggctcaattggcactgaaacgttcacaattttaccagcgtttttaatcaagactggtaatagacccttggttaactcatatggcccaatgaagtccaccatatacgtctcgattaattcctggacctcaaattcccaagccgtccggcccatgtcaccagaaataccagcgttgttcactaataaactaaaatctgcttcttgctttgtaatgttagcaaccgcatgttgaatactgttcaaatcagaaacatcaatcaattgtaattgggcatctccatatgcgcgtaatgcctcaaccgcggctgaaccacgttgttcgtcacgtgcgcctaccaatacacgatagccttgttgcaaaagggccttcgcaataccaaacccgatgcccttattagctccggtaaccaatgctgttttagtcattctctttctcccgttgttcattcacatacttttcataacgcgaaatcttaaagttaaccccatctagactcgcttcgcgcattgcgatctgatcataaatatcttgacggtgcgctactaacattgccaatcttttgggaattgttgcatctccttcaacaatccaatcaacatactgcttaatttggccaatggtcatgtccgtgttcttcaaatgttgaatcgtcttcagcaatgagatttgcatttccgtaaaaacacgacgatctgcctcgtcacgttcaataaacggcaaaagcccccgtttatcgtaaaaacgcaacgtcgattccggcacgccaaacatttcagccgtctcaccaattgtgtaagttttcgccattcattcacctcactaactttgtgtacactactatatcagttaaacctcggtttaagtcaaacatttcttctccagcaaacaaaacggccgtcagttgggagtctgacggccgtttcggatcaagtcgcatgggcttgcgacgatctatatcgtttaaggagtattcaggttgtcacctgaaaaagtagaaagaattatgaatagggttttttctatgggtttgttgattaggtgggttccctttcaacacaattaatcatatgacgattagcttaaggcaaaactaacggcaactaaaagctagcttaacttcactgaatcggccgtaaaataatttgattcccatctgttttaacttcaaatgtcgtctcggcaccatgcggtaacatcgacgctggcatttcaaaatcaaagtcaatcttatctgcatgtcgtaccggccgaacccgttcaacagccaactgcacttgattgtgccattgcatcagcacccgcaagtcttggcgcgaatacacagtttggtcagaaaccgcaaatagctgatcgataataaacgcattgacattccgcaacattgcaatccgacgactcgctgaagttgtcggcaaattaccggtttcatattgttcaatactagcccgcgaaagtcctaataacgtcgcgaacccacgttgtgaaattccaatcttgtgtcgaattaatttaatttcatcttgatataccagatgatgcaccttggcgtatgccctatacacggcttctaaccgttcgtcatctaatttttgatcaaaaaccgcttctcccgttttctgataacgacgttcagcaacattagtaactgtcacttgttccccacgtactttcgtcgttacatcaactaacacaacttctgtatcagattctggtaccacagtatctaagctctcaatatagtacgtcatttattctccttagattcatgtattgaaatgatgaataacatctctaacctgatttgtaacttgaaatataagcctcgctgcccctcacgtctgatgaacacccaaatccattcaccttcatgattccgatccggatcgggacctttaacatactcagcaaacgttaacgccgcaaccatacgataaattgtcccaattcgcaggccatagctctcaataaagtctaaatttacctgtcgcggtacaataaccactcgattctgagcaatcagattatttgaattggctaaaaacgtttcaactagttgccgtgacgagctgttaaataaacccatgtatccctcatttcctaaatcatatcattgccctaaatttagggcaatgatatggcgcgttgtgtttatcacagcagctatcgatcacgtcggaggtcttaacccgctgacattcccagtctgctttatctaatacagacaacgagattagttatttttccaaaataaaaaagactgggacagcagtcactgtctcagtccccttataccaagtcgcgttttttaaaaccaatataaccgacaatcagcaacgctacggctaatccgcataaccaactaccacgaacaaccgacaagctaacaaccggcacgttgtaggtccagccatacggcgacagctttaatgcccacattggcaaatccatgagattcttcatgtaggccatcaagaacatcacgcccgcataaccataaatcaacccaaaccaacgtggcgcccaacctaacaaaacagccgcaattgctataaacactgcgatacttggcacataacccaccaaagcttgttgcatcatggtcacatccagcggcgctgtcaaaaccatattggcagtgaaccaaacaattacaaaggacagtccccataagcaaagcgctacaatcattgcaccactcacatacgttgcatagagtttgagccgggttaatcgcatgccaccgagtaagtcgtacgccccgcggacagtgtctatatgaaaacgttgcatcacatttagtccggccaaaatggccaagaagctaataaacatgctaaccatcaccaaaaagtgacgatagatggcatgctgcatacttgcttcaagttgcgcaccaataattttagttagctgcgggttatcaatcatcatcgtacccacctcatgaaacaagctaccaaacatagcgccaaaaaatgccaagccgaccaaccacgtcaacactaaccgggcttgcaaacgcacaaataaactcgtaaacccacgtaaccaaatggtcgcccgttgccgaccacgccctgtaaattggattatcccggcattaatatcccgcccgttaacgagcgctaacgcaatcaagcccaacacaatggcaaaccacccttgcgttaaaattgcccccgctcggttatctgcgaaaacgcgagtactttcaagccaatttaatggcgacaaccagcgccattccgcggcccgacgaacgtcaatcaccgcacgtagcacatacatgactgcaatgacaccatatccaatggcattaactgagcgagattccgcgaataattggcttaatatcaaggtaataccggccaccattaggccaaacgtccccaataatgtcgcaaaaagtatcgcgccaccattggttgcaccatgcatgggaattagcaccaccccaattcccatcgtcatggtcatcaaaacattcacacccagcacttcaaaaatcgttgcgatgaccggcgtagtcgccgttgtgacacctcctcgaatcagttctgtttcaccggactcttccatttgacgagtaccgcgaaccaccagttgcacgttcatcaaacccattaataccgccataatcggcagcatgattgcggcatatacgattgcaacagtatactgcgataattctggcatccgtgcaaacatggccgtcatcatgggcgttcgtaacatggttagcaattgatctaatgtttccggcgaattatataaatccgctaattttagcgccccagacacaatcaggctaaaattcaccaatagccaaacgatgattacgcgataatcactttttaaattagcccctaacaaccaccacatattacgattcatgcgccacagcccccgtatcataatattgcatgaataaatcttctagcgttggtggcgtgaccttcaaatccgttacgcctgccgtcactaaggccgtcattgttttaggtaataacgcacgggctaccgtaaaggaaatttcgccatttaattcttgatgaaacttcggataatcctgaaacggtgtccaatcctggacttgcgcattaatacgcagggccgcgtgctcttgcaaatcagtcaaggaaccaacttcaacaatccgcccttgccgaatcactgccacacagtccacgaccttttcaacctccgataaaatgtgtgaactaagtagcactgttttccccgcctgctttaacgctaatatctgatcttgaaaattgcgcgcctggagggggtcgagaccactcgttggctcatcaaagatatacaagtcaacatttgcactaaacgctgcaattaacgccaccttttgtcgattacctttcgagtacgtgcggttcttcttacgcggatctaattcgaataatttaatcaaatcatcaactcgttttgtccgggcatgaccacccatccgtaacagcaaatcaatcgtttcgccaccggttaaattaggccatagataaacatctcctggcacataagcaatatgtttatgggtatccaatacattgcccgttgcgtcttcacccatcaacttaatcgtgccactgtcacgcttcaacaagccaagtactgagcgaattgttgttgttttaccagccccgttcggtcctaaaaagccaaatacttggccttggttaactgtaaatgagacatccgacaaggcttggaacttgccgaacgtcttatttagatgtgatatttccaatactttcgtcatatttcatctcatttcttttgaatatatctactgtatcgaaaaaatattgtcgaaccgcaatcaaaaagcgagattcgcatgaatctcgcctatcatttaatgtcgtcgttgttcaaaactgtaaattgcggtgcccaagatcgcaaagccgatcccgaccaaaacggtcgtaaaggcaaaagttgtaaataaatacgctacaaccaagcatgttaagttggttaaccacctaccacctggtagttcaaagccagtcggcaatgttttatcgttgcgcaacttcagtgaagcaaaaatcgtgcctaggtactggacaaaatcactcaacacaatgagcttaatcaaaaacagatagctgccacttaaaatcaaaccacccgcaatcaacatcgttaataacaccgcgccgacgggagccccataacgattcgtccgcgataactcacgtggcaaaaagccacgttcacgcgccatcgaggccagttcaattggcgagttgaacgaagttgcaatcgctaccccaataattgaaagcatcatgccagtaatgataaccgtccggccaatacgtcccaaaatagtattgaaaatatcagcaaccggtaatgacgagccagccaatccgggacccaaaactgacattgccaccaactgcatcaatacgaaaatagctgtggtggcaagcatgaccgtcaagatggcgcgcggcaacattttgccagggttcttcatctctttcgctgcaattgggattaaagaaaaaccggtaaacatgtaaaaggcgttcccaaaggcccctgaaaagtccgccaccggcttggcttgtgccaccgcaaaatgatcaacatgcccaagaacaaaccagactaccgtcgcgatgaagactgccacaatcaccccaattttaattaaactcgacatatcatcaatgcgactcgaaattcccgtgccaaacaggttcataataatcagcaacgtcataatcgttaaggccagaccgttatacaccactggtgtgccaacagccggcaccaaaccggtcaatgtttttaaaaacgctgccgattcggcactgatggtaattaccccaaataaccaaccaaaccagccgactaagaaacctggataatggccaaacgcctttaaggtatacacccacgcgccaccatcttcatcaatcctggatgacatcaccgcataatgcatggcgattaatgtcgccgcaatacctgctaatgcaatcgcaagtaaaacgagttgcccaccttgcttatacatcgtacttggcagcaaaaacaagccaccaccaatgaccccatttacgcctaagagcaccacgctggggaacccgatgcccgctttcatctttttcatacgtttgcatcccccttatgccgttagtctacgcttaattcgtgcctttttcatttacaacctggtaagacaggacgataataatcgcaacaaagcaaaggaggccacgaacatgaccacattaggaacatacgagacgttggcacacgcctacaacaacacaagcacgattacttacccaatcgaagaaacgctctcagtgggcacttataaggttatcgatcaagatggccttcaaatgcacattacgaatgcgattgatggtgtgactgaaatccgctttgatgccgatgcggatgaccgccgttaccctggcaccttccagggatttgaatttgggatgaactggacacacccatcatttatcggggcctttttgaaggcaaagcgcacgcccggccagcacttccttggtgacaacggcacggctgcctacgatgccatcgttgatgaaaacaatcatttgacggtaaccttgaccccatctgctaactaaagtacattgcaatttttgtccagtccccgtatgctaactgaaacaacacttatcggagggacgttatggcaagtcggacacaacgtcgacaaaaacgacacccactacgtaagctaggccagctactattgggcggattattgcttttgctgttggctggcgcgggttatgcaacatatgttatccaccaggcaccaactattacgcaggcaaaactgcaggccaaccctggtgatgaaaacaatcaaatctatgtgcgctatgacagtattccggaaaactatcgcaatgccgtcattgcgacagaggatcgctcgtttgaatcaaacaacggcgtcaatatgggcgggctatttaacctcattacgtcaaatgtgatggcacagttcggcgacggtactgctcgcggtggctcatccattacgcaacagttggtcaaattaaccgctttttcaacttcaaaagcggatcaaacaccccgtcgaaaaattcaagaaatctatctggccttgcagttgacgaaaaacttcagcaagccacagatttttgagtattacgctaataagatctatgaaggtcatgaattatatggcgcgcaaaccattgcgtattattactttggcgagccattaagcagtttgacactttctcaaaccgcgataatcgccggcttaggccaaagtccaactaactttaatctgtataccaatccagatttagtggcacggcgccgaaatatcgtattagctgcgatgctgaatgataacaaaattaaccatcatgaatacgaagaggcaaaagcaaccagcgttactgacggacttttgcctcgttaacgaaaaaatccgcgaattgcacttcgcggattttttgtttgtcagtcattcattttgcgactgatacgcttgtaaaaatgcgtaggctgtagctgccgacgtgaataccggcagttgcttattcatcgcgtcatgccaaagtgtcatctgttgatctgcttgcggtgatgccaccggtatcttgcgggtatcaatcagcacatcaccttgttcaacccgttcacactggcgccgggtcttaaaaccggcgttaacaaaagccaactcaagcgcaacggcttcttggtcatcgtctgttaacaagaccgcaacccctggcgtcgctggcacctttatgccggcgctggtaaaagccttgtagagtgccacgtcgaacgtctcggcacgccccatcgcttcacccgttgatttcatctccggacccaataattgggtgacgcctggtaatttactaaatgaaaaaacaggcgctttgaccgccaccgtggttggcaattgctgcacaccatcctgatagcctaagtctgctaatttcgtcccgagcatcacttgcgtcgccaattgcgctaatggtacgtcagtcacttttgaaataaatggcactgtgcgcgatgcccgtggattcacttcgataacataagctgtgtcgtcttgaatcacaaattgcacatttaacaaaccaacaatctgcaattcgcgggctagtgctgtcgcagctgcaatcatctttgcttgtcgtgattctgaaagcacctgtggtggatagacactcatcgaatcgcctgaatgaataccggctggttcaatgtgctccataacccctggcgtcacaacggtttcaccatcacttaagacatctagttctgcctccatgccaaccacgtattgatcaattaatacggggtgatcatgggacaccgccacggcccgactcatataatcggccaaagctgcctcgttagtgacaatttccattgcacgaccacccaatacatagcttggtcgaactaacaccggataaccaattgatttagcaatcttcaccgcttccttgaccgtcatcgccgtttgaccaattggttgtggcaactttagtttttcaataacttggttaaacgatgcccgatcttccgcgcgattcaagttcgccaccgaggttcccaatatgttaatcccgtgctcttctaaatcagcagctaaattaattgccgtttgaccaccaaattgtacgataacgcccagtggctgttctagtgccaccacttcacgcacatcttcaaacgttaacggctcaaaatacaacttatcagaaattgaaaaatcagttgagacagtttccggatttgaattcatcacaatcgcctcgtaccctgcggattgtatcgccttaaccgcatgcacagtcgcatagtcgaactcaaccccctgcccaattcgaatcggaccagaaccaattaccaataccgatggtcgttgggttacctgagcttcattctctttaccatacgttgcgtaataatacggcgtcaccgcgtcaaattcgcctgctaccgtatcaaccattttataaacgggttttatgtcatggtcgattcgtaactgccaaacatcatcgcttgtccactgccaaagtttagcaattgtggcatccgcaaaaccgcgccgttttgtcaacgcaagcatcgcgctatcacctggtgcttgttgtagttgttgcgcaagcgtcacaatattcacgagcttatctagaaaataattatcaattttggtagcgtcgtgtaattcagttggtgtcacaccacgacgcaatagttcggccaacataaacaaccgatcatcacgagccggccataaatgggccaacaattctgaggttgcccactcctcatactgcacatcgtttaatcctgtcaccccaatttctaacgatcggattgctttcaaaagtgcctcttctaaattccgcccgattgccataacttcgccggtcgccttcatctgtgtgcccaactgtcggttagctgttttaaatttatcaaatggccatcgtggaattttgacaatcacataatccaaggctggctcaaagtccgccaaagtcgtctctgtcaccggatttttgatttcgtccaaggataatccaacggcaattttggctgccatcttcgcaattgggtaccccgtcgctttcgacgccagtgcagacgagcgactaacccgcggattaacttcaatgatggcgtatttgtcactatcaggtgccaacgccatttgaatatttactccaccggcaatatccaatgcgcgaataatttttaatgccgcatcacgcaacatctgataatccacatccgataatgtttgaaccggcgcaacgacaattgaatcgcccgtgtgaatcccaaccggatcaaaattttccatcgacgccacaatcaaggcattgtcctttgtgtcacgcatgacctcaaactcgatttctttgtagcccgcaatggattcctcaatcagtacctgtgtaaccggtgaaagatccaacccatgttgggtaatttgaaccaattccgcttcgttctgggcgattcccccaccggacccacccaacgtataagcaggacgtacaataaccggatacccctgcgcatcagcaaactgaacagcctccgctaccgtgacggcgatggccgatgcaggcaccggttcacccaattcagtcattaaatcacgaaactgttcgcgatcttcagccgcttcaattgctgataacttcgtaccaatcaattccacattgtattcatctaatatgccactctctgccaactccttcgccatgttcaacccagtttggccacctaacgttggtaatagcgcatctggtttctcctgctgaataatcgtctgtaaggatgctagggtcagtggttcaatataaaccttatctgccgtttctttatcggtcataatcgtcgccggattcgaattcaccaaaacaacttcataaccttcctctttcaaagcaatcgctgcctgcgaaccggaataatcaaattcagccgcctgtccaaccacaatcggtcccgacccaatcaccaatattttgtgaatatcacaccgttttgtcattgcataacccccgctttttcttgtcgcattaacgtcacaaactcatcgaatagataagtggcatcatgcggtcctggtgccgcatctggatgaaattgaactgaaaaggcggcatgattacgtagtcgcacgccttctacagtcccatcattgatatcctcatgagtcacaataaggttagtgtcttgcaaactgtcctttgcaactgcatagccatgattttgcgatgtaaaatcagtccgttgactcgtcaggtcacgcacagcatgattgaatccacgatggccaaatttcatcttatacgtgtcagccccattcgccattgcaaatagttggtgacctaagcaaataccgaatagtggtttaacttcttgtaattgttgaattttcggaatcatatccgcgaatgcattcggatcccctgggccatttgatagtagaatgccatccggattgctagccaaaatatctgtcacagatgcatcaggcgataacacggtcacggtcacaccgcgatcgttcaatgcccgtataattgaatttttcaagccaaagtcaatcaatgcgacctgcacatcactcacgtctgatttataaaccgttgttggctgatatgcgtcagcaactgacaaacttgccggtgcgttcacgaccacgtcacttggattatctaccaagacgccagtcatcgtcccaaattcacgtagttctttagttaaagcgcgtgtatccactccggtaatcccaggcagcgccatcgcttcagcccattcacgtaatgacatcttagaccgccaattgcttgggtgctccgcaatatccgctgtaataatagcgcttgtcgcgggtttatcagattcataatcaacatcattaatcccataattaccaattaacggatacgtaaacacaatcatttggcccagataggacttatcggtaatcgcttcttgatagcccgtcataccggttgtaaacaccaattctcccgcaacactttgcgtggcgccgaagccttcgccctcataaatcgagccattctccaatactaaatatcgtttattcattcttagtcctcattataaaaatcccccgtaatgtgccaagcatcacgggggacttatcgttattcgtttacttaatgacgatatacgcaattgaaccatgcaagcctcgctgaacttagttaaatcattcaattgtttctaatcatctagtcaattgccaacggctgtggcaaaaatagttcacctaacgttgcagccattaccgccttgattgtatgcaaccgattttcggcctgttgaaattgcttagcattgtccgcatgaaatacttcattcgtaatttccatctcagtcagaccaaatcgcttgtaaatgtcttgggccattgtcgtttctaaatcatgaaacgctggtagatcatgcaacacaatcgtatcggcacgccccgtttggtcaaccacttcagcattaatttgatatcgctgcaatagttgaatacgttctgcccaagcatcttcttctcccattgaagcccacacatcggtatacaacacatgcgccccctgtacaccaagggccacgtcgtcggtcaacacgattttcgccccacttttctcggcaaacttgcgggcaatctgttgcacctccgtcgtcggttgtagtgactctggtgcaaccaatgttatatcaacccccaatagcgctccggtaacaagcaatgaattcgctacattattacgagcatcccccaaataggctaatttcaatcctttcaaatgaccaaacacttcatccatggtcataaaatcagctaacatctgtgtcggatgccagtcatcagtcaacccgttccaaaccggcacatgactttcagcagccaacgtttcaacaaccggttgtgaatacccccgatattcaatcgcgtcatacatcgatcccaatacatgggctgtatctgacaaggattctttcttaccaaattgaatatctttcgcacccagaaattctgcatgagcccctaagtcatttgctgcaaccgtaaatgatgaacgtgtccgtgttgaggttttctcaaacaatagtgcaatattacggccctttaggtattcgtgggggacacgctgttgctttaagaactttaaatgttccgctaatttaattaacgtatagagttcttcccctgaaaaattcttttctgctaaatatgaccgcccgtaaaatatattttgcatttaagcctctccaatcgttgtcagaattgtcatgacacccgcatgcatctcttgctcatccatggttagcaccggcagtaatcgcaatgtattcccttgcgcagataaagccaaaatacctcgttcacgtaatttcatcagtaccggttgtacatctgttgttaactcaatgccgatcatcaatcctaacccgcgtaccgctttcacctgttgcaaattctggctaccttgtaccaaatcatgcatgatagccagccccttttgttgcacgtctgctaaaaattcaggcgttaatgactgaagaaccgcacacgcactcgccataacaactggattaccgccaaatgttgtcccgtgtgaccctggttgaaaggctgtgcctaattttgcttgaccaatcattgcccctacaggtaatccattggccaaagctttggccaccgtgacaatatcaggcacaatatcaaactgttcgtaggcatatagtgaccccgtacgtcccataccagactgcacttcatccacaataaccagtacgcctaagtgctgcgctttattaaccaaacgctgtaaccacgaacggtcagccacgtgaatgcccccttcaccttgcacaacttccaaaataacggctgcaaaggtatcgtctagttggtcaatcgccgcttgttgattaaacggcaccgtgacaacgtcctggtcaaccccgtagccagcttgataggccgtgaccggtgtcaatgacaaggccccatacgtccggccatgaaatgcttgcgcgaaattcataattttatgtttgcccgtataacgacgtgccaattttaaagcggcttcgtttgcctcggcccctgaattagcaaaaaacactagccgatctgttccttgtgttaacaaccccgcgacccgttcttgcagggtacttttatacaaatttgacgtatgccaaatgcctttaatttgcttttcaactgctgcttgcactgtccttggatgataaccaagattcattacaccgatgccggccccaaaatctaaatactcattccctagctcatcaacgacataagcatcatgcccatcaaccagttcaatatctgaacgggcataggtttcaaataaatgactcattcttggtcccccaatactaattttgtacccacttgaaaatcacggcccatttgaatcttttgcacccctacctgcatcgccataaatgcggcctgtaatttaataaacattcccccagtcaccacttcttgtgacattaatgtcgctgccactgtaggtgaaagtttggacagaacttgctgattttgatcaagtacgccagccacatccgtcagaaaatacaacgtgtccgccttgaaatggcgtgcaaacgctaatgcaatttcgtcggcattcacattcagtaactcgccttgagccgatgataccagtggtccaatcacatataactgacccgccatgagtgtcgtcgtaatgctgtcgatttcaccaactgccccaaattttccggcgtcctttatctttgcaacaacaccatcggttaaccgagttgggcttaaatgcgcttgtcccaagacatggtgtagcattggccaaacctgtgtttgcacaacgttcaccatgacctttaatgttgcctcatcggtgtagcgtaagccggctacttttttaactggtaattttgcgtgcgccaatgcgtcatcaaccatcggaccggcaccatgcaccaagacaactgtttcatcctctgccaaccacgtttgcaactgctttaaaacgttgatatctatattttttaaggcgttgccgccaattttaactaccttcatattttatgtgtgataagctgcattaatatgcacatactcataggtcaaatcacttccccacgcctgaccttgttctgttccgagacccaaatctactgtgatcacaatggtgtcctgttgcattgcttgcgttgctgcgacttcattagcaaccgcatgacccgcaacgataatcggcacttgattaatcgcaattgacaattggtcagcctcgaacacttcaccaacattgccaatggcatcaataatgcgcccccaatttggatccgcaccaaacactgccgtttttaccaaattagaacccacaatacttttggcaactcgttgggcacttgctgaatgacgtgcaccaatgacgcggacatcaattaaccgtgtcgcaccttcaccatcactggcaattgcgatggctaatgtcttgagtacctgatgcaaatccgccttaaacgcctcatatttagccgtgccagctttaatctcggcctgccaatcatcgccattggccaacgctagtactgtgtcattcgttgacgtatcgccatcaatggtaatttgattaaaagtgacatccactaattcacgtagcaattgctgtaacaagccttgcttaatcgtgacatccgtcgcgataaacccaagcatcgtccccatgttcggatgaatcatacctgagcctttcgccacaccactaatttgatagtccgcttgcgtaacttgcgccgtttttgttgtggtatcggtcgttaacatcgccttcgcgagattcaaaggcgtacttgcttgtagccgttcaatgccccgacggattttctccattggcaactgctcaccaataatccccgtcgacacaaccaatacctctgccggtgttttgtgtaatttattcgccactagcttttgcgtttcatacgcatttgccaaaccggtcgctcccgtaaaagcattcgcgttcgcagaattaacaaaaatcgcatggaccggttgattacttcgaaggacttgttgatcgatttgcaccggggctgctggaaatgtatttcgcgtaaatacccctgctacctgagccggctttgtcgaaactagccagccaaggtctggtttggtgggattacgccgtaactgaccgtgaatcccatcactataaaaatttttaggccaactaaatgtcataactgcctcctaaatcatgagtggtaattgagccaacccagccgtttcatcaaagccaaagtattgattgaaattttgaaccgcttgcccagcggcccctttcatcaaattgtcgataacgctcacaattgtcacgatatgtgtgaccggattgtatgaccagccgatggcggtcatattacttcccacaacgagccgtaaatccggcatgtcattggccaagatttttacaaatggtttgtccatataagttgcttgaaatgcggccgcgataatttcatttacatccgcactatcagctgtaaccttcgcatatatggttgccatcaaccctcgcttgactggcaaaagccccgttgtaaattggatagggcccatatccggggcccattgcttaagttgctgcataatttccggtatatgctggtgttgattaagcttatatagcgaaaaattctcatccacatcaacatagtgcgttgcttgactcaattttttgcctgatcccgtcacaccagacttggcatcgacaataaccgaatccaaatcaatcaggcgctcttgtaccagtggcgctaaccccattaaagttgccgtggcataacaaccaggatttgcaatataatctgttgttgtcgccgtaaattcagttaacccatacgttgcatgagataatgtttcacgtgaaacttcagtagctcggtgataccatttttgatacgcctttggatcttgaagtcgcaaatcccctgacaaatcaataatcgggaaatgattttctataaatgtttctgccagttcacccgtaacgcctgcgggtgtcgcaaaaaaggcgacctcgttatctgccataatttgccccgcatcaaacggcaacacccggactgtttgtttagtctgccagtcaaattgttgcgccacggcttccaaatcggcttgtgttgtataaatattaatttcagtgacatttggatgctgactaagtaactgccataaaacagtcccgctgtatcctgtcaccccaacaattgctaccttcattgctcattcccctaattgctcttgataaaatttaatttggttactaacctccgtaacggctgtgccaccaaccgatgtccggcgttcaacggccgtcatcggttgcaagatttggtacacatcatctgtaatcaactcacttgctttttgcaactcagccaatggcatatcctgtaagttaacctgtgtttgaataccttgtagcaccaattggccaacgatagcgtgtgcttcacgaaatgctaatcctttattagccagatagtcggctaattcggttgcattcgaaaaatcattatgtgtgctctctgacatcacatcacgattaacctgaagggttgcaaacataccgtcaaagacaaataacgcatccattatcgtggtataggtttcaaatacgccctgcttatcttcttgcatatctttgttataggctaatggcaagcccttcatgaccgtcatcagccccattaaatctccataaacacggcctgtctttccacgtgtcaattctgcaaaatcagcatttttcttctgcggcataattgaggaaccagtcgcataggcatcacttaacgtgacaaatccaaattcgtaactcgaccataaaatcaattcttcgcttaatcgggataggtgcatcatcaaaatggcagctgactgcaaaaattcaattgcaaaatcacgatcactgaccgcatccatcgcattgtggtaaacatcatcaaatcccagtaggtcagccgtcatcgttcgatcgattgcaaacgttgtacctgctaaagcagcggcgcccaatggtgatactttggtgtgctgcatattgaactcaaaccgctcaacatcacgtgtcagcatcccaacataagctaataagtggaagccaaacgtcaccggctgcgcatgttgcaagtgcgtgtatcccggcatgagcgtcgcttggttatccgtggccacttgcaataatgtcttttgaaactgcttaatcgcttcgatgatattaggtagtcgattggcaacccagagatgaaaatcagtcgctacctgatcatttcgtgatctcgccgtatgcagctttcccgcaacgggcccaattttttcagttaacaacacttcaacattcatatgcacatcttcctgcgcaatttgtagcgttgccacacctgactcaaagtcggcacgtaccgcttgtaacccggccacgatttgggcagcttctgccgctgtaatgattgcctgttgtcccaacatttgtgcgtgcgcaatcgatgcttgaatatcctcagcaatcatgtattgatctgctgcaattgaagcaccatacgcttgtacccggtcggatccagtttccgtaaatcgaccgccccataatttatcagtcatgctgctcaccctgttcagaatgaacatgattaacctgttcaaacacggtattgcctagagtccacagtttgataaatccaactgctgcggcttgatcgaatgatgaactggccgtatacgtcgccaaattttcatcatagagtgaatttttagctgactgacgcgccacagcaattgcagaacccttgaataacttcatcttcacgtcaccgtttacaatttgctgcgttaccttgataaacgcttgcagcgcatcaaacaaaggtgacacccacttggcatcgtagactaagttcgctaagtgttcggccacaattggcttaaaatgtgcaacatctcgctccaacgtcaagtcttccaaatccttgtgggccgtcatcaaaacagtggcggctggcacctcataaatttcacgtgacttaataccgactaatcgattttcaatatgatcaacacggccaatcccgtgcgcgccagccaacacgtttaacttttcaatgatggttgttaatgacattgcttcaccatccaaggcaactggcaaaccggcttcgaaactaatcgtgacaaaatcagcaacgtccggtgtatctgcaattgctgtagtcaactcatatgcttcctcaggcgcttcatgccatggattttctagaattcccgcttcaattgcacgcccccaaatattttcatcaattgagtatggtgactcctcacctactggaatgggtacatgatgcgcatctgcataggcaatctcttcttcacgtgaccattgaaaatctcgaattggtgcctcaattttcaaattagggtcaaaggcgtgaatcgcagcctcaaaacgaacttgatcattaccgtgacctgtcgatccatgcgcaattgttgtcgcaccaatctgatgcgcgatttcaactaacttcttaatgatcaacggccgtgacaatgccgaaactaatggatactcaccttcatataacaaattcccttgaataactggtgccacataatctgtcgcaaattcttctttggcatccaacaggattgacgcttcggcacccacttgtaacgccttggctttgatgaaatccaagtctttaccatgttgaccaacatctagcacaaccgccgttacggcataccccttctccttaagccaaggaatggccaccgaagtatctaaaccgcctgaataagctaaaaccaacttttcttgcatatttattcccctttttgaatatttgactattcgtcaattgtaactatttattcaaaaatagcaagattaattgtatttttattctaaataaattcaataaatcatgataaaaggcacatttaatcggtgaaattattgtcaaacggaatactaaatcaatatcttgaaaatcctaaaatattcatatttgtcaaccggatgcttacattcaattatttacatattttttcaacccatccgtcatttttgtatatttcagaaaactaaccctgtgcataaatgaattaaacatctgtttttaacaaaaaaatccgcggagacagtcatctccgcggattttgatttttaaattgtcattaattagttttcaggcgttgttggcaccttgatatcgccagaaataatcttttccttagcagtctcaacagccttcttctcgtctgcattcaagttcttcgtgacaacaccgactccgccttccttcaagccgtagtaaacagtcttgccaccagggaacttatccttttgcgctgattccgtgatcaattgcacaccacgaccaacacccgtcaatgatgatgtcaacgtcaagttagctgacttgccatcctttgacttgtagtcacccatgtttgtttggtccatatcgacaccgatgacccaaaccttatcctttgaatccgcagccaacgttgcgtcttggtccttcgcagcttggaagacaccatttccaacaccaccagcggcttggaaaataatgtgctcaccttgcgccatcttggccttagcaattgtttgtcccttggctgggtctgagaacgtacctgcatacgttgcatcgaccttcatattaggatcaactgacttcacaccggcttggtaaccagccaagaatgattcgatcacttggttcttcataccaccaacgaaaccaaccgtatcgtcaccgatttccttggcctttgtcgcagcggcgataccaaccaagtatgatgattgctctgagtggaacatgactgatgcaacgttcttgtacttcttatccgcaatttcatcaaccaacacaaacttcgtgtcaggatacttcttagaaacggtttggactgaatccttaaacgtgtttccaatagctgaaacgacattgtacttagcagtagcagcttgcgtcaattgcgtatcgtaatcggcgaccgtcttaggttggaagtagttgtaaccattttgtcccttagacaagttgttagccttaccccacttctccaagccttcccaagcgctttggttgaagcccttgtcatttacaccgtttgtgtctgaaacaaccgcagcggtgaatttatcgcttgatccgcccttgctacctgacgttgcggcatacgcaatccctgcaacgacaacaactgctacaccaccaataatcaatgtccgacgtgaaaccatttttcctaatacctccaaagtataaaatccctcgacccgaccactctttttgccttgaaaattaccagctcagagtccaaataaaaatgtaatttttactactataaggttctatttaagataatgcaaggggtcagttcattacatttttcatggttttcgaattattaaaaacgattaacctaataacaactgtatttaaggccccaaaataagtatttttcgtaaatgtcttatttttagtaactatatttatgagagaaatgtaatatatgaacaaattacgaacatttttaaaacccaccattgattattgtcgggaagtacgtataattagaaacaacaattttatgggggatatcatggcaaacacagaaacgcacgatagcattttggtgttggacttcggttcacaatataaccaactcatttcacgacgcattcgcgaattgggtgtttattctgaattaaagccacacacaatgacggccgctgaaattaaggcacttaatccaaagggactcatcttttcaggtgggcctaactcggtctatgaagacggtgcgttcacgattgatccagaagtgttcaatttggacattccaatccttggcgtttgctacggtatgcaattgatggcacatgtattgcctggcggaaaagttgcgccggcgaatgattcatcagaatacggtgaaactgaaatggacgtgacgtctgacgacaccgttttgttcggcggcacaccagaaacgcaaactgttttgatgtcacacggtgattacgttgagcaagttcctgatggctttaaggccgttgccacatctgacaacacgccaatcgcagccatggaagatacttaccacaacttctacggggtgcaattccacgctgaagtgcaacatactgaatacggcatgcaaattttggaaaacttcgttgacaaggcagttcgtgcagaacgcaactggtcaatggatgatttcattgacgagcaaatcacgaagattcgtgaaaccgttggtgacaagaaggtcttgctgggtctttctggtggggttgattcatcagttgtgggtgttttgttacaacgtgctattggtgatcaattgacatcaattttcgttgatcacggtttgctacgtaaaaacgaagcagatgaagtgatggctgctttgggcggtaagttcggcctgaacatcattaaagttgatgcacaagaacgtttcttaacgaagttggccggggttactgatcctgagcaaaagcgtaagatcatcggaaacgaatttattcgcgtctttgacgaagaagccgctaagcttgatggcatcgacttcttggcacaaggtacgttgtacactgacgtgattgaatcaggaactgatactgcgcaaacgatcaagtcacaccacaacgtcggcggtttgccagaagacatgcaattccaattgattgagccccttaacaccctcttcaaggatgaagttcgtgcattgggtgagaagttgggtatgccacacgaacttgtctggcgccaacctttccctggtcctggcttggggattcgtgttttgggtgacattactgaagcaaagctcgaaattgtgcgcgaatctgatgcaatcttgcgtgaagaaatcgctaagcatggtttggatagcgaagtttggcaatacttcactgtcttgacgggagtccgttcagtcggtgtcatgggtgacggccgtacgtatgactatacgattgccattcgtgccatcacgtctgttgatgggatgacggctgacttcgccaagttgccatgggatatcttggaagagatttctcgtcgcatcgtcaatgaagtcgaccacattaaccgcgtcgtgtacgacatcacggccaagccacctgcaactgttgagtgggaataatatttaatatctaaacgaataaaccgcctgggataaacaaattccaaggtggttttttgtatctattcaaaactttatccccaaatcaaaaatcacatcactgagcatgcttacttttatgatacgtttatttagtattgtaaataaaatacataatattatagaaaagagcgccgttatgataactgaaattgtcggtacccgactactgacgttgcgccaacaacgccaattaaccctgcaagaagtcagcacactaacaggtgtcagcaccgcttctctgaataacatagagcgccacaccacttcgccttccatcgatacactctggaagatttctagtggtctagctgtgcccattaactacttttttgcgaccgatccagtcgactttgaactagccagtcctgcggatttccacaatattgctagtgaagacgcgggtgtcgtggtccaatcggtctttaactcgattgcgtcgaataactttgaagtctttgatttgtcactgactagccagtcagcgcggcaatctgccgcacacgtaccagggacggtagaggtattaattgtaaaaaccggcaccttaacaatgcaggtcaatgggcgaacatttcaaattccggctggtaccatagccaagtttaacggatcatttgcgcatgaatatcggaatgacactacgaccgacactagttttgtcagtctcatgatttataatcgctaggagcatgtatggccataaagtctgttttactcggtattcttgccgctttatttttctcgttgacctttctcttaaatgaaatcaatttgcatgcggctggcgactgggtctgggtgtctaccctccgttacctatggatgttaccgatgatcgccatgttagcttatgtccctcaggtgaaggcaaatttccacaaagtgtggctagccatcaaagacgcgccgttctattggttactctggagtaatgtgtgtttcgtcttgttttacgttccactcacctgggctgcacaatttctccctggttggctagtgtctagcttatggcaactcactatcatcttcggtgtactcacaacgccattaatgaaggtcactgatagttctggtgtatcacatcgtttgcagataccgcgaaataaattgaagtggatggtcattatcatcatcggaattgccatgaccacgattcaaacaaccggatttgctggttttaatcataaattttggtttgccgtcatcgcaattctaatcgcagccatttgttatccactggggaaccgccaaatcggcgttcgttaccctgatttcaacgggttagaaaaagtttttgggatgttgattgcgacgtacccaactttcattttgttggcaatcattggttatttgagatcaggattgccaaaccatacaacgctcttaagcactttcacagttgctctgtcttctggcgttattgcaacggtacttttcttccaggcaaccgcgatggccgctcggaacatggaagtgttggcaactgttgaagccacccaatcatttgaggtgattttcacggtattgctgggcgtcctatttttaaatcatgcgttaccgacacatatccaattgttgggtttgctcattatgattctcggcattgtggggattaaccttactcgtaaaagacgttattaatcgtgaaaaggccaccgcgcaatgcggtggccttttcgtcagtatagactaaataacaagtgagaaaatttttccattcgattatttatacataaatatgcttctaacaatggaacatatatctttgtcattttaatttatttgttatataaaaaatttattacacctaaacaatcaattcagaactaataagttgaaacactattcattcaagtattatcatgtcatttgaaaatagagttagtttgaaaatgaggttagctttcatggaaaaaaacaaaattgtcggcttaggtatcggaattataggtgtgatatttttatttgggttactgccttttatgattatcagtagccaaggtcagagttccgactcgacgagcgaatccacttcgtcgtcttcgaaagtagaatatggcaaaatgcccaattttgtcggagataacatcggcgataatggcgctataacatggattggtgataataacctatcttacactatcgataataaagactacactcgttctatctccttaaccgtaaaaataccggaacgtctttccccttaaataaaacaaatttagatcaatataaaattgtttcacaatcaattaaggctggcaccaagctaagttttaataaagattatacggtcaatgttaaattagttcgtgattcagatgccatttcatctgcagcttctgaatctgcaaaatcatctgaacagagccaatcacaatctgaaatggcttcgtcagaaacaagttcatcagacgtagattctaagaaaacgcctatagaaatttctcctgatgacatggagaatgcgtatattaacagtcaattagttgacggtcaaaaatataaattaacaggcgtagtagctaatgatgtcaccacagaatttctatatctggaaactaccgatggctcaaatatgtctttcgaggcagcctcaaaatccaaaatcgaaaaatttaaaaaaggaatgaccgtgaacatggtggtcgaagagggatcaggtatcctccctaaaatcatatctatttctcaagataaaactaagaaatatgataaaaatgccgagctaaatgaacaacttacatttgcccaaaatgaagtaaatcaggcagctggtatggaattgattagttcttacgatattgaagatagtgttgtatatgttcaactaaatccagatgttttactccaaaatgatactcaattaaaagtaatgttagataatgcacactcaatcatgaaaaacgatggtataacatcttacatggtcttcatggttggcgatagtcgaatcgctcgaacgactgcattcagcggcgttaagttgcttaactaagcaattctgaccataaacgcattcgataatatcttgtaaaatctaaataaaagcccccgcttcggtattatgtgcgcctgaacaactccataataccgaaacgagggtatttttggctagaagcaattgtactcacccacatggcaggtggttttatgtgccgattgttatcacaatcggcactgactaaattcctaacaaaaacacgccataaacatggcgtgtttcatactatgaaagctgagaagatagtatctgcgtttttgagattgttgagattgtgaagtattaagtcgtactaccttctcatttgcggttgcccgcaatgatgttaaacgggttcgcaccgtttaacaccgataggcttaagcctcctgatttagctcaagtaacaaacgataaatcgcaccatacagattagcatcattaccaaatttaccgggcacgatatcgacatgactaatcatgcgattaatatatggattcccttgataaaatgcctcgtacgcttcacgaatggttgccgtcacaatcgattgggctgaaataccaccaccgatcacgacccgttcaatatcaaccgttgcttgtaaattttgaatctgtaacgcgattgttcgcgcgtattgattaaaaatgcgcttagcttgcggataaccagcattgatgaactcaaatactttttctccgtcgtggacatccggcaactccaattcggtcgcaatttccttaatcatctcaaccgccgaccctgtaaaaccaaaccgtgattcacgatccgtcgtaattttatggtaaataaatgataattcaccagcttcataatgagcaccataatgtaactgaccgtcaattacaaaaccaccgccaacacccgtgccaaggaccagcgctaaaccattcgcgaccccttttaactcacctacccaaagttcagcaagtgcagcggctttcccatcattttcaatagctaacggcaaatctaattgcaacgccgtctttaggtcgacgccgtctaaaaacgaccacatcaccccggcatgaatagtacccgtgtcatgattaacacgcaccggcaagctaatgccaacaccccgaatatcgtcatgatacaatgcaataatcgcctgtaattgcgcaacaaaattctttagatctcgacgatttgttggttgattaccacgttcaaccaattctccactatgattaactaaaccatatttaactttggtaccaccaacatcgatggccaaataatgattttccatttttatccctttcattcatgagctgtctcacccaatttattggcatgacgcccagggcgaattgcggccttcataaaggccacaatggctaataacaataacataaagctaataatcacgtaattagcaatttcacttgtttgattaaaccaaccgttcagtgtcttaagcacatatggacttgccgacacaccaacattgattcccaccaacatcattgttgatcctaatgtctgtgagaccgcatttgtctcagctgctaaattactaaagattcctggcataaccataccaaatgcaaatccgtaacccgcaacggctaccgctgataagatgagtgactgactctgtatcaagatgaacaccatcgtcgtcgccaatgttgcgccaatcgcaatcgagtagcgacctaacaaacgcttaatctgtccaaacaacaatgatgacaaaaattggaatgccgtcacaagtcccgtgacaaaactggcatcagcggctgttccgtaaccgcgttcggcaaataccggcgccattttaaccgtgatgccaaaatatgccgtaaaccaaaagaatgcaaataccgctgaaaaaatcatcgctccatttacgcggacatgaccactcgcagtaacatgttcttcctcaaccactggcgtattatcgggtactaacaaaccaaacaagaccaatggaattgccccaagcgcgtacacaccaaacgcggcgtgccaaccaccgcccattaggaatcccacgacccacgtcagcaaagttgtcaccatcgcagccgccgcatctcgataaccaatcaaagcgtcacgctcatgacccgtgtaatacatcgaaatcaatgagaacgataacgaattaaataatccgaccccggcaccaaataggaaccgactagctagcataatcgtataattctcggtaaacatcggtgtaatacctgcaattaccgaaaccaataaccctagaacaacggtgcgcttgtttcccattaatcttgttacaagcggtgacaacaaaacaaatatcaaaatacccaagctcgacacagacatcaataattcaatgtccgtttgcgaatgaccagccaaagtttgatgaatcagtggcacggttacctggacggccgctgccgcattcgttaacgttgcaattgatagcaacgctaccttaaaccaaaaactatgtttattcatataatcatcactccccaaattaatccctattctacatatgccgaccaacactaaccaacgtcagcacggccaacataatcatgaaaacgttatataaaatggccaacattttactagaaagtcgttgactcaacgttgtcccaatataaccaccgataatcgccacaatcgcaagccatggaaccaggcctaagtcataccgactataatcattcgcaatcacaatggtgtatatttttgaaatctgtgagaaaaagatacttgcaatcgaataaattgctgcgtcgcgcagtgtaaaaccaaaacaaattaccaataacgagacgttcaacggacctccaccgatggccaaaaagatagatattgcacctaaaaacaatcccaagccaaacgatgccaaccaatgtggcttttttacatgctgccgttgcggcatcgcccgcgtatagataatcaaaaagattaacgttagaaataatataatcgactgggttaactgcactttattttcaggaaaatagcgtagtaataccgtcaacaagctattccctatatagccaccgactaatgatcccactgagatttcaagcaacattggcaagtcatacttaaagcccgatttaacttgctttgcaatcgatactaaacacatcgtaaatacgacaacggttgtataaaagccaatgacttgtaccgaatctggcgagaacaaatctgtcattgcttttaatacaatgcccccaccaatcccggccaacgccccaatgattgttgcaataaatgtcgcaataacatacaaaacattcagcataaatgcctcattcttccgtcaaactacggccgttcgttgcaataacgcgttgataccaagcaaaagaatccttcttttcacgctgataagtgccgttaccgtgattatccacgtcaacatagatgaatccataacgcttgtccatcgaaccactacttgccgcaatcaaatcaattggcccccaagcggtatatcccatcacatcaacgccatccaattcgattgccttttcgacttcaagcaaatgttgtttaagataatcaatgcgataatcgtcatgaatctgcccattggcatccttttcgtcataagcacctaatccattttcaacaatcataaccggcttctcatagcggtaatacaatgtattcaaggcgaaacgcatcccctttggattgatgccccaaccccagtctgactttttcaaatacggattggtataaccggtctctaacccattcaacccctttaagattccctgtgtcttctgaccagtcacgtgggtcaagtaatagctaaacgacacaaaatctacggttcccgccgccaaaatggctttatcgccagggtgttctgggagcacaatatgcttacgttcaaattcttttaacttgtaatttgggtatttaccacgaacctggacatccgcataaaacatcatgagtttttgaaaatcctcagttccttgtacgtctgccggatcaggactattagggtatgaaaaatgcccgttatacatcatgccgactttattctcggcatttaattcatgcgctaacttaacaactttcgcgctcgccaaaaattgatgatatgccgcttgcatcttatcgttctcactggcatctaagctaataccaccagcgttccaaggcatcgtcgacatattatttatttcgttaaatgttagccagtaccgtacacgcccatcgaaatgacgcaatagcacctctgcataacggacaaacaaatcaaccacttcacggccttgccaaaatccgtatttttctaatcccatcggggtatcaaaatgttgaatcgtaaccaacggttcaatgccatacgacaaacacaagtccacaattttatcgtaaaagtccaatcctttctgatttggtttggcatcatccccattcggaaagacacgcgtccaagccattgaaaaccggtaaactttaaaacctagttcagcaaacagggcaatatcttctgcataatgttcatagtgtttaatcgcatcgtgtgtcggataaaacttagctgaatcaattgcatcagtaatctcacgaggcgcgccattttcggctaacgtcatcatgtcagctgtgctaagccctttaccatcaacatcgtaagcaccttcaatctgttcagctgaagttgcaccaccccagaggaaacctgctggaaaagccatatgtatttaatctccttttcttgctatttctaagcaagaaacagtatagctagctaaccaagcgcaataatagcttttcaaatcgacttgtcagaccgttgcacacttaaacaagaaaacgcttacatgccatgcaacaccattgcgcaaaataacactttcacatgaaaaaacgggcctaccaattgcagcccgttccactttaagattgatccttgataattgggttttccgtaaaccgataacgttggtactccttctctatccgcattttcgtttggtttgcctcaacgtgccgcgataaataactggcatacaaaatatccagcaggtacgaaacagatacatcggtactaaaattaccaaagttttgaattaggcgctcacgtgtactcattggcaacaagatatccgcatgctcagacaatgtgtttttcccataggctgttagcgcaatcacctgtaatttccgattatcaataatcgtcattaaccgatggatatcttgtgtttctcccgagtaagaaatcaatacaacaacatcattcgctaccgattcttgcaaataaaaatctactaaatccgttcgcgataattgcgtaattggtcgacctatccgcaacatcttattcgcaaatatttctgccaagtgacgatgatctccggcagaatagacataaatatgttgcgcatcacctagctttttcgttgcactctcaagttgttggtaatcttgcaaagaaagcgtatctgccacgacctcggtatacagttgacgaatattattagcaactgaccaaatgctatcgctcggtaaaaatggctgattaacatcaatatcttgcacattatgagctagatacaagcgttctgttatcaatgcctctttaaattcaggaaagcctgaaaatcccaatcgctgacagaaacgtgtcaccgtcgaaggggacacgtaaagatcattcgctagctgacgggccgttaattcttttatttccgatgtatcattcaaaaaatagtcagataactgcttttcaacgctactcattgcttcttggttttccaatgactctttaattaacatgaccttctcctgaaaacgcttacttttaatacgactttaccacatttcctgaaagtcggaaattgtggtgtctttcttaatcaatcattttggcaagcgattttagcatgaaacaaaataatgaacagactggtctttattttgtttcgttctataattagaaccatcaagtaaaggagcataacatgaacgaaaataactacacgcaactcgtcactgcatttgctgaggctaacggctttaccttctatcaaggcgcgcaagctagtccagccttgattcgtaattgggtaaatggcccccgcaagattcacttcgtttcttacggtaacgacagtcaaacggctagctggcatttcatcaacgagggctttgaacaccctgtttcgcaccttggtaccggcattaatgaattaaccgattggctaaacaacgtcatcgcgccgcaacttccttaaacatatcaaagtgatctaaccggtcactttctgaaaaaatgtgataaaatcacctgacgttttaaataacgatacatattcaaaaacggcttccgacagataatcgtcggaagccgtttttaattagtttttgtgattgtaaacatagacagtcaacggtgcaaagattgcgaccaccaacacaccagcccctaaaacaatccaggcttgtgttggccaagccccgtggttaagcatcatgcgcgaagcttgaataacatatgacacaggattgatgtttaccaaaatttgcatcgcatgtggcaacgtcttcactggcacaaatgcacttgataggaacgtcaacaacagcatcgtgatcaatgacacactttccaccatcgttgaactcttagccaacatgccgtatagcgcgaaaatccagctcaacgcccaccctaagaagacatctagcaccacgacaacaatgacccagccaaagccagcagcaggtcgccaccccatcaagaaaccagtcgttaatgacgcaacggccgcaatgaacaagcgcaaaatatcagcgagtagttgtccagctaatggtgcgatatgtgcaattggtaatgacttcaagcggtcataaatacctgaattcaaatcatcgctaatctgggtacctgagcccgctgccgctgaaatcaacgcctgcatcagaataccaggcacaatcgttggcaaataagcgtgtacgttaccggcaatcgccccaccaaacaagaaaccaaacatcaacataaacatcaccggttgcacgatgacgtccaaaaatttgtctgggttgtggagcgtcttcaataagttacgatatgccatcgtcgcaatatttgcgaatacattcgtcttgtgtggttgtacatccatcatgatttttgcctcttctcttaattcttaccaaccgtcaatgcaaagaacacgtcatccattgatggctgttcaactgacatgtttgtcatcgttacgcccgctgccgtaatggcttgaaggacccccgcaacggtattaatatcatcaattgccacttcaacaacattacgggttacttgtggcgttgccggcaatgtttcagccatcacaccacgcgcttgttctgcttgtgcgtcgtctgccacttcaacgcgtaacttagcaccaccaacttgcgccttcaattccgccggggtgccgatactaaccaactttccatggtcaatcactgcaattcgatcagccagttcatccgcttcttccaggtattgcgtcgtcaacacgatggttgaccctgctgccactaattgtcgaatggtatcccacatctgtgtacgcgtacgtgggtccaagccagtcgttggttcatctaggaaaatcaacgccgggcgtgtaattaaactaactgccaaatccaaacgtcgacgcatcccacctgaaaagtttgaaattgctttgtcagctgaatttactagtgaaaattcttctaacaattcggtcgtccggactttcgcttcctgccgtgacaatccatttaagcgtgagaaaatcatcaggttctcgcgagcagaaatatcttcatcaaccgatgcatactggccagttaagccaaataatgagcgtaccgtttgtgattctgttttcacgtcgtgaccaaaaattttaatgtcaccacttgttggttggagtaacgtcgtcatcatgcgcaacgttgtcgtcttaccggctccgttgggtcctaataagccaaatacctcgccacgcttaatgttgaatgatacttgatcaaccgccgtttgttgaccaaacgtcttcgttaatccgttaatttctactgcatattcttcagtcatgataatgccttcttgtttttaaaattaattatcagggtacctgacgaaaataataataagggtacctgattaaattgtcaacaactttgttcaggtaccctgtctatttatcgtttattaagcattgaaagcctgttatactggctataacagaaaataaaggacggcgaacatcatggctgatttaattgaaaaacaccaattggcggcaaaattatttgaatttacttcattgcagcacttagctgatgaacaagtggaacgtcactcgcctgtttttcgtggccaaaacaaagtccttgtcgcattaagcgaaggtgataacatttcgcaaaaagagcttgcagaacgccttgaaatgagtgttcaatcaactgctgaatttgttaccaagctagtgaaaaaggattttgtgacgaaaacaaaatcaccaactgacggtcgcattcaattaattaaattaactgaaaaaggccggcgcgaagctgaaaaaagcttattttacattcctgaatatttggattatcttgaccctgaggattggacacagctggcagcgatgctagataaaatgaacgatggtattcgtgatcatttgaagattgatggtatccaaaacttgggtactcggattatgttgagccagttggatcgtaagaccgaaattgataataatgaaaaatagcaaaaaccgcgttggaaaattatccaacgcggttttctgtttataactatatcttattaactacttggcgattattgccgatttctcgacaaaatgacatatatatattacataaagcaaactatatgttacactcttgttagttataaacgtaacggaagaggaatggccatgaataactctgtacgtaaatacagaacattaaagggattaacccaaaaagagctcgctaacgcaattggagtaacgcgccaaacaatcgctctgattgaaaaagggacctataaccctactatgaaactcgcaattgcgatagcaacacaactagatacagacttaaattcacttttttggaggcaagatacagatgaaaccaactactgatgagagaattatccagaaagacaatgaagttgttacgcgatcatttgtatttttagttctactacttatgctatttctagtgtctgcgcatttttttaaatccgtacatgacaatcctgaaataacaatattcacaatattgattgcgacgttgctctattcattaatcgacttcttcatttcaaaaactttatttgctgatgtacaagatacaaaggatttaaaattaaagttaaaatcactgacattcgatatcatcgtcttcaatattgttttaatcggtctatctatgtttcatgcaatcgatttgaagtttagtggactattccttatcgcacttctcgtaatggatatcgtactttttatactaggatttatcattctaaaactatgacttgtttttactgagtaaaccaccgcaaaataaggcgcaattctgtcactttggaaagaattgcgccttttaactgcattcaaaaaattattttttaatcctacttagcaacttcaatcgctgccagcacttctgctatcgtacgtaccttacccaaacgaggaaaaatgacttcgacggatgcgttgtgaccttgatctgtgcgatcagtcattgcttctggaacaaggaccaaattataaccatgttgtgccgcctcacgggctgttgtatccaccccgattgacgttgcaattcccgtcaaaataattgtatcgataccacgtcgacgcaattgcacatctaagtctgtgccataaaatgcgccccaattatgcttgtttacgaccgttacattagttgccgtctcatcagcggcaatatccattgctaaccgtgtcgctgcatctggtaatggctttgcgacctcatgtgatgcatctgtcactggattcataccttcagtaccatcattctttactcgcacaagaacaatttgggcgggcgtatttttcaacgctgtcgctaattcattgttccgtgcaatcactgtttcaccgtcattaggcgtcgtgaccccgttacgaataatgccatcttgcacgtcaattacgaccaatgccgtacgcgctagatcaaaatctaaagccatctcacatacctcttcgttcttcgtattagtgattttcagtgtatcacttttagcacaaacaacaatatcaactcgtttcacgtgaaacaaaaaataataatcacatactcaaaccgaatcaattgttagttagcgcttgttgtaactcctcgacaccaaacgtctcttccaaatagcgtcgttgtgcatcaaccttcccctgtaactcaaccagttcctttaaggaagccgttaactcatgtgctgcctgttcaagtgccgagacttgtggtgcttcatcaaaccggtcaaatgtctgatcgtgtgtcgtcacataatgactagccaattggtcaccacggtgggcacgttcccatagctcattcacccaacgacttcggctaacgctgccgtatagcccatgcttgcctgttcccatctggtcaatcgccatcatcaacttcaccgtcgtaacttcacgtacatcgccattaacttgcatcttttcgataccatccaataaaaatttacataaaaaaacgacacccaaaaccagtaggtgccgttgtcattagcacctatccgttaccagtggagcaccttgcatcgctgtaggttgctgtcgggtcatcgtgtggtatcactcaccgaactcttgataggttatcgtattaatatgtgactttagcttaattgaaaatataatcggcgtcaacccgcaattaacaattcgtgtgctacacttacatcaaaagactctggaggacaatgattatgaacatctctgtttcctttgatgacaacggtctgttgccagataagtatgctaagtttgcacccgctgaatatcgtaaagaagacatgccggtcgttaactttccaattgcgattaccgatattcctgctggtgcccaatcactagcagtggctgttatcgattatgacgccattccagttggtggtttcccatggattcattgggttgctgcgaaccttccgattagcgatgtgccagaagatttagcaaacgccgacatcacgtacgtaccaggtacaaattcaatgtacagtgtgatgaaagatggtaatcctgaaatcacgcagtcatatgttggccctatgcctcctgaccagacgcacgattatacattgacggtctatgccgtggatacaacattcgacttacaacctggctttttctataacgaactccgcaaagatctagttggtcatgtactagctgaagcgtctctcgaactgccagccagaagcgaataaattccaaaactaacagccccaaatctgcattcgtcagatttggggctgtttttaatgctttgccacgcgattcgttagcatcatcgctggcaaaataatcagtagcgcaaagatagtcgcatagaggaagccttcgtgataggcaccaaccagttgcgtcgtttgggtcacgtgatgtgctgttacataactcgcaatcaccgttgctaaaacagctgaaccaaaggccgaaccaacttgctcaaacagcttcgatcccaatgatgcttgtgatgaatcagcacgatcaatgccaacataagcatcagcttgaatggctgatttaacagcagcaccaccgataccgcgtacaaatactacgacagcgattaaccaataagctgaacgggccgtgaaatagacgaacggtaatgtgctagccactgatattgcgacaccaattagcaccacccaacgggcacccaacgcgtcaatcaagcgaccgattgttccacgtgaaacgagcatgccaacactttgtggaatcaacgcaacagctgccaggacaacactttcaccacgaacgtcttggaaatacagtggtagcaaaatcattgggccactcgtaatgaaacctaccaaaacattagcaatcatcgcgcctgtgaaattgcggtgcttgaataagcgaagtggcatcactgcggtatttggctttcgtagtgcataaacaacataagcgcctgccaagagtaagccgattccaaccagccccatcgttgtactgttcataaacgtaccggcttcactggcttgcacaatgccgtacacaatcgttgacgatgccgcgattaatagcgtgacgccgacagcgtcgaacttagctgctggattcttaggtgcaatcaccggtaccaacttatgcaacgcccaggccgcaagcaatacaatgggcacattgatgaagaacatccaacgccatgacacatactggacaatcaaaccaccaatgattggcccggccatcggtcccagtgtcatcggcaacccaacaattgacattacacggcccatcttatcgccaccgaagatatcgacaagcagtgtgaacatgaccggcattaatagcccagctgcaaagccttggaccagccgaatgccaatcagggccgaaattgaccaggcactaccggctaacaaagacgctaagccaaagacaatttcggcccagaaataaactgacttacctgaaaaacgatcaagtaaccaacttgaaaaaggaactgcggcgcccatggccaagataaaccctgtcaccgtccattgcaccatgtctagcgtcgtatgtagactttgaccgagttgattcactgcaatattaaccattgttgaatcaagcattggtgccattgcaccaagtactaggacccacgccatccggacagccgtgcgggggagttctgttgcatttgtcatgtataaaacctcattataattagttcttaagtcgttgacttaattttgtttcctcgtcaacaaaacacaagtttacacctttttgtttccttgtcaacaaaaagagcataaaaaaataagtcacggtcctcattagaaccgtgactcttaatccttatcttgttgtaatcgttcgtcgaagtgggccgttagcgtctgcgcaaaggccagcatttggtttaattcagcgtcagaaagtgttgcaaaaacagcttcatcccgcgcataaatatcattgtgcaaggcttcgtgacgccggttaagtgcctcaccagattctgttaggcgaaaatagcgttctttcttattagctggcttttgaaatgctaccaccaagtccttctcaactaacttgttcatcaattttgtcacgccgccacgcgtcatccccgtcgcttccgctaattccgttacattcggctgatccaattgtccaaccaacgccacggtttcaacctcagcatgtttataatcttgaaactgcgtcgttaccgcacgccgattcaattgcataaatttttcaacaacgtccatataggccgtcataaataactcttctcgatttgtcatcccgattacctcactcccattatacaaaattgtttccgtctaaacaaaaactgctcatcgcaatcatgcaatgagcagtttcaatttttttattacaacccgaagatgaccaacaagatggcggccatgacgaagttaacaaccatgaacaacttcataaacgttgctgatgaatctggttcgatttgacggaagacgcggtaaccaatcaagttggccattgacgcaacaaccgttcccaaaccaccgatattagaaccgatgaacaattcacgcgcatgatcagtaaatgttgaaatcaaaatcgttgatggcacgtttgagataaattgactcaagaagaatgtgccaaaaagtacgtgactcttcgtgttaaacaatgtgccaatcaagttacgtaccgcttcaatatgtgccaggttatttgtggcaataaagaagaataagaacgttgcaagtaggccatagtcgaccaacttcaacatatcatgacggtaaatcagaaaggcaatcaggataagtggaataacaacgttgaagggcgtccaaccaaagatggttgcaaccaaaatcaaccccgtaatgcccaagaaaaccaatcgaccattatcaaccttattcgctgggcgcaaattgatatccaatggcgtggcacggacaaaccgtgtgatgataaacatcaaaatcaatgaaactaccgtcaaactagccgaccacttgaagaattcacccacggaaacgtggtagaacccatacatgtacaaattctgtgactttccaaatgggaatagaatggcacctgagttagctgccatgataatcaatgttgatccaatgactttcaatcttgctgataaatccttggccaaacgcagataaattggcatcaatgttagaatcgcaatgtcgtttgacaaaatcatcgccccgaagaacgacaagaatgtcacactagtcatcaacgtgcgggcatggtggctacgactaaccagccaaactgacacagcgtgcaaaacgcccgcccgttccaacaatccaacccaaatcatcatcgttgccaaactgaaaatggtgtgccaattaacagccccaaaatcaggtgtgttaaagaatgacgtgacaaccgctagcaccagactagccgtaaacatcacgtcccctttcaagtacgtaaagatacgattaatcatgcttgcggctctcttcctctaaaacccgtccattagcgtttgctagtcgaataatttcataagcttttgcagccattaatgacgtcagaccagcggaaagaatcatcgctggaacgagtgcaactgccatgcgtcctgtcgttagttgactatctgcatgttcgtgatgtgtcatgacacaatctcctccaagtaaaaaactcaacttatctattatcaagaaattttaaccatttagcaaacattgaaatgtaacataaacccccgtaaaacaaccgttttacgggggtaatagtttaaactcgtacaagttcttatttaattagaccttcgtacccatacgaacgaacgtaacaacctttaacaggctgaaacgttcagggtttcagcgtaacattctttacaatttaaatcgttttactactcttaattgccaattagtcgcatcaaccaatccgcaccatagagcatggctaagctatacgcaaaaattgataatggcttacctaacacaataatcaaggtaaattctcgccacgtcatcttcgttaaacttgttaataaaactagcgtatcgtctggcgcaattggtgaaaaaatcaataacgcgaaagtgatatgccaaccttttgaatctaatttatgcatatatttttgcaaggtctgttcactaacaaaaacatcaataatccgatgaccaaagcgtcgtccaagccagaataacgcgagtgatccgagcacaatcccaatatagttgtacaagaacccccaccacgggccaaacatcaccaccccagcggcgagcgaaacgccacctggtaaaatcggaataacgacttgaataatttgaattaagataaagattaatggcgcccaaatgccgtatccctttaacaaatcaataaagactttcgaatcactgaaagcccccatttgataaagtttgaatactgcccatatcgttagtaatatccccaaaattgagacgccctttaaaatcagtttgacatgatacaatttcatttctgattcccccagacttaaattaaaccatgttttggcgcatttttcacggatttactaaagcattcgctactcacaagatgttttcacattatttaatttgaaatatgcggtatactgctcacaaagctattaattactatatgaaatgaagcttaatgggggaataaatgatgttagccgtcctgaattttaaaaacttagttgactttgaagaacagttgcaatttcttgacgatttgagtcatgctgatgtccaagtcgatctgaaaatttcaccaactttgcctgtacccaatgattttgagaattttgaaatcatcagtcaaaacttgaccattaaagagcgtacggtcggcgaaatctcgcctagcgttctccaccaccttaacatttcaaccagtttcatcggtcacttggagcgtcgtaagtctttgaacgaaggcctgctaatcgtgcgtaagcgtctggaaaatgcgttggaaaatgatatcaagccaattatttcagttggccaatacagtaatttagaattggtgactgaagagctcgatatcttgttgaaggatcaaccaattaccaagccaatcattattgcttacgaatcacttgcatcaaccgaaatggggcgtgcactatactcaattgatgaaattcgcgacgttcacaataaaattcgtgagttcatgacgacgcattacccagctattgactaccaattaattttgggtggtcacatggacgaagttggttcaccaattgccaacgcgattggctatgatggcgttctgattggtgatcgttaccacacactcgcttcgttccaacccgttttgaatgtccttaacaacttaagtcgatgaaaaaaataaaaacaggatgccgcagcatcctgtttttatttttagagagagtattgagtgagaaagaattgtctgatgtccgtaatccaaacttggtctctacctccttgtttggattaacacgtccagaacaaaacttaagtaatgaaatgatcagtgaaagaatccctaatgattcagcataatcgtctatcgcagataacgaccgcaaatcgtcaaacacctgccttgcgtatgttaccccagatgataaccatggttatcaaaaacaccccaagtcattttttgttccctataaagtgaaacgcgcttgtgtttaacgttttcccgtcgtcagacaaccacgccgcttctctttctcttgcacgtattatttctattacatttattatcataagcgttagttacttttcgtgcatgcaatttttttacccttttttaaaaacaaacaaatgctaaccgacgcctttcataacggttaaacgttttaacatcacgccattttataatcatttactcatgcgcagtactgaactagccgccacttttattcgttaaagtagacgaaaaatgcggtacgacaacctcgtcgcaccgcattttattctctaatttttagctatcgcgcttcgtatcttaatttaataccgtgcatcttttcaaacttatcagccttcacgatattcatacgtcgtcgtaactgctcaaattctaatgatgtgggcattgacgtccaaataaaggtgttttcagccggaatgtttgaattattaatatctgaaatcaaaatatccgtatcatcatctatgtattctgatatttcaatattcatcgctcgcatacctaaaatcatatccgtcaaaatcgactccaagccgatttgatagttgatatccaacgcaaccttaatctttgggaatacctgatgcatatcaaaaatcgatgcaaagcctgtatacaacacttcaaagaacgcgccacgggctaacgtaatatcaagatgacgccgttctgcaacatcatcaataacagccaacgccaattctgccattagtgggaactgctcatacgctgcatccaaacgcacacgattacgaccttcatccggtgttgggcttgttaccgccgccaccattaattcaaagaacacttcaaaaaaagcatcttgctcaagcgcggttaagtgcgcattgaataatttgttgtaatgcgtatcaacgatttgaataaacgctgccagcatgttcataaatagcggcgtcatgttttcacgccgattcatttcaacgccgacaccaatgctgaagaagcccataacaacataccgtccctcacgatgggcgtcttctgccgtcaacgtcgggaaaagctgcatcactaattgttcaacgtaagccgtcaattgacgcgtacgttcgtttagttggtcattaggcaacaaaaacgcatctacatcatcattcgaaatcacatggccgtgttgcaaacgtcctaaccaaatcgcaatggtaaatcgaatcgcaatgcgcttggtctcacgtaagcgctcatcatcaggtttaatataacgagtcacctcatccaagatacgattaatcagttgctcatcactattttcaaacggaaacgcgcggtctgcaaagtaaagttgaaaaatacggaaatacattgctcggacttccgattcattaccagccaacgtatagtcaggtgtaatctcaacaccatgccctgcgaaataatcgtctagttcaagttttgcattacgcgttgtcgatacagtcgtgagattacgcaccgcaaaatcatcatatgaatgcattgtttcatcaaacaattctttcattaatagccatggaattgactcccgcaaataattaaggcggaacatcgtagcatcataattgcgttcacggtttaatatcagcgtcttttcatcgtcagacaatgtcacgaacggctcaagatctggataaaaagttgccaaatccgccactaagtcacgaattgtcgttaacgcgatatattttgaccaatcaaacgcctcttggaccatcttaatcgataaccgtaactccggtcgttgcatcaaatattctaacagtgcaactttttggcggtcttttttctcaatcatccactgcatgttccaacactcactttctcactaccgagactccccactgtctcatactcaattctcattaccatcatataactgatttcccaaaaaatcacgttgtcgtaacaggaaggccacaagtgtccattatatcggccaataacaaaattataccgtgggaccgacgtaaaattgcaaagaaaagccctcatcgcaatatgcgatgagggctatctttgtttcacgtgaaaccttattaatgatttgtttgtaagacgtaaacgaacccaatgaatattaccgcaagggcatacatgattgggtgaaccttcttaccacggccagttaccaacatcaagaatgggtaaacaataaagccaatggcgattccatcagaaattgagtaggccaatggcatcccaatcaccgtcaagaaggctgatgctgcaatcgggaaatcttcccagttaacagctgcaaggttagcagccatcaacacaccaacgacgatcaacgctggtgctgtcacgtgtgatgtcaccacgactagcaatggtgagaagaacaacgccaacaggaagaaaatcccggtaaagactgacgtcaaaccactgcgtccaccaactgcgattcccgttgacgattcaacgaaagcggttgttggtgatgtaccaagcaaggcaccacccaacataccaattgaatcagccatcaacgccttaccagcacgtggcaattcgttgttcaccaagaatccacctgagcgggcaattccaaccaatgaaccggctgtatcaaaaaatgcaaccaacaagaacgttagaataaccggcaccatttggaacgtaaagacatcctgcaagccaaagattgcttgaccaaacgttggcttcaagcttggcacaccagctaccaatgctgatggggcatgaatcaagcccgttaacaaacctgccactgacgtgatagcaattccaatgaaaattgcgccaggaatcttacgtgcaaacaaagcaaaactgaccaagacaccaaaaatcgtcaacattacttgcggattactccagtccccccaaccaatgattgttgacttgttagcagaaataatcccaccatcaaccaaaccaatcatcgcgatgaacagaccaattccaccagcaatcgccgccttcaaatctgccggaatggcattaatgatggtttcgcgaattcggagtaccgtcaaaatccagaaaataacaccagccacaaacacaccagccaatgccgtttgccatctaacgcccattccgattaccacactgtaagcaaagaaggcgttcacacccaaaccaggtgcaatggcgaaaggataacgtgcaactgcgcccataaagatcgttgcaatcgccgtaatcaatccagttgccgtgaagacagcccctttatccatccccgccgcacccaaaacagatgggttaacgaacaagatgtaggccatcgagacaaatgtcgttaggccggccacaaattccgtccgtaacgatgtccctaactcagacaacttgaagtagcgttcaatcatgaagcataactccttttttatatgcaatttttcctaaaaaacaacttaactattatcgcacgttaaacggttcaatacaaaggtttcattaacattaataaaaaagaggccataaacgacctctaaacacgaacattatctcgatttttccgaacatttaatttttgaattggtccgttggaatcaacgcaaagataaaaccaacaatattaaagatgatggccaagattgcccaaacaaccagatgcttcaccccagtatcgcgaactcgtcgcacaatcaatgcaaaatctggcaagataattgccaaaccgaacagcaccacgataatcccgctcggtgacgtcagccactgattgttttgggcgccaaccccagcaatcgcgctcagcacagcaataatgatggcgttaataatcgttggaatccaataatctgatcgagttgaacgccctgaaaaattaacgtaattctgccaaaatgccttatatgatgtcatgataaaatcctcccaattatttaccctcaaacaatgtaacgttattgtaacattgtgtggcagaaatcaggtactgaaaagtcctcattagcatatatttgtatgtggcatcttgctacaatgatattagagggttatgactatgtataacgaaaatggacaaaagcgtcctttaacaagctgggaaactgcccgcttttttatcgtcgggttactatttaatgcggtcggcaacggtttaactgtggccacaaacatgggttcagcgccctggaccgcttccgcagctaatctatcaaacgcaacaggttggtcaatcagcttatttttattctcttatggttttatcgcggctattttgagttgcctactcctaaaatctattgattggcctcgtatacttggtaacctcacctttctcttggccttcagtgtcattattggtctggtttcatcattctttacagcgcacggggttggacaactcccaatgctatggcggctaattatcgacatcattgccattattttcgttgggtgtggcgtttcaatcacccagcgtttgcaatttattttgcatcccctcgatgatctaacaaatctaactcggttcatgttctttaacgggaacgcaggaattgcgcaaatcgtaaatttcgccattcccatggtgatttcttttgccatgtgggcaattaccggtagcatcgttgccgtaaacattggaaccctggtttcatttttcttccaaggccttgttatttctatcgctgaccagcgcgtcatcgggcatctcgatcacaaactatcattggctaaccagtgattcacttacaaataatcgttgacactatagcatttggccttatgattagtatcaacaaatcaaaccgacgatttgtttgacgacaagttgtcggtttttctgacccatcagctatggagaaaaaatatgacgcaacgatttcgactaaacacatacagcttacaagatttcacattaaacgtcttaaacgggaatagcctaggtatcattattgcgcttattcccgcggctttaaccagtcaactactgactttcttcggtcaacatccgtgggtgacaaccgttacaatgatgaccaacgttgcccaaagcatgttgcccattatcgcggcctttgccgttggcgccttcttacgacttggcacactagaatccgctgcaattgcgttagccagcatcgtttccggtggcgtggttcatagcaatagcaacggtctctataccctagctggttccggtgcaattctaaacgtcatgttggtgacctatctgtcggctggcttagtcctgttgctccaagataaactgggccaattgaaattaattttcttgcccaccatcgtgctcttagtcggcggaagtatcggcctcgtcaccctaccttggatgctaactattcaaggatttatcgggtcactagtcgccagtgcgacacatttttcacccctccccatgggcattatcttaggaatagctttcgcggccttgattgtgtcacctttatcatcggttggcattgccacagcaatcaatcttgccggcgtcggggctggcgccgctaatgcggggattgttgctggtgcattaacgctcgcttggatgagcgctacagttaatccaattggcggcaccatcgcccatgtgattggctcacccaaaatccaaatggccaatctcttaaagaagccattactattcgttcctgtcatcctagctgccggcatcactggtggcgtggcaaccttggcagacatccaaggtacgcccttctccgctggtttcggggcttctggtttgatcggaccactaactgcttggcaagtttccggccatgacggtttaatttggcgcattagcttagcctacgtggcagcgcccgtattgaccgcctggctaatgacggtcgtttttgttaaaaaaacacacctgattacaccagcaaacgatttaaaaattccactctaacgcagcatcgtcaaaaaccgcaaatgcgctgattcaaagtcggcgtatttgcggtttttaaacgtgttccgagaggctgaacccgatgttaacgtgatttatgccaaaattgttttgcgccttggtgccaaggcccatggcaaatacatcaccacccacaacacgcccaacaacatgataatcacgctaatatacaacgcgccatgaccgaacatatgctgcaatggctcaagcggcgatcccggtgctgctgtatttaaaaagaagaaattcgtttgcagacgcgcattgacccacaagacaaacggcaccgcgccacataagaagactactgatcgccacaaatcacgccaatttggcaccatttcaccgctcaccatcaacattaacggatacgtaatcaacaacgcgtgaatcacaaaactttgtaacgcccattgatttaagagtggataatacgcccaatccgggaaaatttctgccgcaacggcaccccaaattgtcaaactatacaaaatggtctgggttgttttatttggccggatagcatcaattgcaaccatcattaacccaaacccacataaatgaaatggcagtagatttgggtcccactgtccggttgttgctaaataaatatccttaaataattccatcgtccaaatcgccaacgcaatcccccaacgttgatggcgccgcccggccaacgtcaagcgttgatagcgatgtaccaaaaaataaataccaatcgccagcacacctaataccgtgagatgtgtgcccgaaaattggccaaatccaatgcccactggtatatctggttggtacgttaaataatagttaaacatccataatcccccatgaataagtatgagaattgaataataccgttcctgcttaatttacgctatcattagtagataacaattgagattcggggaagaaaacatgaagacctatgcaatcgttggcaatcagttcgaaggcctctacaccaagccttggtctgaggtgcaacgctatacacacaccaaaccagcaccaaagtataagggatttgccacgcgtgccgaggcccaagcgtggtttgatgatcaaaccggggcgtcaggcaacacggctcgccaatacgtaaccgcctacgatggtcagttcaacgccgatccaagccgttactacatctttaccgatggtggtagtcggaataccggtaacgtagcgggtggtcacgtccgtccaaccgataaggcagcctgggccatcgcaatttatcgtggtgatgatatgcaaacacccgtctttactgacagtggcgcttttttcgggcgaacaaacaatgagatggaaattctcggtttgattaacgccttactccaaatggccaaggtcagtgagccagtaaccattgtgagtgattcaaagtacgttttagatacggtaaccgactggatgtacaactggcaatcaaatggttggcgcaaagctagcggtgaaatcgcaaacctaactgcttggcaacaagtctacgaattggttcagcaagtgcaagaccgcttggcatttatttgggttaaggggcacgcaacgagtgcggggaatatccgcgttgatcagttgcttaatgacgccatggatcagttaaaaaagtaatcaaaaacaacctgtctagctaaaaacagacaggttgtttttgaattaaaacgctgggaacccttgctatcactgttttgtgatataattcactattacctttagaaaatctaaaccttttttcgtgaatattttcacaatacaatacgaaccgctctaaaaggctactaacgttcgctgcgcaagcgcggcctcatcttcgcatgtcgtcaccaataccggtaactgcaacgtcgtttggagatcttctgccaccacatcctgatcattagccaacgacacaccaacaccagttaatgcgtacaacgtaccatacaagcgggccatacgctgcattcgtagcagcaacgcctccttagtttcaggcgcctcaaacaccccgtgttcgcgacaaccgctgtcttcataaaccgcacagatgactgaatctggtgccacattaaacgttaaaactgccatatatgcccccaatcttaactttcatatgcgaacaaattgtaaatcttcctaacgccatcttaacatttatgtataaccagtttgtgaagttcacaaacttggcgtatgaagcttattgtacgaattatcactgtatacaaaaatacgtttcaatatgcatattcttgcatattgaaacgtataaccgtcttattgttttcttaatatttcatcgagagtcaacaaaacaccatcattattattatcgtctagggcagcagggtagcgctctagcaacgagtcatcaccatttttcattgcatacggttgcgctgccaaagctaacatttccgcatcatttagtccgtcaccaaatgcaaccaacgattggtcagcggtcaccccgtaataatctgccagcaccttaataccattggctttattcacgtctggtgccacgatatcaactgacccatacccagacgtcgtcacatgggcggctgaacccaatgcttgttgcgcagcttgaataaagtgattcgtctgatgctctgcatagccaatcgttactttcaaaattggttcatcaatttccgctaggctatcaatcatcgtgacatgtgcaaacatcatcaacactagtgattgatgggctaaatttagccgaccttgatcacgcaacatatacacaccgtgacgcccggtaaacaaggcaccttgccggggatcgaagggcaggtcggtcacaacttgcatcatggttgctacctctggcacttcaagtcctgatactttcaacgtttgaccatccgcagtcttcacaatcgccccgttatcagctactaaatcataacgccccgcaaaacgtttaaaatgtttatcaatttgctcttcatcgcgaccactagccacgataaatctcgcatcctgtgccgctaataattgtaaaatgcgatcaaaatgggcctcattaaaacgctttacgtccgttaaaaaagtcccatctaaatccgtcgcgaccaagctaatttctgccattgtcatttactccccaatccagttcactgttttacctttaattgtacttaatttgggcctagttttccgcaaataacccctaaatttagacacgtatcatgttagaatatatctagtgtactttatatcacacatgtacttatacaattgaatacgaggattttgtcatgaaatggtttaagaaaatccgatatttgtatttagcaatttgggcaattattgcggtcgtcgcagtgctctttttgccaaacatgtcggatttggcgcaaacaaaggggcaaatctccttacctgcgtcatcacagacttcaaagtctgctgacctaagtaacatctacaacgggggaagcgatcaaacttacgatttgaccgcagtttatacgtcatcagatgggaagaaaatcagcaaggcagagaaaaaggatcttaaggacacccttaagaacttggaactacgtgaggagcaatatggcatcactaatctgacgtcatttgcgacaagcaagtccgttgctaaccgtctgaactcaaaggatggtatgacaacgctggttcaaatcagtgtcgacaagtctcaaggtaacgtcaaggaagtggccaactcactgactgatgcgttatcaactgacgggttgaagcttcgtttgactggtgaagatttgatcacgtatgacttcgcaagtacgactcagactggtgtgaagcgtactgaaatcattgccattatctttattttggttgtgttgattttggtattccgctcaccaatcgtgccaatcgcctcattattgacggtcggcattagttacttggtctcattgagcgttgtcggaaatttggtgcaaagcttcaatttcccattctcaacgttcacccaagtcttcttggttgtggtgctattcggaattggaactgactacaatatcctgatgtactcacgtttccgtgagcaattagggattgatgacgatccggttaccgccgctttagctgctcgcaagacagctggccgtacgattttctacagtggtacagccgtattgattggattcgctgcccttggtttggcaaacttccaactttacaaggcaactagcgccgtcgctcttggtgtgttggtcatgttattcgtgatgagcacattgaatccagccatcatgtcgttgcttggtaagacgttgttctggccaagcaagaagttcaacgaacctgaaactagcaagctttggacgaagttttcatcgtttgcggttggaaagccaattctaacgattttggctgtcttgttggtgacagtgccattggcagtgacaaacaacaagccattgaactttaacgacttgtgggaagtttctgacgtgtatgactcaaagtcagccgtccaaacgattgaagatcactatccagccggctacgcatcacctgcaactgtgtacattcactcaaagaaggcgatgaacaacaacgaagctttggcgattatcgataacctaactggtcaaatcaataacttgaatggggttgccagcgttgccggaccaacccgtccaacggctgaaaagatcacgtcactttacacggcatcacaaagtgctaccttgtcagacaagctagacgatgccaagaccgggacgaagaccatcagcaagtctttgacagatgcttcaagtcaacttaacagcactgatcaattagcatcagtcgctgcgccattgacttcaagtaccaatgatttggcgaatggcgcttcagaattgcaaggggctttgtcaactttgacaagcggtatgcaatcaggtcaatctagcgctgccgaattgtcatctaacttgtcaaacgccgtcgcagttgtgaacggcttggcaacaacgattgatacgttaaatgcgtcagtaccaactttgacggctaacttacgtcaaacagctgacacgttgggcgctgcacaatcagctttggccactgctaatcaaggcttcacgtcaattcgtgacaccttgaacggtgatgcctcagttaaccaaaacggtaacgtgcaatcagccattcaaacagctggctcaaacattgattcactaacggctagttcacaatcattggccaacgccagtgctatgaacaacgatatggtcacgtcagctgaatcaatgagcagtagcttgtcacaaattgctgacagcgttcaccaattgcaagctgctttgacccaaatgcaagccggtgccggcacactaagctcaagcttggacagcggttcatctgctgctggtgaggtatcaaccaagtcaggtgctttgacatctggtttgtcatcattgcaatcaggtcaacaacaattgagccagggcattagcgatttgcagagccaatcaaaggaattgcaaagcggcttgtctgaaggttcagatggtttgaacaaaatcggtaaggggttgggcacagccacaacttacttgtctgatttgagtaacacgggaacatcagtcttctatgtaccagctgatgtcttgaagggtaagacgttcaagagcgctttgacgagttacatgtcagctgatcacaagacgttgcaattgcaagtgattatggatgaaaacccattctcacgtagtgcaatgccagtttcaaagaacatccaaaaggtggctaccaacgcgcttcgcggcacgaagttagctggttcagaggttgcgattgctggtacagctgctcgtaacgatgatttgaagaagatttctgaagctgacttcatccgtaccgctgccattatgttggccggtatcttgttagtgttgattatcatcacgcgttcactcatcaagccaatcttgattgtgcttggtctattactttcatacggtgctgctttgcaccttggtcaactattgattgcccaagtaatggacacgaatgaattgtcatggaatgtgccattctttagtttcatcatgttagttgctttgggagttgattactcaatcttcctcatgatgcgctaccgtgaagccgaaggaaacgcctcaacgcgaatggttacagcggccggcgttatcggtgctgttgtactatcagccgcattgattttggctggtacgttcgcagccttgattccatcaggggtcttgtcattgatcgaagttgctacagtcgtgatcatcggattggcgttcttaagtttgatcgtcatgccattgttcttgcctgctggggttgccttggcaaacaagctattggttaaggccgttgaaaacgagagttaatcaggtttaaacataaaaaacgcattcgcgctaagcggatgcgttttttttgcatattagttgttattgctgcaaggtgtctagcgcaagatatcaattaagttcttattcgctgcttgcttagctggtagcaggccaaacacaattcctacggccgttgaaacgccaaacgctaacgcaaccgaagcgggggtgacaatcgctctgaacggcatcgccatcgatgcaacagctgccacgcttgtgccaataactaggccgatgacaccacccgaaaccgttaatataatcgcttctagcaggaattgcatcatgatatttttaggtgtcgcccctaatgccaggcgcacaccaatttcttgtgtacgttcagaaactgaaatgtacatcatattcatcacaccaatcccggcaataaacaatgaaatacccgcaattgccgccacaaagtaggtaattcctgaaatcgatttgctaatccctttcagcaatttgcccatatcgatatattcatagcgaccatcacgatgatgactacctgattttttcagttgatgcagcgcctgtttggcacccacacttacctgagcgcctggtttaaaagtcagcttaatcccattaccttgtttcccggtactcgagttaagatacaagggtttcggcaaccgtgcatcggcagctttattatgataaaccccaataaccgtatacgttgtttgctggaccgtaaccgaagtcccgacggcattcgcagccgtcgtatacatcttggttgctagcttatccgacatcaacataactggattcttcacttcaaaatcgtaagtcgtcaaattttgacccgcaacaattggttgtttaacgggcttgttaaccaaatccgccgtcatcgcttgctgactatcattaataatcgcggtcatgccaattttcttcgtttgttgcaaaatttcgaccttcgcaacgcccttgagattagcgtccatcaacatagtgacatcccgattgtcaaagcccggttcatttaaaaacatatcgcgtgaattgtagtaaatctccgccgtttgttgcccggtttgggtcgtatctaaatcccgtagcatctgttttttaacacccgcacctagtgacataatcgtgacgactgacgcaatgccaatgataatcccgatagtggttaaaaaactccgcttcggattagcaatcaaggcatgccacgatgccttcactaattcagaaaatctcatgatgacacctccgaatctgcaataatgcgaccatctagaatttcaaccgtccgcttcgttgctgcggccacattaggatcgtgtgtgactaagataatcgttgtgccttggtcgttcaactctttaaagagttgcataatttcggctgaggtccgactatctaatgcacctgttggctcgtccgcaatcagaaaacttggattggcaaccaacgcacgcgcaattgacacacgctgttgttgcccaccagatagggcggtggggagcttatcacctacgtcaggcagcccaacccgtgttaactgttcatcaatccgggcctgcacttggcgtcgtttttcaccggcataaagtaaggggagggcaatgttatcgctcaccgacatcgtccgaatcagcttgaaattttgaaaaataaaccccacgctggcattacggaaaggcgttaattccgctcgttttaatgtttgaatttgtgtgtcattaaattgatactcaccttcaaattgatcatctaaaaagccaataatgttaattaacgtcgacttacctgatcctgattggccaataattgagacatattcaccagcatcaatcgccaaattaatatcatgcaagacatgaaattgattgccaccttggctatacgacttattgatattttttaaattaatcactaatcgccacctgtgccgcatcttttaactgattatccgggttcataataatgcgttccttagcttgtaggccggccgtgacaactaaataaccatcccgcttttcagttgtcactggcgtcttacgggccttacccgcaacatagcgatacacatggccgtgtttaacagccgccattggtacccgaatcccatcttgcggcactgtgattgtcagtgattggccattcataaattgcgtcgcatccaagttttccgttgtaaatgcgtatcgcgccatgtttttactgctttctttcgccggattggtcgataagaaattaagggtggtttttgcttcgtgtttcgttgctaaagccttaatggcaacatcgcggtgatctttgactttgtcgtagtcgtactcactaaccaaaccagttgcttgtagtcccgaaccggtaatggccaattgtactttaccgctctgatcataacttactgaaattcgtccatcgtaaggggccgtcacctgaccgtactgactattttgtccacgctgtaatacttgctgactcgtttgcacatccgcctgtgcatcagctaaattgctttttgcatcacgcaattgcgagtccaagtctgcccgtgttggatcatctgcaggcaactgttgcagttgctgtgtcaattgattaattgtgttttgcgcacttgtcgctacccgattgcccttatcaagggttgcttgttgctcagccaagtccattgatttatccaaaaaagtcgttagcaacacctgaccagcggtgacggtatcaccattggcaacgttcaattgttgcactttcccctcaggaatcgttaattgttgctgggctactggtgccaccttgccagccaccgtaaaggttgactgtttcaccgtcgccacctgataggttggcgtcccggcctcttttgttgtttgatgatcagtcacatacaagactgttccaccgatgactgcggcccctaatggtaccaacactatccctaatttaacgcgctgacgcatatcacatatcccccaaaaatatttcttatcacctaaatacaatatcatacatcgtataatatgcgaaggttttctgtcatatttttgaaatttttgtgttcttaatgtcaaaaacaatcgttttagatgttatttgtaacaaaaaaccgccatgcaatttagcacagcggttgataagtaaatttacccgatgataacttcctcggtcggatattgaaaactggttggcttttcgcgaatattcatcacggaaaacatcaccgtgtacaagccgacacgaccaatgaacatgaccatcataatgacaattttccccaacgttgttaaatggggcgttaatcccagtgaaaaaccggttgttgaaaaggctgaaataacctcaaacacaatatattctaagccttcgcccttcggaatcgtttcggtaatactcaagaagagcgacacgccaatgacaaacacaatagatatcactgctaacatcatggccttaatgaccactttttgactgaagcgccgcccaccaaaattaacttgctcctggccacgtagcgctgccattgattgcaaccataaaattcccagcgtcgttgttttaataccaccagaagttgatcctggcgttccaccaacaaacatgagcaacatgataatcatcagaccagcggccgttaaatcacgtaatggtacaacttccaaccccgcagttcttggcacaacagctaaaaacagggtgtccatgatgcgatgccaaagtgatgttgacccagctaatggcgtcagcactttttccgtgaataagaagaaaataaacgccaaaccggttaaccaggctgatacgtgcaaggccacccgggtgtgcaaactcaagcgacgctgcttgcgataaagcaataaatcacgccaaaccaggaaccccagtgacccagccgaaatcagcaacatccaaacaaccagaatatacggatcattccgtaaaaagaagactggttcgtcaaagaatgtaaaacccgcatttccaaatgctgaaattgacgacgcgatacttaagaaaataccgtggctggcgccgaagcggggaatgaagtccggcatcatcaggaccgcacctagtaattgaataaccgctgacagtgagaagacgtacgataacacacttttcacatcggctaaactgccgaggtttaaggcctgttgggccatgagtcgtgcttttaaatccaagcgttgtccggtaatcgcaaacaacagcaccgcgaacgtcatgaacccaagggcaccaatttcaatcatcaccaaaagaacaatatgcccaaacagtgaccaggtcgacgctgtgtctaacaccgtcaaacctgtaatcgccgttgccgaaacggcggtgaacaaagcgtccatataatgaaccgttacccccgctttctgcgatattggtaacatcaaaatgcccgcgccagcgaaaataatgactaaaaatccaagggtcaaaatttgtggcggggtcattttgctaagtaattttctcataagttaagtatcccccaactttctttattatacaggagttgaggcttagttttgcacagatttttgtggataaaaatggtaaaaataaactgttttacccacatcctgtggataacttgtggataaaagcccgatttgtgcaacgaaacccactatccacgggggaaaactcagtgtggataacttgtgtgtaaatgcttgctacatgcaaaacgcccatataagggcattttcaaccgaacgttaagtttaaccttaatcagtaacgggtttttatagctaacagaatgttatttcacgttatcgttcgtctttaggtgatttacatgcctttatatcggttgttcattcataaaatgcgcttaatcacgaatgttgcaaacttacatgttatcaatttttgtatctttagttttcaacaaattccagggtgtgcaaaactatttttagtccgcagcgatctgtggattttttggcatgtttttgtgactaaaggccgatattgcaacgttttaacagttttacacactaaaacacccattctgtggataaatgtggataactttccccagaaatcgctctaaactttgatataataaggtttgttagatatccacagcctgtttttaacatgtggataagccaaaagttgcgatttgtttaagcagttatccacacctgtttaaaacttcgaagaaagaactaatttgattaaggaaaggtaaagaccatgaacgtaaaaatcatcggcgttggcaagctaaaggaaaaatatttgaaagatggtattgcagaatacgccaagcgtttacaaaagtttgcaaaatttgaagtaatcgaggtcccagatgagaaggcgcccgaacaactttcgcaagcccaaatggatcaggtaatggccaaggaaggggaacgtattcttagcaagattaaagataaggaatatgtttttgccctcgccattaaggggaaggaacgcagtagtgaagaacttgccgctgaaattgataaattagcgctacgtggcgattcagatttaacctttgtcatcggtggttcactgggcttagcgccagaagtcattgcccgtgctaatacacaaattagttttggtcgctttactttgccacaccaattgatgcgtttggttttgactgaacaaatctaccgtgccttcatgatcaatcaaggatcgccttatcacaaataaagcgtttaaccgttatttgtattgatattatattttgattcggcgtcttatatcgtttaaccaaaagaaatcttacaaaatgacattaaattttatgaaagtttcacgtgaaacatgatttattatgtattgaaaacgctttcaaaaagtattttaactaaagcatgcgggaaaaccacaatccccgcacgcttttttattttgtgacgctgtttcacatgaaacgcaaaaactgaaaaaatatattggtctttttcgtgccatcttgccagaaaagactagaatgatgttataaggtttttaaccaaagaggggggcgttactatgcagtacttattaatgggtattatcgcgggtagcctaacaccgtttcaaacggccgttaattccaagctacggcaatatgttatttcaccatttctatcatcattaatttcatttctcatcggaaccatcttcttgactattgtcattttggccagtggtgggcagctactcttaaccagtcaccaagttgccactattccttggtgggcttacctcggcggggtcttaggaatgattggtttgaccaccaacattctattgttccccatcttaggcagtgtccaaaccgtcattatgcccatcatggggcaaatcctcatgagtatggtcattgataattttggtctctttggggccgatcaccacgccttgtcagctatgcgattggtcggcgtggtgctcctaattattggtgtgctaatcgttgtggtcttacccggttatctgagtcgcgataaaatggaagacaacgatcatgcacccgttaagttacgctggttatggcaattaaccggcgtcatcgttggtgccatgctggctgtacaagctgccattaacggccggtttggtggcatgttagcctcaccattacatgccgcttgggtatcatttgtcatcggctcaatcctgctattcattgttagtttatcccaacggagtttgcctaacgtggccaatttggcccgcaataagaccccttggtggatttggttgggtggttttctaggtgccatctacattttctcaaacgccttcttggtacccaagattgggaccggtacggttgtggtcttggctttgttaggtcaagtcatcggcagtcttagcattgatcaattcggcctactcggcgcctttaaaaaccggattaccccaatcaaaattattggcctagtcattatgattatgggggttgtcctcattgaaatgatgtaatctgaatcgctaccagctcaaccacagcatctgggttaagctggtagcttttttgatataattaacacactattagaaaataagaggattatgacatggccaacatccaaactgacctgctcattattggcgggagtgacgctggtatctcggcagctttacgtgcccgtgagctcaacaaggacatccaaattacgatagtccttgctgacgagttcccaaacctttcaatctgtggtattccatacgcggtcagcaaggaagtttccgcttggcaaaatttggcgcatcgaacggtcaaagatttagaggcgtaccaaattgacttttacatgaacacttgggcaactgccattaatccaaccgcccacacggtcactgccacacgtggtgaggaagcaatcacttttgcttaccaacacttaatggtagggacaggcgcagtacccaaagaattgccacttactggcgtaggcgacggtatccacgtcctacacaccatgggtgatttctttgacatcgaagcacaattggtgcaacaccagccaaaacgggcagctatcattggtgcggggtacgtgggcatcgaaatggcggaagctctcacacaccgtgatgtcgctgtttcgttatttcaacgggggcctgaagtactatcgaccatcgacgccgatcttgcaacgcccattaatgacgcattgacgcaaaacggcgtgcaggttttcaccaacggtaccgttaccgaaattgcccaaacaccaactggttaccgtttaatcggtggggctaccaacgaaacttttgattttgtcctggttgttgtcggtgtgcggccaaacagtacattgcttgaggaagccggtgctgaagtcacgactaatcatgccgttattgtgaacgaccgcatgcaaaccaacttacccgatatttacgcggcaggtgatttagtccaaacgaaacaccgcctccttggtgatacctatttgccacttgggacgacggcccacaaacaagggcgtgttgctggtgcgaatatcgtgggacgtcaaacccactttgccggtattcttggatcacaagtattgcgcgccttcgatgtgattgctgcccggactggtttgttacctactgaagctacgcaggccggttacaccccaatcacaacaactgcagtggtggatgatcacaaggggtactatcccggtgctgaaaaaattacaattcgcatcaccgctgatcgccaaacacatcgcctgttaggcgcgcaattggttggtaaatacggcagtgaagttaccaaacgagccgacatttttgcgactgccatttataacgacatgaccgtggaagccttcagcgacctggatttaacgtactcaccagtcgttggcgcaccatgggacgcggtacaagctgccgtccaacaacttgaagcccaattagatgcctaatcacaataaaacgcgtgagattcctatctcacgcgttttattatcatgatgcctttttctgctgattcttattaacaacatgactaccaattaacgctgatgcgccggtcatgaagcctgccaaaattgccaaaataatgaaactaggcatcgttaacccatttttaaataccatgataccaatcaaccatgctaaataaatgatgcctgttaataatccccgcttaattggggctaaatatagaaacgctgccagcacaacggctaccagcccccacggatagtccgtccaaatcggtccgccagtcatcagtgcccacagcaccggccagacaatcacagcccccagcaatattaataattcttgcgtcccggtcatttttctactcatcgctattaccacccttctaacaaaattgtaacaaactagtgcgtacccgaagaaaggaatttgcaaaatttactttttattggttcgcgcgcatactagtcatacaatctaatacttaatggggtaaagcattatgcgcgaagcgaaaaatgtttttgttggttttggtaaagcgggtaaaacgctcgctttcaagctagcatcggctggcgaatcagttattttgattgaacaatcagaactaatgtacggtggaacttgtattaacgtcggctgcattccatctaaactactttatacactatcagatgctggcgcgggcgaaccaggcttagaaaagtatcgcaacgctgtcctaacgaagaaatcgcgcatcggtacgttgcgtggtaagaacctacataaggttgctgatttggaatatgccactgtactgaccggccaagcgcactttgaagatgatcacacgattaccgttacttatcaaaacgggcttcgtgaagaagtacgtggcgaacgcatcttcatcaataccggggccacaccaagtgttcctgatacgccgggattagcaacgagtcgctacgttgtcaagaccgacgctttaatggatcaagaagtgttaccaaaagaactggtcattattggtggtggctatattgcggctgaattcgcgacaacctatgcccaattcggcgcccatgttacgatgctaattcgcaacccaaccttcatgtccttcatggaacgtgaggccgcggcagccattcatgagtcattaactgacttaggtgttgatattcggttgcatgcgaccgtaaccgaagtaacagacggggacattgcggcaacgttgaccgttaaccaagatggccaggtaacctcggtcaacgccgacaccatcttaatcgccacgggacgtcatgctaacattgacggactcggtctagaaaatacccatgttttgaccaatgagcgtgggattttggttgatgatcagttacgcacagctgcgccaaatatttgggccttgggcgacgtgcgtggcggtgcccagcacacgtatatttcgcttgatgattcacgcattattatgaatcaactccgcggggatggccgtgcgactctcgcgcaacaagctgtgacaccttctgttgtgttcacaaatccaccaatggccacaataggtcttaatcaagaagaagccgatgcacaaggcattcactatcgcatgagtaaaatggctgtagctgccttaccaaagacatacattgcggtaatacgcgtggttacatgaaagccttggttgacgataatgaccacattatcggggccacattattcgccatcgaggcccatgaaatgattaacctcatctcaatggccatgcataataatttgccttaccaaacaattcgtgatcaaatctttgctcacccaacaatgagcgaagggttgaacgatttatttgaaggcatccctgaaaaataacgttatattagcggcaaactttcagaatacgttaaaaaacgcaaagcaaccactattggcggctttgcgttttttaggactgagacggaaactgcggtctcagttttattttgtatgcattttatcttccaaacgactcatccaccaacctaaccaggtgccaagtgccaacagcacaacggaaatcgtgatgtggataatggtgaagtctttaaagtcggttggcacaatcataaccgtcgacgccaggacaatcccaaaaattgcgtggaacaacttcgcatacgcaatcttaaaaatataggccataaactttgacagcagggcaataatcaaaactaaaccaatcataatagggaccaagacacccaaatcgccatgtttaatcccatcactcatccctttatataagccaagataaattaagaaattcgatgggctcaggccgggtacaattaaccctagtccaatcaaagcccccgctaggatccacgcaccgaaacttgcttcaatttttgaaaacaaaggcgcgccaaacaacaaaaatgccaacatcgcggcaaatgcaataaccgtaatcaccacgtcaaccggcgttcggccttctttggccgcatcacgccacaatgacggcaaagtaccaacaatcgctccgacgaaaaaccagagcgccacactttcatgttccccaagtacgaagctaattgcaaaggacaacaaaaaaatgccaagcaaggcaccaatgccaacgggcatgaagtatagcacattctctttgaatcgcttaaacggattcgctaagaacgtaataattcgctcatatagcccaaacactgcggccagtgcgccaccactgataccgggcaagataaaacccgagccaattaaggcacctttaacagcacggaagatccaatctcctggttgtttttgcatggttagtcctcgtctattcttcagaaaattcgctttaatactgtcattttacctgagtcactaaaacaggacaacggcctctaaggtttcgacaacaaatagtaatcatgttgcgaacgtgctaccattaaggtcactacagaggattgaggtgagccattatgatgacttatacacgtaaagcacgtctatctgatttagacgcaatactaaaaattaccgaccaagccgtggcattcttggcaagtcaagattcaccgcaatggcaaggaaatgatggaccaactcgtgcagaatttgaaacagcaattaacgctggtgtcgcatatgtcttgatctatgacaagcaagttgccggtgttgccaagttaatttctggaccggaagcagcttatgacaatatcgatgggcagtgggacggcgatgccactacctatatgaccatccaccgcgtaactgtcgatggcgaaatccgcggccaaggtttggctcagcaactgctccatgatttaattgtgattgctcgtgaacgaaatttcacggatatccgcattgatacccatgcggtgaacgcaattatgcaacacgtcattaccaaactaggcttcacctatcaaggcatgattatgttgccaattgccaatggagaacgtaaagcctatcaactaattctcgactaacccttttcatactgtattcctcggaaggtgtgctattatttttgcaaagaaaccgaggtgattcataatgaagaatgtgttggtactaggcgctaccggaaatgttgcgcaatattttattgatagttttgctaatgtggcgcctgatgacatgcaattaacattgtgggcccgtaattcacgtcgcttaccccgttctcagcatgaggcttatcaagtctacgaaggggacatgtacgatgcgacaacattggtaccagccatcgctgatgctgatatcatcgttagcttcatcggttcatcaccaatgccaacgtatgcccaagcgctaatcgatgccattaacatgagcgggcgcacgatcgaccgtgtcatttggctcggcgctggtggcatgatgggcgaaaccattggcgatgaaggtcgcattgcccgttcgatgcccggctacttcaatcaacaactacgcggtggtgaaatgttgatgggggctgactttgacacaaccattgtcagtcctgtgatgttccacggtgggccagccggcaagccaattatttttgacagtcatgaaacaacacccgcacaaactgtttcacgtgaaacgattgcgctagtctacttagaagccttgttacaagacaagtggcgtaatcagatgattacagttggtgatcgtaaataaaaaaactcccgtcagacgaagactgtatatgcttcgtttgacgggagtttattttttaattgtcttgtttatgcttcgtccaaaatgagtaaccaccaaccatgacaataaagaagatgattgttgcaatcacagatacttgtgtcgccttatccaacaccaagataaccaacacggccaagaagaaggcaatcgttaagtaactggttgctgggaaccatggcatcttgtatggattttcgattgatgcctcggtcgccttgtacttaatgtgcgcaaccatgatcaaaatccaaacaaagataaagctaatcgttgccacaccagtaattagcgtaaagatttgtgatgggaagaagtagtttaacaacacaacggccaaaaaaatcaatgacgatgccaacataccagtaactggcaccatgttctttgaaattttcgccaacgactttggcgcttggttgttcttcgccaacacatacaacgtacgtgacgttgagaaaatcgctgagttagcggctgacaacgctgaggttaacacgacaaagttcacaatatcagcggcaaacttaatgcccatccccgcaaacacttgcacgaaaggtgattgggccgtattaatatcattccaaggatagattgccataataatcgcaaccgcaccaacgtagaacaacccgattcgaacaggtactgaattaatagcctttggtaaatcacgctctgggtcttctgtctcaccagccgttagccccaccatttcaatacccgtaaaggcaaagataaccattggaaaggccattaagaatccaccaaagccggttgcgaagaaaccaccatggtccaccaaattagcgaatgaagctgtgtgtccaccagtatggaacccagtcgcaatcaaacctaatccggcaacaatcaaagctaagatggcgatcaccttaatggatgcgaaccctgactccaattcaccaaaccaccgcacattcaccaaattcaacccaactagtagtaacaccacaatcaacggcgtgacccactgcggaataaaggggaaccaatagcgaagatatataccagtcgccgttaaatcggccatagccaaacttgcccaactcaaccagtaggcccagccgatggcaaattcccatttgtcgcctaagtattcgcgaacaaaatcaataaatgagcgcattttcgtattcgataatagcaactcaccaaccgcgcgcatcatgagataagcaaaaataccagttatggcatatgccaaaatcagtgatggtccggctgccttgatggctgacccagaacccaggaacaatcctgttccaattgcaccaccgatggcaatcatctgaatgtgccgcgacttcaacccacgtgataactcacgttgctcgtttccgttttccatattaaaaacctcactgcatggggtacaaaaaaagtccccatgccaaattaaatttgacatagggacgttaaataacgcggttccaccctaattcttggttaatcatcctaaccaagcaacttaattacgggtaatttttgtttctccaaaagttccacgttcgataacaatgtacttgtttgcaccaaccacaagctctctaaaacattgcataatcgaacacctctttcttcaccgagacgccaattagtaacttaactataaagacttctaaaaaattagtcaagcgttgtgacctacttggtcttttcaaccagtgattcaaaatgcttcacatcaacgctctcaccaacaaccgttagcacatccccgatttgaatcatctcactagactctggtgccacattaacctggccttgcgacttaattgcaatcacattaaggccataatttttgcgaatgtttaattctgaaatcgtcttattcgcaaatttcaaattcgcaatcttgatttcacctaaggagtgcttatcacccaaatcaatataattaatcaaattaggcgtcataatttgttccgctaagcgttgggccatttcatgttcaggacggaccacttgatccgcaccaaccttcgccaaaacgcgggcgtgcaaattattttcagccttagcgaccacatgtcgtacacccatgtccttcaacaaaatcgttgtcaaaattgacgcttgttgattgtgaccgattgccacaatgacgtgatcaaaacttggcaaatccaaatctcgcaaagcatcctcatcttgtgcatcggcgatcacagcgtgagttgccttatccatgtaattttcaactaatgcagggttactatcgataaccaatacatcctgaccagccgcaatgagcgattctaatagcgagctaccaaaccggcccaagccaatcacggcaaatgtttgcttcattatgttgtctccatttttattaatctttatatcatgccttagacaccctaaaccagggtgttttgatcatcgtgcggtcttaaattaccaccttgacctttcgactttattttaccacttcatcacaaactacctaaaaatcggaagtaaacttgcattaagtccgattaaatgcctacaatagcatatgttaaattatgcactttgtgtgaacttataagaatttagagagaattagggttggtaattaaatttgggagattgttaccactcatgagtactatttcgcgcgttgccgcgcttttttcaacagctgcattgggtagcatgctgttaacaacatccgtttcaagcgttacaacgattgtcgctgccgctgaaacaaatcaaacacaacaaactaacgctctgacgttagctgatggcacttatgatacgaccgttgccgtctataagactggcacgcaagaagattcagctatgatgtcatacgtcgagagcaaaggatcaatgaccatcaaaaacggatcagtgacccttgatattgccatgaaggggcagtcacagatggatatgatgaccggctttacagttgccggccacacagccacaaagtctggtacccattggaccgtgactttacccgtcagcgaatgggcagcaccatttgcaaccagcatggtgattgacgtgccagctatttcttggcatgaggaaccttctgcagatctaatggtgacccccatcgtcccggacaagccggctgatacgaatgataccgatagcgatgccattctgtcagccgacgtaccaatggccgctagcgatagcatggatcgtttttttaaccccactgctaaactagctgtcaaaggggatacaactgacgtcacactttcattcaaggatagtgttagcaatatgctcagcatgattcctgaagtgactttcgatggcatcacacaacctttaaatggtaaaaatgacatcacgttcaacattccaacaaaggacttaaagcctaccaacggtaagtcagtcacattagcatctttcactagtgtaccaatgagtccgacgaaaggatataaatcagatttaacttttgatttaactaacgtattaccagctaaagacttaacaactgggtcttacaaattagctgtttcagctgatggtgggatggataagtggtttgatacaaacttccagactgacctcggttggttgacatcaaaagtgaccgttgcctaccaagaatctaagcaagggatgctcagcatgattccaacggtgacatttgataacatcaccaagccggtcaatggcgaacgcttcgtcacttttgaaattccaactaaggatttgtcgccagatgacacgaacgttgctaaaattgcgtcgtttacgagcgtgccgatgagtccaagcaagggttatcaatcaaacttgtcatttgatatgacaccggcccttgggtcatcttctgaaacacaaccagaggcgcccgctcaaccggagcaaccaacggatccagagacaccatccgtgccaactacgccggaaacaccaagtaaccctgcaacaccacaacccggtcaacaacaattagcaaatggtacttataccgtcccattcgctaactacaagaccggtacaaacaatgcgtcagcaatgaataactacttgaagacgctggccactgtaactgttaacggcaaattagcacacatcgatatcgcaaccagcagtcaagctatcatggatatgatgtcagactacaagttcaacggcgaagctgctaaacgtcaaggcacgcactggctagtcacgttaccaaccgaggcgttgtacaagacgattacaacaagtatgacgatttcaatgaacggtcaagtcattgaaaagccaacggccgacatggtttttgacactagtaacgctgctacaactggtgacaagggcggatctgatgaaaaaggtggcgctggtaagccagatgctaaaccagaaactgataccgatgaatcaacatcaaataaaacgggaaagcccgctaaaaatgcagtcgtgcgtgcgttgaaaattttacgtgccgataacgatgaagcttcaattgccacccaatactttcacacgaccattaaattagctaaaaatgctgacggctcatactatggttatctaacgacccacacaccaaagttgatgggtaaaaatccaatccgctttactgataagaagcatgatgtttccttagtagagacgaaattggttaacaattactatgaatcaacttaccggatgaagttgcaaaagtctgaattgacaaagccaattgccacaacgattcacgtgcaatttacagagccaattccttataacgaaaactatgagattcgtttggtcatcggtaaagtattgagtgataagggaagtgatttgccaactggcgcggataaaaacggcacacctagtggcactgaatcgaacacgagccaatcagatgtttcacatgaaacaacactgactgatgtaaatgatcgtacgaatgctacgacaccaacgacaagcatgggggtaaccggtgttggtacaacaatgccatccccaattgctaacgtgccaggtacagccgctacgacaacactggcaacaacgccagctacacaaacaacagccacgccaaccactgcgacgtcattgcctgtcgcagtggctgcccaaacagctacgcaaccaaatgcaactactgacaagccagctaagtcgactaacaaggctaagcacgcctcgaattcaagtcaatctaaaaccgctaaggacacacctgctaccgagcaagctaacacgcactatgacaaacaaccgtcatcaattaagcgggctgctttgattggtgctggggttgcattgacggctgcaatcggcttcattgggacaaccatggcagtcaatttcttcaagattcggtaggcgtaatatcatgacaatcaaatcatttttgctaagtctaattagcggtattaccctactaactgctgcaccaaccgtgtttggtgaaacgtataacgcacccatgcaagtcttagaaaacgggacaaatagtgcatcatacgcctcagcttactttgccaattcggcaacggtaacgccaaacggtaatcaatatactgtgacatcaacggtcacaactgatacgtcacttggcgattaccctgttcaaatgttaagcattgacggtagcggggtaacgacctcacgcagtcaaagcggcaataaacaaacgattacgtatagttttgtcacatcagatttgaaagcacggcacaacgccaacattaaggtcgatgttgatagcatcaattatcaccataactacaccgttggtttggtactcgataccgccaacgtaccggcaccagccgcgtcagtaacatccgctgattcaactgcagcgtcgacttcggttgcggctgttgcaagcagtcaaacgactacaaccagtcatgtcgcagcgacatcaagtagccatgagacccgtgaagcaactagttctgccacacaagcaacaacggctgaatctgtgacaacgaattcagcgactgagacatcagcgtcaagcgcgtcagcatctaccagcacggccggcaagactgattctgaggcgcatgcggcgacttcatcatcagcgcacaagtcaactaaagctgccaaaaagagcgcccctgcacaacaaaaatcagcggatcaaaccactgatcaggctgcagctttacccgttggcctaattattggtgccggtctggcaattggtattctaggtgctctggctactgtctttttaaagaggcattaagccatgcaaaaaaaacaacaagccttacatggtatcttattggtgattttagttgggttaacagcaggctggtattggctatcaacccaatctgccaactcaacaacccatcacacgcaacaacgtgtgattgtcacaaccaacgcgcaagctcagatttttaatcaattagccatccccttagttggggtgccaacacctggtgataaccaaaccttgccaaagcgttatgcaaagttaccccaagtcggtaatcacgttgcccctaatttggaacgcatcgctagtctaaaaccagatatggtgtacttggaccaggccttagtgtctgactatgaacaaaaactcaaaagtgccgatgttcaaacaacggccttgaatttttcagacttaaccgccttacgcgagagtatcaaaacgattgggaatagttttaatcgtcaacaacaagcccgccaactaaatgccaccctgaacttaaaggctgtgcatccgaaccatcggcccaaagtggctttgttaatggggatgccaggtggctctttcctaactgggacgaaacatagttatgttggcgatttaattaaccgggctggtgggactgtcattggggctgggaatggtgcttataccaccatgaacgttgaacagattgctgcggcacagccagatgtcatcatcacgatggcccacgccatgccaaaacaagtctttcaaagcttcgatgaactgtttactcagccagcctggcaagccttaccggcgattaaacagcaccaggtttatcaagcatccgagccaacctttgggatgacagctaatttaaatgcaccagcggcctttaagcaattaaagacgtggctgcaaacgaattagaaagtcggtaaaagactatgaaacagctttataactggattttaggtggggtactactaattagtattgtcatcgcaatgctcatcggtagtacaaccattgcgttccatgatttatggcaaggtaatgcccaagcttggcatatgttgctcacttatcgactgccacgtattatcatcgcagtcgtcggtggtgcaattttgggtggcagtggcttactcttacaaattgttttacgtaatcgtctgattgatgcgtctattctgggaataatgaatggtacgcaattcgtgacaattggcagtttagttttgttgcctgctagcttaaattggcacgtcggggtgggggcccttggtgggattttaattatgattggttggcgtttgttcatccctcaaaatcgtccccgcttgcaaatggtgttaattggcattgcgacagcgatgacatttcaagccttaaccaacatcgccagcgaaggattcggattaccattgccgtcgttaagcaccgttacttgggctgacgtgatgcaattactcatcattgtcgtgattggcctaatgttattaattctagcctggccaaatctaaagttttacgccttatcggcccaacaagtccgtttgttaggctttaacgagccgcgcacaatgtggttgatcctcattgccgtcggaatttggaccggggccttaaccgcattacttggtgtggtcttctttttgggggctattttgccacaaatcgctcggttaatggcaccgcgtacaaaatcccagcaattactgccagcaaccatgttgtggggcagtttgctattaatcaatgctgacacagttgctagaaccatcttagcgcccaaagaattggcaacaagtgccgttctactggcaattagcggaccgttatttgcagtcatgcttttgaaaggaagtcgccatgctacaacttaaagacgttgacgtataccgcggtgaccaacaagtcctgtcaaaagtgaccgctgatttacgaccgcaacagattactagtctcatcgggccaaatggttctggtaagtcaacgctactccagctgcttaccaaagcattagaacctcgtcgcggtgtgattaccggtcgacccttaagtatcgctttattagcgcaacgaaatgagctccatgagcctttgaccgtacgtgaattattaacgatgaccacagatgttatcgacgatacggttgttgcattgcttcaattaacggctttgcttgaaacgccaatgccggaactttctggtggccaacagcaacttgcttggctcggattcgtcttacagcaacagcctgaactggttattttagatgagccaacaacctacctagacttgcagtaccagcacttattcttagaaacgctgcggcagttgcaacaacaacgccaatttaccgtaatcatggtgttgcacgatttaacgcaagcctttgcttatagtgatcagatttggttgctaaacgaccatggccagctaaaaagtggggctgtcgctgatatggctgatgtcgatcaattatcaacgaccttcaaaacccctttaactgacgttatcgtgaaccaacagcatttgattgtgcacgcctgacaacacaggggattgaccgtaaaactaaaaaaccgcctgacaatacgctgtcaggcggttttttggcgatggattacttctcaaaataagtcttccattgcgtattaatattagcgcgcttggttgcttcgccccagaatggcacctttacaacaccaagcaccttatccttgttcacaaagccccagtaacgtgagtcgtttgaaacggtacggtggtctcccaaaacgaaatactcgcccttaggcaccttaaccgtcttctcacgttgccaacccatgtggtcaccaagttccgtcaaacttgaccagttaccaacattgttgaccgtgttagttgctgtttgctcagactctggaatgaaatcttgatcaacagccttgccattaaccttaatcacaccattttcagcactaaccgtatcaccaggcataccgataacacgctttacgtaatccttgtgaccatccacttctggatcttcaccataagcatcaaacacaatgacactaccacggtgaatcttttcaggcttcagaacgaaaacacgctcgttgttggtcaaatttggttccatagatgtgccgtcgacacgtactagtgtgaaccaatacgtcttaatcaacaaggcaataattaatccgatcgcaatcggaattacccaagacataatctcgcgaaatgctttcatgggtggtctccttacatcatttttattattctcagtttagcacacctaaaataaaaaagccccgcaaattggcagggctttaggaaacattcagataatagactgcttcacaaccaaaaaaatcgccgtgtggcgattttttgatgattaacgcttgtgtgaacgcttcgccttacgaatcgcacgttcacgatcacgctctgcttgcttctttgcttcacgctcgcgacgaatttcaaatgggttttgaatggtccacgtttgcgcaacttggaaggcgtttgaaaccacccagtacaatgacaaggctgatggtacattaatcgcaaaaatgaagatcataattggcataatgtacgtcattgacgttgtcattccgttcttttcaggttgtcccaacatgaccaagtatgatgaggcgaatgtaaacaacgctgctaagattggcaaaatgaacaaatggtcgtgttgacctaattgggcccacaagaatgtccccgtttccaattgcttcgtcgtacgaatagccgtatacaatgcaatcaagattggcatttgaacaatcaagggcaacaagcttgcaaatgggttaacacctgcttccttataaagggcgctttgctctgcttgcatcgcagccattgattccgtatcacgatttggatacttggcttgaatagcctttaaagcaggggcaacttcttgcatcttacgcattgaacgcgtttgataaaccatcaatggcaaaatcaacaaacgaatcaacaacgtaaagacaataattcccaagccatagttatttccaaaccaggctgagacacccaaaattgagcgtgagaagttggcgatgatgattccatgccagaatccggtaccggctacatgtcccttaaacatcacaccagcaatgatcatgataattaaggcaatgacagctgtaacggtagagcgcgttgaaaatactttcttagctgactgcatcgtttttctccatataataggttgtttttaattttcgtcctggtcgacaaacaaatttgccaacttgaagacgtgttccaagttctttttaatgatcgccatgtcttggtcatgagctgatgggcgggcaatcaccagaatgtcgacatcttgacgcagatttggcttaaattccaaaacactttgtcgaatgcgacgcttcacccatacacgctcgtggccacgcagcccaactttctttgaaaccgaaattcccaagcggaagtgggttggttgttcacgctccatcgtgtaaacaataaacattttgtttgcgaccgagtgatgttgctcgaataccaattggaaatcggcttctttcttaacacggtaactcttacgcatatgtttgctccagacttttttgaagacaatagaaaacgcgtgattcagccaaaatggccgaaccacgcgcgatcgttatcagtaatcctaatagaaggcctgacctaattaggctgacaataccttgcggcccttttggcggcgacgtgcaagcaccttgcgaccgttgctagtgctcatgcgcttacggaagccgtgtacacgctcgcggtgacgcttcttaggttggtatgtacgcttcatgtgaatacacctcccattcgtagttagatttggcctgcggttggcaaggccaaaccacaattcgtatttcagtgtatcacgtaaggttccagttggcaacctttctaaagcacttaattcttttttaacaaaaattaagtgtaactgaacttactaatagtatagcacaacgcgaaatcgtcatgttcaattcttaaggccttaactttttctttaaaaaaattaaacaatcatcacctacgagttatccagaaagtaacagagcgttatgtttataaattccgggcatgtaacagagtgttagtttagttttccccaatatccacattttttccacaatctacacaggggctagtaacttttccgagctacccctgtgcatatgtggataaccgctcaaatagttgatgtatcaactttagcttattaacaaagacttgtaaatatctagttttacccctaacttatccacagatatccacaaataacgtaaaattcgaattcacatcaagttgataactaaattttggatattaacaggctgtggatatcacataacgttattcaaattcgcgaaaacccttgatatatcagtgatattcgctgtggaaaacttatccacaccctgctacaatggaatctgttgaattgcgcttcttaagaaatttaagattagcgaacgtattgtggataacttccacccaaagattcagatacttctactttttaaggaggtcgtcccgatggatcctgtccagctttggaacgccattaaagaagagctacgcgagtccatctcaactggcttctcctttgctaattacgtcgatacgttgacgcctttacaagttttagagaacaaaaacaatacggtcaccttacatttatcgaccaaccatgaacaagtggctgacgaatggctaaacccaagtagttcttactatctcgctttcatgcaagcagctatgacagcaacgatgaagctgtatggtcaaccaacgtttatcgtcccctcggtgacttatatctcaccacaaccaacttcattatttgaggtgccggctactgatgccgctcctgaacaacaaaacactaccggcacttcaccagtagcagctgattttgttacacaatcaattttgaatcccgaattccgttttgaaacctttgtgtcttctgatgagaaccgcgaagcgtatgctgttgcgcaagccgttgcggataaccctggtacccaatggaatccactattgatctatggtggcgtgggacttggcaagacacacttaatgcaagcaattgggaataaagttttagaaaacaatcccaacgccaaagttaagttcattacgactgaagatttcattaatgacttcacggaagctttgcgtcgtggtcaaaaagagactgaagcatttaagcgcgaataccgctcgacagatctcttgctagttgacgacgtccaattcttggctggtaaagaaaagattcaagaagaattctttaataccttcaatgccattacgcgagaaaatcaccaaatcgtcctgacatcagataagttgccaaaggaaattcctggcctagaaatgcgtttggtcacacgtttcgggcaaggttattcagcaaacattacgaagcctgacttaccaacacgtgtcgccatcctacgtaacaagtcggatcaagaaaacctcaatattccaaatgatgtgattgatgaaatcgctgcggctgttgatacgaacgtccgtgatctggaaggggtcttcaatcaagttgctggtaagttacgattcgcatcacagccggtcacggttgatactgctcgtgacattctcgagacaatgaacttcaagcggcaacgcgccatcacgattcctatcattcaagatacggttgcaaagttctttgacgtgaccgtgcaagaccttaatggtaagaagcgtaataaggaaatcgtggtaccgcgccaaatcgccatgtatttggcacgtgagctcacacaagactctttgccacagattggccgggccttcggtggtaaagatcacacaacggtgatgcattcaactgaaaaaatcgataacgcgattgaaaatgatgccctattggctgatcaagttcagaaaattcgtgaagagttgagcaattagtttgaatgaccattgtgaattattcacgaagttaccaaaagttttccacagggttgtatacatataccaatccttgatgtaatggtatagctgagggttttgcacattgtgcacaccccttattactattattatttttttattaataaataaatcagtcagtaagcgatgcatgcgcagcatgccgagcaaaaaaggttgaggagataatcatgcaatttacaattaatcgagctgttttcatcaaagccatgaataatgtcagccgtgcaatttcatcacgtacatcaatgccaattttgacaggtgttaaattggtccttgataacaatggcctaacattgaccggttcagatacagatatctcaatcgaaacagttattccagtaaccgatgatcaagcaacgttgcaagtatctgaaccaggggccttggttttgccagccgccttcttctcaaatattgttaagcgtttgccgggcgaaacattcaccctttcaaacacaactggtttccaagctaaaatcacttctgaaaattcagaatttgatattaatggccaagatgctaataactacccacacttaccagaaattgaagtccgcaataatttgacgttgccagctgaaacattgactgaagtaatcggtcaaaccgttattgctgtttcaaagcaacttagtcaaccaatcttgactggtgtgcactttattttagcgggtggtaatttgacagcggtcgcaacggaccgtcaccgtttagcccaacgcacagtggcatttggtgattcagatgttagtgccgacatcatcgtgccaggtccttcattgaaccaattgcaagcaatgttggatgaagtcgaaacagttgatgttcgtgtggctgaaaaccaagttattttccaacttggggctaacacgacgttctactcacgtttgttggaaggaaactaccctgatgcttcacgcttgattccaactgaaaagcggacgactttgacgattaatgcccgtgacttgctacaaacaattgagcgtgctgccttgcttagtcacgaaggacgttcaaatgttattcaatttacagttagcgacgaaaagtcattgatttcatcaaattcacctgaagttggacgcgttgaggaacaaatctttgcggccgaaactgctggtgatgaattgacgatttcatttaaccctgattacatgcgcgaagcattgaagtcatttggagatgagcaaatccaaattggcttcaagactgcgttggatccatttaccttggtaccaaccaacaatgaaacaaactttattcaattgattacaccagtgcgtacttactaattaccgcattgcgtaatttataggctaaaaagccgaaaattgctgtttaaggaaaaaacagtaattttcggcttttttgtttcataagtcgccaaaagcctcagaaaggctctgacgccttgattacattgaataaagcaaaaaaatagcgtataataagactacttatggaaacatttctcagttgggattaacccccgacagaaaggatattgaagtggctaacgaagtgcacattcaaacgccctacattacgctaggacaattattgaaggaaaaaagtatcatttctactggtggccaagcgaagtggtacctacgcgaaaatacggttttggttaaccaagagcccgatgatcgccgtggacgcaagctttatccaggtgacgtggtcgcagtgccatctggtgagcgatttgtcattaacgggatgggtgctgaagcagactaatggaactgcttgagctaaaactaaataactttcggaattatcaagatttagcggtgaccttttcaccaggcgtcaatgtctttttgggaccgaacgcacagggtaagacgaacttactcgaggcaatctatgttttagctttagcgcgctcacatcgaacaacttctgataaagagttgattggttgggacggcaaagaagccatggtctcgggcgtggtgcgccgccaatacgggaaagtgccgttgtcacttgcttttacaagcaaaggtaagaaggcacgaatgaaccatttggatcaggcgaaattaggcacatacattggacaattaaatgttattttattcgcaccggaggatttagccttggtaaaaggggcgccgacgattcgacggaatttcatcgatcgcgaatttagtcagatgagtccaaagtatctttatattgctaaccaatataagggcgtcttgaaacagcgtaatcaatatctgaagcaactgcagtcgaagcaggcgaaagatatgctgtatctggaagttttgacggatcagctaacgagtttcgccagtgaactaattgtgcgacggatacagttaattaagaagctcggtgaggccgcagcgccgattcatgctgatattacacaagggggcgaaacgttacggattgcgtacgtttcgcaacttaatgaagaagaattaggggatgaacaggtcattaaagaagcgatgacgaagcgttttgaacggttacagtcgcgggaagtaatgatgggcaccaccctgttaggtccgcatcgtgatgacttacgttttgatgttaatgggcatgacgtggcgacatttgggtcgcaaggacagcaacggacaaccgccttggcggtgaagttagctgaaattgatttgatgaagcaagagactggtgaatatccaattttattgctagacgatgttttgtcagaactagataccaatcgccaaacgcacttgctaacggcgatgcaaaataaggtacagacctttattacgacgccgtcactaagtgatgtggcccgtcaattaattaatgaaccaaaagtctttaacgttcgagcagggcaacttgtcgaaacggacgatttggacagtgctagtgaagaaaactagcgatagttaaggaggaactcatggctgaagaagatgtaacacaaatgcatacacaagctgatgattacgatgccagtcaaatccaagttttggagggattggaggccgttcgtaagcgacctggtatgtatattggaaccacgacgagtcaaggactgcaccacttggtgtgggaaattgtcgataacggaattgatgaagcgttggcagggtttgctgaccacatcacggtgacaattgaaaaggacaactcaatcacagttactgacaacggccgtgggattccagttgatattcaagaaaagactggtaagccagcgttggaaacagtctttaccgttttgcacgccggaggaaagttcggcggtggcggttataaggtttctggtggactacacggagttggtgcgtcagttgttaacgcgctatcaacagagcttgatgctgttgttgttcgtgaccgtaaggggtacgcaatggacttcgagcgtggtcacgtgaagacgacaatgcacaacgtgccagttgacgatgcacctgtttcacgtggaacaatcgtgcacttcctaccagatccagatattttccgtgaaacgacagtttatgattataagattttgatgaaccgtgtgcgtgaattggctttcttgaacaagggtttgcgaatttcaattgcagataatcgtccagatgagccaatttctgaatcattccactacgaaggtggaattaaggaatacgttgatttcttgaacacaaataaggacgtcatttttgacgagccgatttatgttgaaggcatggataacggtattgaagtggaagtgtcattgcaatacacagatgactatcacagtaatatgttgtcatttaccaacaacattcacacctatgaaggtggaactcacgaaacgggattcaagtctgcgttgacgcgtgttatcaatgactatgcgcgtaagaataacttgttgaaggaaagtgacgatgcattgtctggggatgatgtgcgtgaagggttaacggccattgtgtcagttaagcacccagatccacagtttgaaggacaaacgaagactaagttaggtaattcagatgcccgtacggctgttgaccgtatgttctcagaaacatttagccgtttcatgttggaaaacccaactgttgcgaagcaaattgttgaaaagggaatcttggccggtaaggctcgtcttgctgccaagcgagcgcgtgaggcgacacgtaagaagtctggtttggaaattgctaacttgccaggtaagttggctgataacacatcaaaggatcctgaaatttcggaattgtttatcgttgagggtgattcagccggtggttcagctaagcaagggcgtgaacgtttgacgcaagctattttgccaattcgtggaaagattttgaacgttgaaaaggcttcattggacaagattttggctaacgaagaaattcgttcactctttacagcgatgggaactggttttggtaacgaatttgatgtcacaaaggcgaagtaccacaagttgatcattatgaccgatgccgatgtcgacggtgcgcacattcgtacattgttgttgacgttgatttatcgttacatgcgtccattgttggaagcaggctatatttacattgcccagccaccgctatatcaagtgcgtcagggtaagttcgtgcagtacttggactctgatgaagagttagaagctttgttgccaacgttgcctgcctcaccaaagccagttatccaacgatacaagggacttggtgaaatggacgcggagcaattgtgggagaccacaatggatccgtcagttcgtcgtttgttacgtgttgaaatggatgacgccgtggatgctgacatggtcttctcaatgttgatgggagacaaggttgagccacgtcgtgaatttattgaagaaaacgcgcaatacgcggagttggacgtctagttttaatttgaactagatagaaagaaaggaatagtaatggctgaagaagaacaaaataacagccgcattaaacccgccaagcttggcgagcaaatgcgaacatctttcttggactatgcgatgtcagttatcgtggcacgtgcgttgcccgatgtacgtgatggtttgaagccggtgcaccgtcgtattttgtacggtatgaatgaactaggtgtgacaccagataagcaacacaagaagtctgctcgtatcgtcggtgacgttatgggtaagtatcacccacacggtgactctgccatctacgaatcaatggtgcgtatggcgcaggactttagttatcgttacatgttggttgatggacacggaaactttggttctattgatggtgacccagctgccgccatgcgttatacggaagcacgtttgagcaagattgcaacggaaatgttgcgtgatatcaacaaggacaccattgattttgcggataactatgatggtactgatcgtgagccagttgtcttgccagcccgtttccctaacttgttagttaacggagccaatggaattgccgttggtatggcaaccaatattccgccacacaatttgggtgaagttatttcagccattcacatgttgatgaacaacccggatgttacaacggctgagttgatggaagcggtccctggacctgacttcccaacaggtgcgattgtaatgggtaagtctggtattcgtaaggcttatgaaaccggtaagggtgttgtaacggtccgggcgaaggtcgaaattgagacggagaagtctggtaaggaacgcatcatcgtgactgagttgccatacatggtcaacaaggcgaagttgattgaacgtattgctgaacttggtcgtgaaaagcgaatcgaaggtattacggcggttaacgatgagtctgaccaaacaggttaccgaatcgctattgatattcgtcgtgatgtttcagcatcagttgtgttgaataacttgtacaagaatacgttaatgcaaactggcttcagctttaacatgttggccgtgcaagatggtcgaccaaagttgctaggtttgaaggccatgctggttgcttaccttgaacaccaacaaattgtcgtgcgtcgtcgtacggaatttgaattgcgtaaggctgaagcacgtgcgcatatcttggaaggtttgcgtattgctttggatcacattgatgccatcattagcatcattcgtggttcagaaacgtcagaaattgccaagaaccgtttgatgacggattatgctttgtcagataagcaagcgcaagccatcttggacatgcgtttggttcgtttgaccggtttggaacgtggcaagattgaagatgaatatcaaggtttgatgaccgcgattgctgattacaaggacatcttggctaagccagaacgtattgatgaaatcatctatactgaattgcttgaaatccaagaaaagtacggcgacgaacgtcggacggaattgcaaatcggggatgtcacaagcattgaagacgaagatttgattgaggaagaagacattatcgtgtcattgacgagcgctggctacatcaagcgaatggcgcaaactgaattccgagcacagaaccgtggtggacgtggtgtgcaaggaatgggcgttaatgatgatgactttatcgatcaattgattggtacctcaacacacgatacgttgttgttctttaccaacgctggtaaggtttacaagatgaagggatacgaaattcctgaatatggtcgctctgctaagggaatcccagttgttaacttgttgggaatcgaagcaggcgagagtgtgcaaaccgtgattaacgtacgtggtgaagcttctgaaagtgaagacttcctcttctttacaacccgttacggtaaggtgaagaagacgccggtttcagactttagtaacatccgaacacacggtttgaaggccattacgttgaatgatgacgatgagttgattaacgttatgattactgatgggactgagaacttgttgattggtacccatggtggttacgcggtgtcatttaacgccgatgccgttcgttcaatgggacgttcagcagctggtgtgcgtggtattacgttgcgtgatgatgactttgttatcggcgctgaaatcttaaaggatgacgcatctgtgctggttatcactgaaaagggatacggtaagcaaaccccagttgatcaatacccgattaagggtcgtggtggtaagggaattaagacggcccaaatcaccgagaagaacggaccgctagcaggtttggcggttgttgatggttcagaagacattatgttgacgaccaacaagggtgtaatgattcgctttacggttgattcagtgtcagaaactggtcgtgccacacagggtgtccgtgttattcgcctagatgatgatgcaattgttgcaacgtttgcaaaggttgaacatgaagaggatacaccggagttagcagaagacgctgccgagacagctgatgacgcaacgccggtcgtaaacgatacagaattaccagcagcgccagttgatggtgagcaaccagctgaagtagctgaattgcttgcacgggctgaagatgattcagaagaataataaacagtaaaaaggacaacatcgtgaggtgttgtcctttttgtattgataatacatatatattgatacgttatgcataaacggccggtgtgttttaaaaataattcagtattaagtttatgtttttggaattttttttaaatataaatgcatatgtaaagattataaaaatattgttttgctttaaattaggagccgtgtgagtggtttgtatcaatagcgggacagtattttctgtataaatccccaataaatacatggtagggagtataatctagaaaggttatatgagaaaagttaattataagtaagaggttatcatgggtaaaaatcgagtgcctgttgaggcaattcgcgaagcgatgatttatttcatcaaggaacgcaacatttcagtaccagtcgttttgaagacggttgatatttcacgttcacgactttacgactatttacaaggcaacggtaaggtgtcagcgacaactttggttaatttgttggtgacgattggcgtatcatttgatgagttgatgttgcatgtctacatgaaccaccctgagttgctagatccagcaatcaaggaattgggcttggatgcacactcacacacaatgacgccaacggaagacacggtttaccggacgttgtcaatgtatgacgagacgcgcgatgtgcgtttgttggttaacttggtgcgtgcaattaactcacaagtggccgacgaagttgaaaagtaccgtttgattgaaatggtacgaccaacaattatcaagttgttggctgctcgtgaattctacacggccaatgacttgttgatgtttgcgaatattattcgtcatgagccatacaacgccgccaagatggttgttaagcagatgtctgatcaagcacaacgcatggcgaagcttgaaggctatggcttgatggaattagataatttttcatcggctgaggttcgtaatgtggctttgttgcacttccaattgttgattatggcattggaaaacaaagatggtgacactgttaagaagacattgatgttcttgcgtgattatcgtttgccagcgttgagcacgtactttagttttgttaagaagatggctgaagttgtcgaacttgcattggatgaaaagaatgaggaagcagaacaattgtggcaccgcgcactggatgcagcgcaattcatgattgatgaacgcttctggccaatttattcatttattgcccgtcgttcgtttgaagagttcctggtaccagtcaactcatacaagcgtcacatgacagaacaaaatcaataaccgataaaataaagctcccagcattgcatattgcaacgttgggagctttttcagttacgtcagtttaattaattcagggttagtaccatattacggtgttcaatgcctgcgtccatgaaaatgtcactttcagctttaaaaccaagcttctcgtagaaccctaaggcagagacttgggcgcctagatcaattgtgtggacaccggcttctttggcatcctcgatgattgtctgcataattttagcagcgtaaccatgaccacgcgcatccgccaatgtggccacgcgttggatatgccaattttcaccgtgggcattaactaagacacgggcagtcgtcacggccttgctagctgtgaaaccaacgtagtgtgtcgttcggtcatcaagatcatcaatctctagtgcaaggggcacaccttgttcgctaacaaacacggtttgacgaattgcaagagcttcgcggctaagttcgccagcgccgtattctttgctgacgatgagttcgtttgttgacatgcgcgtttacctcatttttttatcaatggtcttattttaacttaaattggtaaaacgccaaggctctaaggtatgaattttaaaattacgctataatagaccggatacataaattagccgcgatcaacgctggcgtaagcaccggtcacaataatggccggaaaacattaaaatacgtaagaaaagggtgactaaactatgaggcattatggccgatttagctggattaacacgcgcttagggtttgtattgctcttggtcgtgttaatctgggcaaaaacgttgctggcggattttgtggactttaacttgttctcgggagcaacaccagtacaatacgtgacgctgttgattaatccattgacggtgtcatctttattgattggattggcgttctacttccgatcagcaaagcttttctacccaattgcaacgattatgtacatcgttaacattgtgctgttgcaattaaacgtgacctattatcgtgaatttacagattttatgtctgttgcgacgatgttgggttatgacaaagttaaccagggattgagtgcgtctgggtttgcattaacaaatctacacgatattttattctggattgatattccaatttttattgggttgttcatctttaaaaaaatcaggatacaacgtgaaggcacaacgaaattcatgagttttgcgatgacgacattttcagtctttgccttcatggtgacgctggttttgggtgaggcggatcgtccacagcttattacacgccaatttgatagtaatttattggtgaaatatttggggatggacgcttatacggtgttcgatgggttgaagcaacatggcgtgtccgagatgcgtaagtcggcgaagaaaacagatatccaaaaggtattgagttatgttgataaacattataccgatgcggatgctaagtatgccggtattgccaagggcaagaatgtgtttgtcattcacttggaatccttccaacaattttcaatgaacatgaaaatcaatgggcaagaagtgacgccaaacctgaaccaaatttataattctgattcaacgattgcatttgataatttctttaaccaagttggtcagggtaagacatccgacgctgaaaatatgttggaaacatcaacgtttgggttgccacaaggctcattgtttgccacgcagggtaatgaccagacattccaagcaatgccggccattttgaagcaaacagaggggtactcgtcagctgtcttccacggtaacaacgctagtttctggaaccgtagtaacgtgtacaagaatatgggctaccaatacttctttgatgctagctactatgatacgtcgggtgataaggcaatgggttatgggttgaaggacaagctgttgtttaatgattccattccatatttggaacgaatgcaacaaccgttctatgccaagtacattaccgtaacgaaccacttcccatatagtttggatgaacaggataaggatccaaactttaccacgacgaatacggattcagatattgtgaacggctactttgaaacgaaccactacttggatcaatcaattggtgagttcttcgattatctgaagaagtcaggcttgtacaacaaatcaattattgtgttatacggtgatcactacggtatttcaaattcagaaaacaagtatttggcttcagtgctgggtaagaatgccgatgactggaatgataacgataatgcgcaactacaacgcgtaccatttatgattaatattccagggtggcacggcggtggtgttaatcatacgtacggtggtgagattgacgtcatgccaaccttgctacacttgttaggtgttgattcaaagaagtacgtgatgatgggacaagatctgctgagcggtaagagcaatcaggttgtggccttccgtgataagaactttgtgacaccgaagtatagttatatcaacgaaacgatttatgataataagactgatcaggcgattactaatccaactaaatcggttttgaaagagattgatgcagctaagcagcaggttaaggaacagttatcgatttcagatgatattaatcaaaaggacttacttcgtttctatacgccgagtggctttaagtcagttgatgcctcgaagtataactactctaacgggttggcaaagttagaaaatcttgagaaccaagcgggtgttgaatcgaagagcttgtggtctgagaatggtggtaagaccacgcagtcattgtatagcactgacgcaccagaaaaggacgaaccgcgttctgatacatcgcgtattaagcaggttaatccggacggtggcgatacgactgatggtggcgatgacacaccaaatccataacaagtaaaaatgtccttgatgtgttgatacaattgtcagccaccaaggacattttcttttttgacgaactatcttgacatttgtgttaaataacctgacaataatagtctactaaacgtacaaggagaggcaccatgtcatttgttccaaaacaccattttcataaaaatgcgttgaagtcagaagtttttcagttccgcattggtgagttagccacaatgacgggtgtgtcaacgcgccaattacgttactgggaaagcaaaggcatcatttcgtcactaagtcgtgaaggcgagcaggatgcccgggtttataactacaaaacttatgtagcagttgcagccattaagggctttttagatgatggctataccttaaaagcggcggttgaaaagacccatgagcttgagcaatcgtggcgggtgctgcatgaagtgatgagtcaggccgttaagggtgtcatcgaacttgatggtaagaatgttgttgatttaggctattttgatgatgagcaacagcagcgtttatttgcaacgattgatgatgacaataaggtgcactatatcgtgcgtcaaacagatgaaaactaaaagaaaacggttttggtggctagccaagaccgtttttgtcttttctcaggttgaataactggtaaactataagaggcaaagcggtcgtgtgtaccgcaataaacggaaaaggaagttgtagaacatggcaaattggcagggattctacaagttgtcgtggcaagaacgcttgcaacggacgattgaaaataaaaatttaacggctgatcaggcagcgttgataacgcagcattatgacatggttggtgaacaacaggttgaaaattacctctataattttggcgtgcccacagggttactgttggaattgccggttgatggccgcttagtgacggtaccgatgagcacggaagaaccaagtgttattgcggctgctaataatggtgcacggatgatgcgggctggcgctggtgtgcagacggttattgaaagtcgtcttgtgcgtggccaaattattttggataatgttgccgatgttgtggctttgcaaacctatgttgagacacatttaacgcaattactgcaggtagccaatgatgcgcacccatcaatggcaaaacgtggtggtggtgcgaaagctttaacggtcgaagtgcttgatgcacagacagcgattgttaatgtcttagttgatccgaaggcggcgatgggggctaatgttgttaataccatgtcagaagcgattgctagcgtattgcgacaagcgggctatgaggtgttaatggcaattctctccaactttgcgactgagtcactcgttaaggcgaaggtagctgtgccggtaacggcgttggcaactaagcagggaatgtcgggtgccgatgtagcagctaaaattgcagccgctagtcggattgaaacgttgtcaccataccgagcagtcacgtctaataaggggatgttgaatgggattgaggcagcagtcctagccagtggtaacgatacacgcgcggttaacgcggccttgcatgcatacgctgcacaaggtggtcagtatcatggtttgacgcgttggactgttcaaggtgacgaattgcttggtgagacgaccttgcccctaattcttggcgttgttggtggttcaattgggattgtgccagctgttaagttgaaccatgcgttgatggataatccaacggttaacgagttgaccagtacaattgccgccgttgggttggcccaaaacttggcggccattcgtgcattggtgtcgactggtatacaagccggccacatggcattacaggcaaagtcattggcactccaagtgggtgcgacgccagcagaagtgccagcgttgacagccgcgttacaacaagcgggtaagtttaatgaagctaccgcccgtgaattattagcaaaattacgataaatagacggaaaagagaacagatatgcaattttcagcagatacagtacaactagtcgaccaagttaaccgtgtttatcctggttcagttgttttgcgtggtagcggggaggccacaggtgtcttgacgcacgatcaagtgacgacggatatgttgggtacgcgcttgatggttgaagtaacggatgctacggcaccagattattcagcaacaaaagaattgttgatgatgatgctaaccttgagtggttacccacaaatttacttccaattgaagtcagacaatgttgagttgacggaccaactaatggttatggcgacgtacctgtaccaaccagccatgcgcacgattatttataaggaacaagccaagcatggtttgttgacggatgatgttgtggcagcctttgcaaagggtgtcatgacaacactaacgaaggaagcagacggggaccgttccgaagctgccttgcgtgtgttgacattgttggatgctcaagtctttatgaatgcggttactggtgagacggcggcgtacacggatacgtttgctgaagctttcccagaagcatgggcagctgctcaaaagattgtcactgctatgaagattgagggtattaaggatccgttcactgttcatcgggcagttgtggcggcctttaagcattttgatgaacaaatggcagcgtgggatttgccagagttgcatgctaacgagtttgcaacgttgacgccagttttgtcagagcgtcagttgcgattgcctttggcgcaagtttacgatattaagcacacagatatgattgatcgtaatacagagaagaccgcctacgttgggttgaataagacggatgagcagaatagttttgttatttctgcgccagaagagaatcaaccaacgttcttcaaggagctctataagacatctgttcgtgaagtgcttgaacaaattggtcaaccattcgtcgtgcgtcaagcagactaaggaggtagacgatgatgttactatctgcagaacagcaacgattgtttgatgatgcccagaaaattgtgtttttaacaggtgctggcgtttcaacggcgtcggggattcccgactatcgttctaaaggtggcatttatgatgatagtggcgttgttgaacgacctgaatatttgttgagtactgacgcgttaaatcgtgaacctgagaagatgtatcagtttatgaaggaaaacatgtattttccggatgccaagccaaacatcattcaccaaaagatggcggcactaacgcaccagggtcgggcacgaatcattacgcaaaatgtggatagtttgcatacccaagccggtgcagaaaatgttatcgagtttcatggttcgttgtataacatttatgcggtgaccgatggtgccccagcaacatttgaggcttatatgcaagatatgcgtcgggaagacggtgcactacttcggccgggaattacattgtatggtgaaattccctttcacgtgacagaagccgcgcaatgggtgcatgaggctgacttgatcgtcatcgtcgggacaagttttgtggtgtatccgttcgctggcttattgcagtatgcgcaagctcaagtgccaatcattgcggtaaacttggagactatcccagcgccagctaatgttgtgcaggtgattggggatgcgcaaatttactttgatgaattacgggtataaatttttggaaaagctctcgttattgatggataacgagagcttttttgttatctgacgttttgtgtgaattaattttgaagaaagtgttgacgaattgtgtttctatctgtaatatagattaagttgtttcgcaggaaacagcgacaagtaaaaagatatcgcatgagacgttgataaattgatttaaacaagttgttgacatcgtttgagattcttgttatgatataaaagttgtcgggtgagacaacgacgtaggtcaagaactatctcgttgtcgctcatcagcaacgttatttatattaccaggttagcaacttaatgtcaacaacttattttagtaagttgtaactcgttaaccgagaaacatatattccgtcgcaagcaacttttatatcttaccgaatcaaaattaatttgtcaacaaccaatttcaattcgatttgattggttttgcaattgaattgtattccctgcaaaactcaacttaaatataatacccaatctacgaatattttgcaacccctaatttaaaataaactaatctagtcgtgccacacctgtcatatcaacattcgtaagcaaacctgctgcatcttttgcattcataaattgcaatcccagcagtgccaatcgatccatattaaaatctgttgtatcaattggttcgaaggtatacaacgaaattaaatcttccgcagtctctaatcccttaccatgccaggccgctaattcgcccagccgtaagttatctaaattaatgcctagttcccctttcataccagttaaaattgaacccaacgctgtatccccagcatgtttgtgcatcttcactgtgtaaaagcgtggtgttggcacctcatcagtcactaaaaaataagactgatcatttcgcgtaaatacaattgtcccagcaatcattgacatgtctcttccccctatttatcgttgtttcgttttcaaacgatcgagcgcctcattaatcatagcatcccgtgttgtcgcaatgctatcaaagcctattgttaaatgctgatttgtccagtaatggtgatgccaattatccacacgttgattgtcgcgatcggatttcacaacttggccaccatctaaaacactgcgccgtgataatgaaatcttctgattgtactgatcaatatccagtaccatcacttttatcacctgaccaacatgcaattcatcccccacatgtcgaataaatgctgaacgacactcagagatatgaatcagtccttgcgtatgttcgtctaactgtacaaaagccccatatggttgaataccagtaaccgttccttctactacatccccaatacgatatgtcattggtgccactccttaaccattagtctatcttctatatgtatcccggcacgccgggtaatcgattaagcaatcgttgccttaatgatcttaatatcttctactggcttgtccgcatagtcaacacgaaccttagccatatcatcaacaacgtccataccttcaacaacatgcccaaagacagtatgacgcttatcaagccacggcgtaccaccttgtgcaccatatgctgtcacaacttcgtcagggactaagccatttaattgacgcaacatgtttgctgggacacgtgaagcttgcacaatgaagaattgtgagccgtttgtatttggaccagcattggccattgacaatgcaccacgcaaattaaagacttcgtcagagaactcatcttcaaacgcgtcaccccaaagtgactcaccacccataccagtaccagttgggtcaccaccttgaatcataaagtcgctaatcacacggtggaagataatcccatcgtagtagcccttttcaaccaagccaacaaagttttctactgtctttggtgcttgtgccgggaacaattggatcttaatcgttccctttgacgtctcaagcacagcaacaggtccgtcaaccgctgccaaatcaaattgtggcaatgccatatttattttcctcacacattcttcaatatattccttagctattatagcataatcattaaggcgtctttcaagcgtcgtaaaacgtgctaaacttagtactagttgtcattcgacaggatatataaatatacgggagtagaaatcgacatggttcacatcattgatttgttccttcacctcgatgttcatttgaacaacttggtgaatgcctggggtgtttggtcatacgtcgccttgtttgcggttatctttatcgagactggctcagttattttcccattcctaccaggtgattcgctactgtttgcggctggatctatttcagcgctacatggtagcattttaaaccactgggtcttaatgattatgttctggattgctgctgtttcaggtgattcattgaactttttcctcggccgaacagttggtctgaaactagttaaacacccgctgcttggtcgttttatcaaagatgaacacttggcagaagccaacgactttttcgttaaacacggtaagatggctgttatcttaggtcgtttcctaccaatcattcgtaccttagtgccatttacagccgccatttctgggttcaagtaccgcaatttcattgcattagaaatgattgcggcgactatctgggtcgtcgtggctgttgaagcgggttactacttcggtggtattcctttcgtcagtgaacacttctcattggtcattattggtatcttggttgtcactgcactgcctgccattatcagtgcaatccgccaatcattaattagtaaaaagcaaaaacaaatggaacaataaataaaaaagccggttcataacgaaccggcttttttattaacatcattagttttccaacttagaagcttcttcatcgataacaacgttaccagcttcaatttcttcaaacgcttgaccaattggctttactgagtcgaagtgagacaaagtaggtaaaccaccttgctctaattcgtgggcgcgcttagcccccaaagcgatcaacttgtaacgtgagtcgacacgttccaacaacttatcaactgatgggtataaaatcatgcttctagctcctcaatcattgtaatgtattctggcaacactcggtttacgcgcaaacgctccaccttaataatatccttaatacgatcaactgccaaaggcacctcatcgtttacgacagcgtaatcatagttagccatcatgcgaatctcggctgttgcagctgaaacacggcgatcaataacctccattgcttcagtaccacgtccgattaagcgctcttttaaggcccctaaatcaggtggtgtcaagaaaatataagccccttcaggcatcttttccttcacttgcaacgcaccttgcacatcgatttccaataggacatcacgtccagcagccaatgtcttctcaatgaagctctttggcgtaccgtagtaatttcccacgtactcagcgtattccaacataccaccgtcagcaatttctgcttcaaactcttctcgtgtgacgaagaaataatcttccccattcacttctcccgttcggggttgtcgcgtggtcatggaaattgaatattgaaagtcgatgtctgattcttcaaacaacgcctttcggacagttcccttaccgacgcctgacggacccgatagtacgattaatacgccacgcttcatggtaatcttactcctatctatttctctagctaatcatttatttattctactcgttttttctgacttagacaacaagtacaacacaccagttaacacaacatctagatttgctaagatgtatgtccgcgttaagtgatgggtcggcgtcggtaacgcttgtcggtttgtgcgaccagccgccacaatcgcggcaacaaaggtcgtcaaatcatactcctgcagtttatcaactgccaacaaacgagccaaacgttctattgttgccaatccttgaccagcttcatccccagtcgcatcgagatcaatatctcgcgctaaccattgttgccaggccaaccaaaccggtagctccgttaacgcatttgcgattggtgcggtcacaggatcggttgctaaccacttcaccagttgcacgccacccaaccaactaatatcaacgtcggccggcaatgcgtaatagtagccacctaattcacctaacacttgcttcgtgcggatttcgccgagtgtcacgtactcgccacttaaatcagggaaaaagtccagtaaggggccaaattgccaaggtgttcgaatataatgcaccacggcatcatctggtcgtgtccaatcttcaggtaccccatccataattgagactgcatagatttccttggcaccatgatcagcggcaatatttattggtaagttattactgtaaccaccatcaatatattgtttcccgttaatcatgactggcgaaacgaccggataaaaagcactagaagccaatatccaatccgtcagttcatcagccgtggtttcgtctgtcaccgaaaaactagctggccgcaacaatggtaattctgtggcgaccaaggtcatttcagctagccttggcgttgccagttcatgcgcaaccacgggatagatcaactgacgcaacgattctttttcaaagtagtgccgaccaacaaggtgcgtcgcaactgttttactaaaattgacccgtgagacaccaacttctggcacttcgtacacgacgtccgttgtcaacgtgtcccaagtcgcgtgtgaaattgtactatcaaggtgcataaaggacatcgcattaatcgagccaactgagacccccagtacctcatgcgggataatgccacgacttttcaggacgtcaaaaaccccagcttcaaacgccccatgcgcaccaccaccaccaaggaccaatgctactggatatgagaacgtgcgccgataggttagttcatcaacccgttcaaaaccatctagcaatggactgttcgcttggtttggcgctactttcatttgtaagcttttcactcgatgcttgctaaagtacgtcataagttgctcgaataaagtcagtcgatcaaccgtcttccaggctaatgtgctgactagcacaatatgaccaccttcgttgcgatagagcactgcgcccactaccgtttcgttatcaacaaatagtaaccctgctgatatactctgtgcttgctgatagtgcaatcgcgcttcggcagcatctgaaaacatatttaataactggccaaacggcgccatttgtcggttagacaacttgccaacaattatttccatgccccgtcctcactttcaatcatacgacccattttaagcttgtttcaccaaaaaaacgagcatgtttgctcgtttttaggattattcagttcgttttgcaacagcccgttgaatcaaatcacgggcattttctttagcagcatccgtcagttcatcgcccgacaacatgcgtgcgacttcatccacacgctcttcgtccgttaactgttgaatacttgtttcagtacggtcaccaattacgcgcttttgaataaagtaatgatggttcgcgaccgccgcaacctgtggtaagtgcgtaatcgtcaacacttgtgaataacgaccaatcaccgcaattttttccgcaatcgcctgggcgacacgaccagaaactcccgtgtcaacctcatcaaaaataattgaggtaatcccttgttcccgtgaaaaaatggttttcatcgccaacatcatgcgtgacaattcacccccggaagcaatcttcacaagtggtttcgcaccttcaccagggtttgtttgaatataaaattcggccagatcgtaacccgccgtatgcaacgtggcgctagcggttaaatggacagaaaagacggctttttccatataaagatctgctaattgctcgtgaatctttttggcaagctgtttggcagccttttcacgtaactcatgtagcttatccgcatattgccgtgccacgcgttctgcttcctcaacttgttcagctaactcagcagcggattgttgcccgccacccatgtcagctaactcgctatcgacatgttcttgatgtgccaagacgtctgcgatcgtcgcaccatacttgcgttccaaattacgaatcaaattcaagcgatcatcaacctcgcgtaaccgttcggcatcaaattccaatccatctcggacagacataatttcagaagccgcttcttgtaattcatagtacgccccgcggactgcttcggttaacttgccatacttcggtgctagttcttcaatatcttccaacgatcccattgctgtcgaaatcgtctctaacccgttattgtcccagtcaccatcaagggcctcatatgctttagacaaagcttccaaaacatcctgaaagttcgttagctcttggtattcagcttccaacgcttcttcttcgccatcaaccaaagcagcatcagctagctccttgctttggaaactcagcatgtccaatcgttgggcccaagcttgttcatcagcctggcgtttgtgaaaggccgtctccaaactacggtagttttcataggctttttgatacttttgtgcaacgggtgcaatggcttttttggcaaattcatctaataagcccaagtggcgttcgacttgcatcaactcttggtgctcattttgcccatgaatatcaacaaggtgctgcccaatttccttaagcgtcgccgcattgactaaactaccattaacccgaatcacgtttcgcccacttcgctgtaattcacgatgaatcaacagttgattatcctccacggggatgccaagctcgttcaacactgcaacaactggctgatcaggttctacgtcaatcaacccttgcaagacagccttgtcagcaccttcacgaataaagtcttgcgacccacgaccaccagtcaacaaaccaaccgcatcaatgataattgacttaccagccccggtttcaccggttaataccgtcatccccggttgaaaactaatattcagtttcgggataatcgcaaaattctgaattgataattcctgtaacatttgcgtcctcctacctttctactaagctttcgccatcaagtcagtcgcaaattgttgcgcccacacgccttcgtttaagatgactaatacgccggcgtcatcgccaatcaaaccaaacacatcagttaaatcagcctcttcgagcgccgtttttaacgctggtccagttcctggcgcaacacgaatcatcaccatgttagcttgcgtcttaatctccgtcgtgctttctttcaaaatacgccctaactgacccaagtaatccgaaccagacatcatggcatacgcaaagccacccgttggcaatggcacttttaccaattgcatctcagtgatatcacgtgagatggtggcttgcgtgacttcccaaccagcctcgtttaatttttgaaccaaatcttcttgccgttgaatctgttcattactaatcaatgacttaattgcttgctgacgttcttgcttacttcgtctcatccgcattttcctcacgacgcgcgttcaattgcgcatgtgcacgtgttacaaccgcctcacgctctgcttcagtcatcgtgctctcgccaccgtccaataccaagtgtgctaagaactcgatgttacctgacccacccttaattggtgagtaatcaagtgccacaatactaaaacctgccgcttgcgcataaccagcgactttatcaagaaccgccaagtgcgttgtggcgtccttaacgataccatgcttaccaattgcttcccgaccagcttcaaattgtggcttaatcaacgtcgcaaccgaaccacctggcgtcaaaatcttcgccagcggtggcaaaatcaagtttagtgaaataaatgacacgtcaatcgtcgcgactgccggctgaccgtgcgtaaagtcagttggttctgaatagcggaagttcgtgttttccatcaccacaacgcgttcatccgaacgtaacttccaaaccagttgatttgtgcccacgtctaaagcgtagaccaacttcgccccattttgtagcgaaacatctgtaaaaccacccgttgatgaaccgatgtccaaaacaaccttgtcctgcactgaaatatcaaaaacttcgagggctttttctaatttaaatccaccacgtgacacatatggcatcggcgcccctttcaaatgaagctccgttgtgaccgggattttctcgcctgctttatccatgcgttgctcattttcacccaagatttcaccagccataattgctcgcttcgcttgttcacgtgacgtaaacaacccttgttgtactgctaaaacatcaacgcgctctttttcaattgccatctacttctccacaacctcttcaaaataatccagaaatgacaacaacaaagttgtttcgtttcccgttagttcgccaaactttacaatggcatttgtcgcaattcgaacctgttcccgcaaggcatccttcgcaccgtcaacgcccaaaatagttgggtatgcttgcttatcggcaacatcatcctgccctagatcatccaagtcatctttgatttgaaaggccaaaccataggccataccgaagttccacaaggtttctttgacttcatcagacgcatgggccatgattcccccagcaattgccgcgtacgcaatcagtgcgccagttttacggtagtgaattgctttagcttgatctaatgagatagttgctgcgttagttgcggccatatccatgacttgcccggcaaccatcccatcagcacctgaagccaaggccagttgtaacgtcaattcggccttttgcggtgttgtcaacaatgggtcactcgccaaccattgataggccaatggttgcaaggcatcccctgccaaaatagccacatcttcaccaaatgccttatgcgtcgttggcttgccacgtcgcatgtcgtcattatccatcgccggtaagtcatcatgaataagactgtaagtatgaattaactccaacgcacttgctgcccgaagcaaaccgttgatacccaatccataagactgcgccacagctaatgttagcaatgggcgtagtcgcttaccgcctgccatgacggcataagtcatggcgtcacgcatcgtttggttagatgtactgtgtgctaactcagcagctaacttatcctcaatttgtgggacaacagttgctgaaaactctgataatttcatgttaaccctctggttcaaaatctgatgtcgtcccgtccgcattcacaattttcgccaaactctgttcagctgtttgtagggtttgttgtagttcttgactcaacttaacacccacttcaaattgtttgagggcttcttctagcggtacgtcacccttttcaagttgcgcaacaatttgttccagtgttgccaaattttcttcaaatgtcttttctgccattatttttcactttcctttgctgtaaccgtggcgtctaattcaccagtcgccaaccgaatatgaaccgtatcaccaacagcaacatcatctaccgtcgttaaaatgtgcgtgtcatgttcaacaacgctgtaaccacgggctaagatagccaatgggctcactaactgcaagccagccacggcgcgaccaactcgttcctgggaacgctcaacctggcgggtcatcgcatttactaaacgtggtgccaataagtcaaattgatgctgacgctgcgtgaccgttgtcgtaaccgcttgttgtaaccgttgttgcgcgatatctaatcgttgtaaatatccttcgtacaaacgagctggttgtgtcaacacgtaactattttgtaaccggcttaggcgttcttggttagccacaacttggcgctgcatttggttaaccagtcgttgttgcatttgctgaatgcccaaccataagtcagccaatggtaccggtgtcgctaattctgccgctgccgttggtgtagcggcccgctgatcggctacaaaatctgcaatcgttgtatctgtctcgtgaccaaccgaactgataattggcatgggcatggtcaacatttggcgtgccaccgcctcctcattaaaagcccacaagtcttcaatcgagccgccaccacgccccataatcaagacatcataatcggctgcttctgcaacggccgtcatttgcttcgttaatgacggtaccgccccatcaccctgcacaactgcaggatacaaaacaatttccgcaattgggtaacgtcgtcgaaccgtcgtcataatatcgcggataacagccccgctaggtgatgtaatcacagcaattttcttaggaaagcgtggaattggccggcgaagttggtcaaataaaccttcagctgatagcttcgcttttaactgttcatatgcctgataaagggccccgacgccatccggttctagcttatcaataataagactgtacgacccattgggcgcgtacaaatccatgtggccaacggcgttaactttcatccctggttctaacttaaattgcaacttttgaaaggcaaacttaaacatcgttgcattaagcaccgccccgtcatccttcaaagaaaaatattgatgaccaggtcgttggcggtaattagaaatttcacccgtcacatagacttcttttaaatacggatcagccgtaaatttacgctttagataactggttagcgctgaaaccgttaaatagtctgccatcctgcctccaatgtaacaccatgatgtaatgcagccaactcaactgtcgtttgcaataatgtggcaatggtcatcggaccaaccccaccaggaaccggcgtaattaagccggccactggttccgctgaagcaaagtcaacatcgccaactaacgaaccgtcagccattcgattaatcccaacatcgataaccgtggcacccgctttcaagtcggatcccgttaccaaaccagcgacaccagttgcaacgataaccacgtcggcttgtagcaataattcgtggcgtaagttatctggtgtatagcggtgtagcaatgacaccgttgcatcagctgcttgcgccaacgcaaacatgggccggccgaccaaaatggagcgaccaataatcacaacattctttcccgccaacgtaacaccctcatgagcgagcatcgtcataatgcctcgaggtgtattggcaattgggtaatagccttcccgattggcatacaaacgaccaatgttctctgggtgaaaaccatctacgtccttagctgggctaatcgcttcttggattttgtgttcatcaatgtgacctggaaccgggctctgtaccagaatggcatcaacgcttgtatcagcattcaactcggcaatttttgccaacaaagtttcttccgccgtctctgcatcataacggatggtttgtgcattaacgccggccttactagcggcacgctccttattacggacgtatatttcacttgctggatcatcaccaaccaaaataaccgctaatccaggcacaacaccagcctctgataaacgcgtggcttgttccgtaaccgaagcgcgtaacgccttggcgatcgccttaccatcaattaactttgccatggtacacctcactttttattcattactaatgcataaattctaccacactaactgaaaataaaccatgaatcgcgataactaaaaaacaggaaacccttgatatatcaaggattccctgttgcaacagtcgttattaattttcaaccgatggccgtaatagaaaatgaataaagcttagttttgcttaacaaaataacgattataaactgtaattaaggctgtgccaaggacagcaatgaccaccgtattcgccaaagcagcgaccaccccttgctggtatgactctgataacgccaaaccataaatccagtggtcacccaagggtgcaatcactaaccaagccaccacattggcaattagttgccaaacattaaacagcactaatttgcgggccgtcaatgaaccaataaacaacccaattcgttgcgttgctaaacctagaaatagaccaaacatgccatcagcaatcgcccatgtccaccaaaccgttcctgatgccaggccatcatttaatgtgtgcccaataaaggcaacaaccgccccggcaatcggaccgaaaatagccgttatcaatgccaaccaagctggtgctaacgttatcttcgtgttaggcacgccggctggtatggccacgtacttaaataacaacaaaaacacaatgataccaacgatcgtaccaatgaccttgtgggccgttaaaatattgtgcttcataataattaaatccccttaatcatgactatcattcaaaacaaccaaatcatctggaatgtcttggccgtttatttgtttgtaatacttacggaagacatcattatacgtgccttcattaagtgcttcaggatgcatggccagataacgaatcgtcttaacctgcatgacttccgtttcattcggcttacttgaatctttaattcccaccatcggcgacattaaatcaagtgcggatccttggtgcttgagcgctaatgcgtgcccaaattcatgaatcactgtatgctcagcctctttatcgtgtaaggccgtaatatccgccgatgtgactgggccatacaccgcccctgacaaataatcctcacgctgtatcgtttctgccaaccacaccttcgccgcatgggctgaaatccacatcgtattgccaccttcagtcgttgtggccaataccgaggtatcttccttaccagccgtgtcagtcatttttttatacccaaccaacaactggtagtcactatcttgtggccagacatttcgatcaacattttcatcctggttggcatcagatgaccgcactgagatgaactgcacccccagtgcttgattccacaccttcgctgctgttttaacccacttcaacgcctggccatccgtttccttcataacccgactagataccacaaccttcatgttcccggcagcatttaagtcccaatgcgttgtcactggcaacttatcggcagagttgtcaccttccaagcgttgttggcgggcaatttttgccagataatctttttcctgctgggccgcctgtttcgcttccgtcacgttcatatagtatctaataaattgtggggctaccaacaccaccaaaataataattgtcatcaccagcgctaaccgcttgtttcgactcatacgctttttccgtgccatgtctcactcaatctttctctaacgttcaattactctgcttcagattcatcagactcggccgctgcgacagcctcattgatgctttgcaattctttatcgaaaaaggtcgcaatcttgccttcaacggattctgggtcatccgcaaaagccgcgacggttgctgccgtttcaattcgcagaccagacttggtaaccaacgggtgctccgcaatcatatataacgttacttctgtctctgggtcattaatcacaatcttactaattgcgttggtataacgaataggtagattaaccaaaccggtttcaacccgtaaactaattggttcatccccactaatcagtaactctgcgctgaacaatttctcttgtgatgtcgcttgttcaacataaccaaacaaatcatccaaattaatggttgcttgatcagcggcagtaaagcttttgatttcataggtttcatctttcaaagccgcaatgaaatcatttcctgtcatttgcatggtacatctcacttcttcattaattatccttccagtgtagcacaaaacgggcgccagattatcatctagcgcccgttgttaaacatgttctgaaagtttgaatccgtcatccaacgcgattcaaagcatctttcgtcacacacttatttttagattggttcaaaaacgtgattttgcaagagtaattgttcatctgcccgactcgcgacatcgcggtcgtgcgtaattaaaatcactgtcttaccaaattcatgtgccagttcagcaaacaagtccacgattttttgtgagttctcatgatccaaattaccagtcgcctcatcagcggcaacgattggtgcatcgaccaataatgcccggacaattgctacgcgctgttgttcaccgccagatagacgttgcacgtttttatgagctttttcctcatcaatgccgacacgagctaactgatccagaatatatgccttatcttttgcgtgaatcgaacctgtaatcgctaaggcagtttgcacattttggaacgccgtcatcgtattcaacagattgtaggcctggaaaattgtcgacacgtacttctggcgaaatttagttaacccgatttccttaatcgagaccccatctaccagaatgtctccctctcgaggttcatcaaggcccgctagaaatgatagtaacgttgtcttacctgaaccagattcaccaacaatcgcgtaaaaacgaccagactcaaatgtcagattaacgtcttcatataatttatgatctcgatccgtataccaatgcgttaaatgtttgatttctaatgtcattctgttatctccattaatctgcctgcaaaatttgctttggccgcatgcgcaaaatactaaatgccgcgcctgaaactgataagacagcaattaggaaagccacgccaccaagttcagccaccgcaactggtgtcatcgctgtctggagttcggccgtcttcgtcataccaccccgggtacccattgggccgccacccatattacctgatggcttttgaccaccgcctgggccaccgttttgaccagcgccaccacctggtaggccgccattcgcgctttgcatttgttgcgtcgtttgttgttgcactagctgttttccaattacacctgaaacgccatttcctgcagcagtggcaataccaagggccacaatcagaatggctaataattcggtgaacaattgcgcgacaaccttaggctttgattcacccaatgccaccagaacaccaatttcacgacgacgttcacgtgtaatcaggataataatcaaaccaagaatcaagatacctgcgattgaaactaaccaaacaatcttcgaagcaaaagcggccacgttcttcatgttcgctgcagcggtcttgtactgtgaggcatccgatgtcagcgtaagcttgtcggtatcaatatacttcttagctgccttaacaaaagccgttgtttttgctggttcagccatcgtaaaggtgacgttagacgcgacattctcagtgccattgattgtattagccaaggtatatgaaccgtaaatcgtattcgatggatcattacgttggaagccatcggtcgctgtcttcaccttgtaaatacccacaacagtcagcttaaccgttttcgcatcatcagcggtcgtcttcactgtaatcgtttgaccaaccttgaccttattagctgatgccaattcgctttcaatgaccacattgttagtaccttggtcagacgctttgataccccgaccagatgtaatcttagctgaaccatctgtaaatgacgacgttgctgccgtaagtgacacaccgttcacttgaatatcaccactattattctcaccacccattggaccgccgcccatggcatttgatgtcgttgtcgttgtcactgccttaaaactattcgcatttactgacgcattattggtgatgttatacgacgaaacattagcgagtgccgcaatctttttaacctgcttcacggttgcggttggcattgtaatcgccgttggtttcgtttcactgtttgatgttgaactagcgcttgactggcttgctttcatctgttcaaacatcttctcgcgattagctgataagctgactgttgagccaactgcattagcggcgttattggctgctgttaatgcagcgttctgaatgattaaaccagccatgacgaaaactaaaatcacggtcgacgtcaacaccagtaataaagaacggcctttgcgggtccataacgtaattcctgctcgtttcacaaaattcattttaatctcctatcactgggtcgtcgtgccgttacttgcagcttcatctactgaattcgttgtacccgaagatgtgttgccatttgaacccgcctgattattttccattgggccacggccaccaaaaccaccggattgttgcgtcatagtgggccgactagtgtctgacccgattccgaacggatgaaaggcggtgatgagactaaacaccattgctaagctagcaacgcccaaggtcacccattgcaaccacggccgttgacctttattttgattacgatctgtcatatcgtgttcctccaaatgtttttgacgaggattatcatatgacgcttagcttagcgctatcttcacgccagctaaaacgaaacctaaattttgtgaacaaacctggttagtccagcaatgcaaaaaacgccacatcagcaaatgctaatgtggcgttttaaacgtaacgattaaattacttgttaacggcttccttgaagtccttaccagccttgaaggcaggtgcctttgcggctgcgatttcaatttctgcaccagtttgtgggttgcgacccttacgtgcagcacgctcgcgaacttcgaaagtaccaaagccaaccaaggcaaccttctcgccttgtgccaattggtccttgataacgtccaacaatgcgttaaccgtcttagtcgtttctgacttagcttgtccagtctttgctgcaaccaagtcaatcaattcagtctttgaagccatgtttcaatacctctttaatagttattactcgaatagtatacgctatgcatgcatgagaatactagacttttgtgccaattagttacccactcttagggaaatctaaagaatatatgtaaaatgcatactcaaatgtccctttacaaagagaatgccgctataactggcaagttacagcggctaagagagagaaagagaattggttgtgtaagacatctctgccctacgcatataaatataacatgctcgttgtacctttgcaaccaatcaccggtttaatctcctaaaggtcggactttctacacaaacggcacaatttcttcacggttcgtgagttttgccgctgctgcagcgtcgacaatcaccgtcacattagggtggcgttgcaacacactagctggcatatcttccgttactgggccctcaatcatggcagcgactgcgtctgccttgttctcaccatatgccaccaacaagatttgcttagccttcatgatgctgccaattcccattgagtacgcataacgtgggacatcattttcatccgcaaagaaacgtgcattggcatcaatcgttgactgggtcaatgtcacttcgtgggtcaatgaatcaaagggtgtgcctggctcgttgaacccaatgtgcccattttgccctaagccaagaatttgcaaatcaattgggttgtcgttaataatgcgctcatagcggactgtttctgtagccgcatccgccatgccatcaggtacatagctctccttaaacggcttcttattaaataggtgctcattcataaagtaacgataactttgttcgtgagtccctggcaatcccttgtactcgtctaagttaattgagacagcgttgctaaaatctaaatcacttgctgtaatcgcatcatagattgaaataggggttgaaccagttgccaacccaaagacagtggcaccatttgctaacgcctctgcaaagacgttgtagcctgcttggccgcccattttttgatcactcacttgtagaattttcatgttattctccccttaataagatgtctatcaattcctttggtatagaccaattataaaccatggtctataccacttgcaagtcatgagggataaaaaaattgacagccattagtggccgccaatcatgtttatgctgttcaacttttgtgccattcatttgtgcgactaaatgaatcacgaatttcctttggggcatcatgccaggtataaacttgcttcaaatcgccttgcatcacaacgcggccacgctctgctgtgtaatcgcacgtaatcaaagtgagttggttcttatttggctgattataagtcacttctacagctgtcggttgcacaacctttactgacgttgcttgatagctataaatttttgacatgtccgtcaaatacatatgctggcccgtcttaccctcatagtaaatcggactaaagaggaccttcttattactgctaccttgaacaaaatgactcgccaacgagtagttgtttttccccatctcttgatcaggataaagtgttcccgcgccaaatgtgagtgctatatcgttaacacccttgctaatcggcaaactcagcccaatctccggtacagaaaccatcccgatgtaacgcaactttcctgcgtgtaagcgcgcattaatcatttcttgggcggtcagtgatttaacacttttccaatcataattcgccttcgctgttttcgcttttgcgaccattttttgtgtcaccgttggtttatacgtcttaatcattaatgtgccaatttgattgtgaaaaatcagccctaacgacgccgttacaccaacccccaacagtgtgtattcaaccgctttactcttcattgtttccctcacaaatttctttcatgtgtattctagaggaaaatgacgcgaaacgtgacgaaaaagggtataaaaaaatctcagttacgcaacaagcataactgagattttaattggttgattatcccttaacagccttttccaatgtctccattgcacgtgagtgacgtgcaatgtcagccatcaattgtgcctcaaaggcatcaacagactttgactttgtgtccgttgaaccgaagcgacgaatcgtaacggtgttgttgttaacttcttcatcaccgataaccaacgtgtaaggaaccttagacgtttgggcatcgcgaatcaagtaacccaacttctcattacggtcttcgtattcagcacgaataccttgcttgatcaaacggtctgccaagtccttggcgaacttaccgtgtgcatcgcggttaactggaatgatacgtacttggtgtggtgccaaccaagttgggaacgcacccttgtacatttcagtcaagtaagccgtaaagcgttccatcgttgagatgataccacggtgaatcataactggacggtgcaattcaccatcaggtccaacgtagttaacgtcaaagcgctcaggcaacaagaagtccaattgaatcgttgacaacgtctcttcgccacccaaagccgtcttgatttgcacgtccaactttggtccgtagaacgcagcttcaccttcagcttcaaagtagtccaattccaagtcgtccatggccttcttcaacatcgtttgggccttttcccacatgtcgtcgtcatcgtagtacttttccgtgttctctgggtcacggtatgacaaacggaagcggtaatctgtgatatcaaagtcagcgtaaacgtcgatcatcaagcccaaaatcttcttgaactcgtcctcgatttggtctggcatcacgaacgtgtgaccgtcgttcaacgtcatttcacgcacacgtgacaaaccagtcaatgcacctgacttctcgtaacggtgcatcattcccaattccgcaatacggaatggcaactcacggtatgaacgtggcttgtgcttgaacaccatgatgtgagatgggcagttcattggacgcaattccaagaactcgccatcacccatgtccataggtgggaacatgtcatcgcggtagtgatcccagtgacctgattgcttgtacaagttcaagttagacatgattggcgtgtaaacgtgttggtaaccgtcttgcacttcacggtcaacaatgtaacgctccaacgtacgacgaattgccgctccatttggcatccaaacagccaaaccggcaccaacttcttgtgacgtgaagaataggtcttgctcagcaccgatcttacggtggtcacgttccttagcttcttcacgacgcttcaattcagcatcaagttcttcagctgtccagaatgctgttccgtaaatacgttgcaacattgggtttgaagactttccgcgccagtaagcaccggcaacagacgtcaacttaaagtgcttaatccagttcgttgatggtaccaagccaccacggtccaattcaacgtgctcaccttgcacagcaattgagatgtgctcatcagcaggcaaatcgttaatcaattcaatcttgtatggatcgttcttgaacatttccaaagcttcgtcacgcgtaatctcacgtgacacgattggcaagttttctgaagcaatttgcttcatcatcttttcaatttctgggaattgatctgcagaaatttggctaccatcgaccttatcagtatcgtagtagaaaccattttcaatggctggacctacaccatagtgaatttgatctgggtacaaacggttcaatgcttgtgccaacaagtgtgaaacagagtgacgcaaaagttgtgttccttccgcatcatccttggtaatcaatgaaaattcaccatcttcgttgatgccatcgttcattccaacgtagtggccgttcaactttcctgacactgacttcttagccaatgactttgaaataccgttcgcaatttccaaaggcgtaacgccagcagggaattccttaaccgcaccatctgggaatgtaatctttacatctgccatgtgtcttatctcctataatgactatccatcgacctaacgcgtggaaacaaaaaacgtcccgtcacaacaattatacttgctgtaacgggacgtttgcacgcggtaccacccgagttcgcgaaagtttcccttcgcctcatcgtccccttaacgcgggatacggaattggttccccaattcactcggaagtagtatcgcgtaacgaccgctatctgcctcccaccactggcaaactctcttaaaacgattttgttatccgacgtgtcttcgtcaacgttttatactgacgtaattatagcacatgtcaggttaaactgaaaatacatgtttttgtcccaagtttggcacttttgttggtttcggctgataacttacgtaaaataagaaacatcgagaagtgggaaaagattttaattttattgagggtatttttcatgacgtttgttgtatttttgatggttgcaaccgccattttgattgggattaccggctatctattttacgtttactcagtgcggccaacgaccagtaatcttgtgttttcactcgtgttcttggttggcacattagtttttgtctttatggggagcgtcccttatttgttggcttttcaggccggtgtttaacacccatatttaattagcatcgcgttggcctatcgcagggacaattgtcgatgctttttagaaaaaaagagagcaaggtggttatccttgctctccttccgtcgcataatcattacagagaaaaatcattatgcgactcgtggttatacgttctacaggttagcctgttaggaaggcaaatttgggtaaatcacttcctcatgaacagttcctattttaggccgtcttatcagactttgcttgttttttattagttgttttttgaaaaattttaatttaaaaaccgcaacccttttagcaagcgttgcggtttttctgtgattaatgagataccatcgtcttgtggttcacatcaatcttatgtgattcgatggttgcttcaacaacgtcagccacgtcctcatcattttcttcaatcttaaagatagtcttgtaaccagcaaaggcaacggctgctgcaattaaactaaacaagctcatcaaaaatgtcatcatgatctctatctccttcgtgcgattgatttaccttacttgatgtaattataataccccagtaagtggctttatgccgaaatggtctggaattggcacattttttcgtttttctgacgttatcaccgctattcgcatcaaaactggccggatttcggtcaaatatgggaatttcattataaaaagccgtgctagcaaagcacggctttttaatttgcactatcaatcaaatcgtcctggattgccgagtaggtgatcgtgcctgtgtaagtggtggctttaccattgttactcaaattcacctgcatatctcccactggaatagtgccactttttcccgaaccggttaaaacactttgaccaaaccccatcgtgagaccgcctaaattgctcgtaccatcctgatatatattctgattatttaccaccatggatgtaactggcaaagtgtaactgccatcgttcattgctgatgtggccatcataatatggaattttgtatcaaacatattactgtatcgcaagtcaccttgtggcgacaatgtaatatgtaaatctcttacagatgctgttccctcaaatgaaggaacttctaacaatgtcaggccgttcgccattaatccagcattacccgcagtcgcttgttgcaccgtttggcctgtaccatcaacattcggattactatacttcgaatcagttactctggtcacacggacctcaatattaccgggttcataaatatatttactttttctatctgtttgaataaatttccacggcgccaccaaatcgttattatcaactggatctcctgattctttgttgccgaaatactgcgtaccgacttctttacctgtttgattatcaatatagacaaactgcccagttactgctgtttgtgtgttaagcgtaatcgcaccaaacggggaaagtgtctgatcgcttgactgagcaatagcttttaacgtatcaatgcgattagtctcaccataaattgattcagaaccaccgaatgcatatagtggtgtcgaaacaccatcaatcatcccctcataacgtttaacgccatcaaacgatagttgtgcattatcagtcactaccgttccaaaactcacatttccagattgtccggcagtttgttgtaaaaagacgtatagcttaggtggtattttatcaataagtcgatattgccctggaatctcttttggcactaaaagttgcttcgtatcaatttcataaacagcattttgatactgattgtcttcatctgccagcaccgctgaaccgtctaccaattttccaacaacgccttttatcgtgtcattaagccgttgcccatttaaataaatttggacaggtacagttatttcatcatccaacttggtcaacagaccatacataatcataaatgcagttgccgacgcggaattattcgtattgttcaagacatcgtaaagtacaattttaattgtattgaccccttgtgggttatccatcgctacatcagtgaaggatattgttatcgtttgcccaggcgcaatatcaaaagcacttgataattttcgtgtcgtaccatctggtctgtcgtttggctttggatcggcaggtggcgctacaattcccgaaactgaaaccgcactaaactccgtaccgctcatgactgacgcagcgtaacgtatttgcttagtttccgtcgaagtattctttatagtttgcacaacttttacgcgtttaatggttggaccaccaccggttgcaggtgcatactgcgaataatcaatcggggtatcaacaattgcgccattttgcgtgacttcgcggtaataagctgtcgttatttcaaaatcattccagagattaaatatggggtctgaactatcatctgcatgtatgattgtgccacaaaaaaaagtcatcgcaaaaaccaacaaacccattaataatcgtcgcaccccctttacctcctttctgcaaaaaacctcacgcatactgcgtgaggatcaaaacattctgcttaatcaagcaccaacttaggccggatcatcaatcgccgctgcatttgctgaatcatctgctttctggccaccttccgtaattaagttcgtgtcttgtaacgtgtacgtgataacaccagtatacgtacctgacttaacttgatcagatgacaacttcaatgtggcgctagtttgaccagatgcaaatgtaccgttagtatccttattaccagaaagcaccaaatttccaaacgccgcttgctttccgtagtcatctttatcagcggtaatagttgcatccgtcaattggtcagttgccttctgatctgcaaccttagcaacagtacttgtagttgcatgatacgtgtcagcattttctttaccaaccaacaacgcattattaggtgccttcttaggcataccagctactgttaatgccaacgaagaaaccggcagttggttacctgcggcgttatacagcgatgaagacgtcgcgtaaacttgataaccagtgttaccaccacgtaaatcgcgaactacaatagctcccaatcccttatatacatcagcagttgcattggctgcattaatcaaattagacttgcccacagtgctatcatagacaccattttgtgtaaatcccttttccattccagctgccgcttggcttaattcttttgaaccaaagtcaaaactcggcacattgagtagcgtcaatccaaaagcttgcttaccagctgccgcagtagtcttgctaccatccgcatttggattctcataaccagactcgttggtataatcacctgaaaattgaatctttgtctttccttgattggttgcaacatcactcgacgttcccacaatagtgtctgctgctgaagcaaccccactaacaccgacaacacctgctaatacagcagcgcccaacatcaattgcttaatcatatttaaattcccctaattctcttaatttctctattacgttaatcactatctcaataagtaagttagctctctccttctaacattacttatcttcaccatcctgcttcttgcgtcgtagcaacaatataatcacaaacatcaacgctgccgccaaaataccaatcaaccaccaaatccacgttggaatgaaggccgtcgtgcgttggagtgttgtttgtccttgctgtgcggctgaaatcgtaaagtcacctgtaaacgtccatgactgcttactcttcacatccgtcatcttcacatgatagcggtacttaccggccgtcaacaccttctcagcaggcacactataagtgaacgtgctgttcggggtcacctgtcgattagtttgcttgtcagtcaacacagtttggttgcccttactaatcgttgtcgcaacagacatatcaccgatgtaattggcttcgttattagcaacacccaactggaatacctgctggttcgtaccactaacaacacgccccttttttacctcagttaagttggcgttaacctgcttatcagtctcagcaatctttacacccttcacgtatgtaaattgattggtaaaacctgacttcttaactgctttcccggggacgtcctttgtcacgaccactgcacccacaaccgtgccatcaaaactttgatccgccatcttaaaattgattggcgcataaaccgtttggcccgcgccgaccgtgacactttcttgtggcaccttcacaattttccgaaggtccattgttttagcaagcgaatcattattatgaccactgtcataaccaacaactaaattgttgttggtaaacccttgttcaactgacacatggaacgttgcttcggctgcggatgtattttgaatatacacaacgccaccaaattttttacccggttgtgttttaatattccaggttgttgatccgtcatcttgctgaccatcgattgccgaaagtgcgactgaaaactcaggcttgttgttactatagtcatcagcagatacccttgtcgtttgaacaacactagctactaacccgagcattgtccccactgataatgcctttattactctcatcccaaattcctcatgtcattccaaaaaactagcgtaattataccatttagcgggaatgcttactttatttccgggtccctaattttgcaatcacaaaaaaagatgtctcgtatatgagacatctctgtgattaactattcaacttcagcaacttcgtcttcggcttcgtttcggaactgggcgatgtacccagcagctgcaactactgcacttaacaaacttactgcactcatgaatactgccattttccagtcctcctatcaccgattgcttactttatatatttatcatacagcagctaacttaaaaatttcaaaacgccccaaaatcaagctatatcaggcctgttataccttgtgaaattatgattatggcagaatgttctcaaaatcgttcagttctgggacatccccaacttataacaaaaaggcgtgaaccacctgacagcagtccacaccttcttatcgattaagcttctttgtcatcgttcttacgacgcttagcagcgaccaagaacaagcccaacaaagccatcgtaccagcaaccgtcaaccaaacttgttgatcaacacctgtctctggcaacttattttctgcagccaccgttggcaccgtgttatcacgaaccaccaacgttgggtgcattgttgtaatgataccagcagaaacgactggcgctgcagctgcggtcgcaattgcagtatccttctcgttcgctacggcaatcattgcaaccgcaatttcactagccgtggcaccattagcaagcaactcgtttaggtgttgctttgctggcgtcatcttaccagtgtttacaaccgtcttggcatccttaacttgggcatcgtatgcagcttgcgcagcatccttggccttgttgtaggctgtcaaagcgttttgcaaatcagtagccgttgcatttggatcaccagccaatgcagctagcttatcagccgccgcttgcaatgacttgctgtctgacaagtatgcaggaaccgttgcttcagacttggccgtcttcttagccgttgccaatgcagcttgtgccttagcaaccgtttcgttcaacgacttcgtagcagcctcgatatccgccgtcgttgccttaccggcagcagcgtccttaatcaattgcgccaacttgtcctttgccttttgcactgcattgttgtctgacaaattcttcgcaccggcagtttggcctgacttctgtgcagccttaattgccttatcacgcgcatcagttgcctttgtaacggcttcttgcaatgactttgcagctgcttgcacatccgccgtcgttgcttcacccttggcagccttggcaatgatgttatcaagtgctgattgtgcatccttcactgatgactcattagcaactgcgcccttatcaactgactttgccgttgatacagcttggttgcgtgcatcggttgcctttgtaacggcttcttgcaatgactttgtagctgcttgcacatctgccgtcgttgcttcacccttggcagcctttgcaatgatgttatcaagtgctgattgcgcatccttcactgatgactcattagcaactgtgcccttgtcaactgactttgcagttgatacagcttggttgcgtgcatcagttgcctttgtaacggcttcttgcaatgacttcgtggctgcttgcacatctgccgtcgttgcttcgcccttggcggccttggcaatgatgttatcaagtgctgattgcgcatccttcactgatgactcattagcaaccgcacccttattaactgacttcgcagttgatacagcggcatcacgatctgacttggctgacttaacagcatcctgcaacgctgtcatcgcatccttgatatcttgtgtcgaagccttaccagcttcagcattcttcaatacatcagcaagcttgctttgggcagccttcacagccgtttcaccgttgactggtgaggttgcgacattattcgcatccttaaccgcttggtcacgatctgcttgtgcactcgcaacagccttattgtaatcagaaaccgccttggcaacttcttcagcagatgcatccttgttagccaaaaccttgttcaaatcagtttgggcagccttcgtgtcttgatcaactgcatccgcgttcttcgtgtagttcaccacgaattgttggatttcagcatcttgacccggtgcttgttcaccaagcgctgacgccattgtggcaataccatcacgtacttcaagcgcttgtgcaatcacagcttgctcgtcaaacgttgcactgccaccagcaacatcgttgttatcaaagaacttatttgccttcaaagcctctgcccatgttgcgtacgtcttaccatcaggtcccgtaaccgtgtatgagtaaccagccttcttcaaacttgcatccgtcactgaaccaagcttcgtcttgccagtccagttcgtgtcagaagccccatttgtttgagcaatcaagcttgatgacaagttagacttcacaacaaccttttgatcattctcaggtgagtacacaaccacaaagttgttgtcatctgttgtgaacgttgggttagctgctaccgcttcagccaacgtaccatagaccttgttgtcaggtccgacaacttcgtattggtaaccatcgaccttcaaaccagcttcgattgcatcaggcacaaccacagaagcacctgtataacctgttgaaataacattcttcaagttatcaacaacggaagcaatggttggcaacttacgagcagctacattaccagccgtcgtttgcttagccgcatctgtcaacgtcaccgctgctgctgcgttaaccgcattgggatcaaatgaaaccactgcgtcaacaccagctggcaaaccagctaccgtgtacgtaccatcgacattcttagttaccgtcaatccttgtgtgttcttgtcatccagcttcactgaaacaacatgaccattctctggatccacgtaagaaatgattggcgtgtaacccgtcttgtcagtcaccttaaccgttgctgtatcacccgttacaactggtgatgtcacttcagcaactggcacttgcacaacttcaagtgttgcaccggccttcaccttcgtgcttggcaacttgtagtggatagcaccatcttcacccttaatcgcgtttggcaaaaccttttctgtcgtgccgtcagcattgtggataaagaccactggcgtcttaccatcaactgatgggatgtccaaatcagcgatatcatcatcttcgccagctggaacaactgctggattcgtaactggcgtgttcaccacatccaattgcttttgagcgttctcgacgtcagccttgcttgactttggatcgtccaaaaccttttgcaagttatcagctgcgttttgcacgtccttaggcaacgtcttacctgacttcttcacagcatccaagtcagctgctgcatcttgcttagccgtatccaaagcttgttgggccttgttttcagcttgcgtcaaggcagtttgcgcatccttgatttctgacgccgtggccgttgaaccatcagccaacatatcttgcaacgccttcttggcatcagcgacagcttggctatcactcatgttatcaggtacgtttgcaacaacttgcttagccaaatcttgggcattcttcaatgccgtttcagcatttgactttgctgtgttgtaggcgttttgcgccttatccaagtcactttgggtgctattcgcatccttggctacctcagccaacttagctgccgcatcgttcaatgacttatcatcagccaattgcgttggaactgacgcatcaaccgcgttcttgttgttttgcaactttgtggttgcatcatcaatcgctgtttgtagtgcagcttgggccttgttgatcgcgtccgttgatccttgatcatttgaggcatccttcaaagcttgttgcatcttagtttgcaagtcagcgattgccttgttatccaacaaaccagctggtacttgcgtctccgttgcctttgacactgccgtttgacgttcttgcttagccgttgcaaccgcatcgttcaaatcgttcatggcttgcttaatatctgaagcagtggcggtactatcaccaagcttcttttgcaaagccgcgatttgatcagccacttcacctgaaacaggggccgttgcatcaagtgctgacttagctgccgtaactacatcagaacgaacaccttgttgtgcagcgacagcggcagccaattcttgcttagcttggtcgatggcagactttgttgcattatcagccgtcaagtccttagtcaaaccttgtaccttagcaatcgcatccttgactgcatcagaatccttaacagacgctggtacaccagttacggccgtgttagccgttgctgccgcaccttcttgcgctgacttggctgccgtaacagcgtcatcaagggcctgttgtgcagccttaacgtcagtcgccgtagccgttgctgaattaatcgcgtcattcaaggctgccttcgcatccgtcacgctcttgtcatccagcaagtttactggcacattcgtcatatcagacatcgccgtgttcttcacatcagccaagtctgattgggctcgcttaactgcatcgtcaagggcctgttgcgcgtccttaatggcttgcgtcgtgcccttatcagctgctgcattcgccaaggcgtcttgcaacttatcttgcaaatcttggactgtcttaacatcttgtacatttgcaggcacaacgtcgctagcagcatcattcacagccttaccacgcgttgtcgtctcagctgagactgtatccgtcaacttcttcgtagcatccgcgatttgcgttgctgttgctgtacctgaatcaagcaacgtctgcaagtccttagcagagtctacaacggccttttcaccagaaactggtgccgtcttacccaaggcagacttggcagttgccgtcacatcggccaacttgttgtcagccgcttgctcagctgacttcaatgacgcaatggcgttatcaatgtcagtcttagtagccgtctctgaatcaatcaagttttgcaaagcatccgttgcgttcgcaaccgctgcattatcttgccaggccttgttatcgttagacgtcttaacttcttgcttagcttgatccttagtgtcaaccaactttgattgtgcgcctgttacagctgtatccaaagctgacttagccttatcaatcgcttccttagaagaatcagggttgctcaacacatcgttcaaagccgcttcttgcttttgcacatccgcatcatcttacacgttggttggtaccttgttcaaagctgacttagctgcatccgttgactcgctcaaagttgagttagccaccgtaacagctgattgcaaagcagtcgtggccttcaagatatcagccgtcaacgcattcttatcagcaacttggccatccttggccgctgcatcaacaagtgcttgcaagttcgcttgcgctgccttaacagttgcgtcacctgcaacattggctggcacgttcgcaatggcatcgttagcaccgttattagcaacggcacgctttgccttcgctgcatcaaccgcgttttgcaacgtttcttgagctgcgttcaattgtgccaaagaaaccaacttgttagctggatccaacaacttatccaaagccacttgggcttcagcaactgaggcttcattcttgactgtcgtcgtatcaactggggttgcagccaatgccttcttggcatcgtcaattgccttattagcgatgtcaaccgcatcgttaaccgccttcttagctgcatcaatttgtgaagccgttgcatccttgtcagccaacttatcctcaagcgcttgcttagccgctgcaactgaagggtcttcagcagttcccttcatctcaggattctccaaattattaacaacctcttgtgcagttgacttagcagtgttcaaaacttcttgcgccttgcccattgctgtgttgtacgcattttgcgcatcctgcaagttcgttgccgtcgcattattatcttcagcaaccttcttcaagttagcaagtgcgtccgcagttgctttgtcatcagaaatgtttgtggcactcgttgttttatcagctgttgactttgcagtattcaaagctgattgggcctctgttactgcatcatcgtatgccttttgtgcagccgtcaatgcgtttgccgttgcattcttatcagcggccgtgttgtgcaaagccgtcaacaaatcaccaacagtcttgttgtctgaaacattctttggcaccgtcacatcagcagctgcattcttggcatcttgcaacttaccttgctctgccttaacggcatcatcgtaagcttgttgcgcgtttgccaattcagtcgccgtcgcatctgggttatctgcgaccgtcttcaagtcggccaacttaccagccacaatcgtattgccatccatgttatctggtgctttcacacccttagcagtatccttggccgtttgtagcttgtcttgctcatcagttagtgcattcgtgtaagcctcttgtgccttgtccaaagctgactgcgtagcgtttggatcagtcgcaaccttcttcaacgctgtcaacgcatcgttaaccacgtcattgtcggtcatgttagtttgcgccttcgtagcatttgctttgtccttgtttaactgcaacgtctcgtcagcagtcttaatcgcagcagccaactcagccttagccacgtcaatttgagctgacgtaccagcgttgttagcagctttatccaatgcatcttgcaaagcagccttcttgatagctacgcttgacgtctcattagccgcttgatcactcaagttcactggtacaacaacttgtgcggcgtcattaactgacttagcacgaacagctgaggcatctgcaaccgccttcgttaaggcgtttgtagcatcagcaatttgttccgccgtggcatccgtctgcgtcaaagcagtcaaagccttggccgcatcagcgattgttccgtcaccagcagtttccataccgtatggtgcggttgcaccggccgcagccgttgccaaatcaattgcttgcttacggttcttttcagcagccgcaaccgctgaatccaatgctgactttgccgcatcaatttgcgtcttagttgatttttcaggactcttcaacaacgtatccaaggcagattgtgcatctgtcacagccgtctcagttgcaaccgcaaccggaattgacttcattgcaatcgaagcgtttgacgttgacgttgcaagagcatcttgtgcgttagctactgcttcagccaattcagcttgtgctttggcaatatctgttgctgttgacgttgaatccgtacccaaagccttttgcaaagccgcttcagcttgttgcaccttcgtatcgtcttggacgttcacaggcaccttagccaaagcgttcttagcagaatcttgaacatcagccaacgattgcttagctgaggctaccaatgaggccagcttagctgaagctgaggctacagctgctgtcgtgcccgtatcagcattggctgcttcaatagctgattgtaatgctgccttcgcatcattaatgtcctcattatcagacaaatcaggtgttactgatcccaaagcatctgacgccgtatccattgcagcatcacgagccttttcagcagatgcaattgcacccgtcaatgcatcttgcaagttcttaatatctgctgttgaggccgttgaaccatctgcaatggcatccgtcaaagccttcttagcagcaacaacttgtgcttctaatgagacgggcgcagttgctggcatgttcttagctgcagaattcttcgcagctgccaatgttgcttcagctgctgtctcagcattttgcaaagccttaacggctgcatcgatagctgtctttgttgacgtctcaggcgcattcaacaacttttgcaaggtatcatttgcagccatgacatctgtatcagaagccaagttctttgcaatgttcgtttgtgctgtcttggcgtcagacgttgacgtgcgcaaagcagtgtcagctgccgtcttcgcattttcataagctgacttagcattcttcaaatcatctgccgttgcgtaatcactgttagcaacatcaagcaagtcttgtgcagccgtattcaaggcagtgttatccgccaagttagttggtactgtcgcaataacatcagtcttggcacttgcaagatctgtcgtagcagttgccagtgcctcattcaaaccacgcgttgcagtttcaatatctgccgttgtgccatttgctagctgctttgctaattcagcaaccgcctgtcccaaagcagaggtcttatcctttgcttggtcagccaggttagctggaattgacacagcattggcattcttaaccgccgtgtcacgggctgcttgcgcgtcattaatcacgttttgcaagttcgtaatcgcattgttaagatcggcagttgttggatttgttggattgtcctttgcttgcgtcaacaaagtttgcaactcgtcttgtgcatccttaacagcttgttcattgtgaaccgcaaatgtatcagccttagaagctgattccaaatcatttccagtctcaatgaccttggcacgctcatcgttataagcatcaactgcactttgcaatgaggcttcagcagacgtcaaatctgtcttcgttgtcgtagcatcatttgcgtcagccaacaagtcagtcaccttgtcataagccttaaccaatgccttttgcgcgtccgttgctgtaccatccgcaaccgcttgctttgaagcagcataaatagcatcaactgtcgtgtccttagttgctgccttttttgcgtttgttgcattagtgtgctcttccgccaatgcttgcttggcagtagcctcagctgaggtcaaatcattgattgccttagcaatgtcatcagccgttgccgtaccgttagtcaacaacgtgttcaaagcagctgacttatcttgaacacccttgtcatccttaatgttggcaggaatgtctgcgattgcttgcgcaccagcagtaatcttgtcagcaacagccccttgagctgccttttcagcatccttcaagtcattaacagccttggtaattgcggctgtcgtgccttcattattagcaccgtccgcaacagccttatccaaggcatccaaagcattcttaacagcttcgacagacttaacagaatctggcacattttcagccgtcgttgctgctgcatttgcaacatcacgatctgccttagcttgtgcaactgcttgttccaatgcttgttgcaagttctgcaattgcgtagccgtcgtagtcgtatcttcggcagacaacgccttggtaattgcgtccttcgcattcttcacagttgtttcttggtcataaggcgacgtcacagtcttgtccaaggctgccttctcagcatccttcgcattttgcaatgccgtttgtgcgttagaaacagccgtgttcaagtcagacaaagcattcgcaatatcttgtggcgttgcgttagctggcaagttgttaatgacgttagcggctgccttaacactggcatcgtcagaaacatttgatgttgtcgtgtcagttgccttagtagctgcatccttcgcaacgtccttcatggcatccgtcaacttcttctcagctgctgcaatatccgcgattgaagctgttgatccatcaaccaacaacccatccagatcactcttggcgttcttaactgaatcagcatcgatcaatgaggccgccgtgtcagtatcgttcttaacggctgacttcacggccgtgtcaagcgacttcttcgcatctttaaccgcttgaatagccttggcaacatcttctggcgttgattgtgtgtcagccatgattgtcgtcaaattcttttgtgcggcatccaactttgaaccggcgttagccacatcagcgttcttagcaacggtcgtgttggcaacggccgcttgatccgtgtcaacagtcgtgtttgtgtcactacccacagtcttcaaggtatcctttagcgcatcactcttggccttaatatcagccaatgaagccgtatcaggcaagttgttaaacgcagtttgggcatccttaacagctgtgttgtccttagcaatggcattaactgcatctgagttaacagccgttgacatagcatccttaacagcattatccaacgctgactttgctgtattcactgcattaacagccttagcaatatcatcagttgtagccgtcttgtcagccaagaccgtcttcaaatctgcttgagcagtatccaaggcactgttcttggcctttaccgtcgcatcctttgccgccgtcatatcagcgatttgcgtttgctctgagtcagcgtcgccgttagcagttgttgcggcattcttaactgccgtgttcagctttgtctcagcatccgcaatcttcgtcatatcacctgatgccatggcatcattcaaatttgaaactgctgttgcaaccgtcgtgtcagactttgccaatgcgctaacatctggcgtcaaatcgttcttcgtcacagccgccacaacggcatccgtgtagtccttttgcgctgacttaacctttgtgactgcggttgcaatagcgtcagttgttgcagccggatcagctgccaacaagttcttcaattctgtttgcgcttgatccaatgcacctgacttggcagttacatcggcatcgtttgctgaaggcatgttagcaacaatcttttgcgcgttatctgcatcaacgttagcttgctttgctgcgtctgaaacggcattttgtagtgctgtatcagctgatgcaatcttcgtcatatcaccagacgtcaaagcatcgttcaaaccgctaacagctgtctcgattgctgaaccaggggttgccaaagcagatacggcgtcagtaacgtcgttcttcttaacggcagcgataaccttagcatcgtagtcgttcttggcgttattaactgccgtaaccgcagctgcaatctcatctgacgttgctgtgcctgacttaacaagcgttgccaactcagcttgcttttggtccaaaatcgtaccagctgccgtaacgtcagcatcctttgctactgacatctttgcgacaacatcctgttcagcatccgctgtattaccagcagcagtagctgcagcgttaatagcgctcttcaaaccactttcagccgttgcaaggtcagtcaacgttccaatccgtcaaagccttcttcaacgcagttaccgcagtattcacggctgcgtctgaggccgccagaccagcgactgccttcgtgtcatcgttcaacgtcactgcgttcttaacagctgactcgtaggcacgcttcttatcatccaaagccttaacagccgtgacgattgcagcaactgaagccgccggaaccgctgccaaaacgttttgcaattcaaccttggctccgtccaaatcagatgctgccgtctttgtggcatcatcattggcagacgtaaccgcagcttgatcggcagtcacttgatccaacaaagtgtttgcggtgttctttacgccgtcaaccaagcttgcttccttagccgcgatatcagcaatcgtgcccgccttcgtagcgtcttgcaaagctgtttgcaagccagtcaagttagcatccttcaaatcagcaacgccatttgcgttagtgtttgctgcagcttgaacagccttatccaaagcgttcttagcgtcagttaccgcttgtgtggcttggttaatctttgtttgatcgcctgacttcaatgctgaagtcaaatcggccacctttgaatcaagggttgccttgtcggccttcactgttgcaacactagcttccgttgtcgtagctaacttagcgacatcatcggtaacagccttttgaactgctgtcgcataatcggtcaatgccttatttaagtcatccgttgactttgacccgtcagtcaaacctgcaactgcatcagcaacggcttgcttagcagtcgtaagtgccgtgctagtcaagttatctgggtaagaagctaggttaccagcaacagtcttagctgttgtttgatctgcaactgcttgttgcacagcttgatcataagccgccacggccttttggactgcatcttgcgtcgttgcacttgccaaagcagtttgcaacgtagccgcagccttcacaacagcactgtccttcgcaacgttaacatcatggttatctccggccttcgttgcatcaaccatatagatgacattaacagcctggttcaaaccagttagtgtcgttgtttcagccaaatcaaaactcttttgaactggcaaataacctgaaacaactggcaatgagtcaaacgttaaagtgctgtccgcgtcagctaccgtaccgttcacgtcagtttgtacagtcttcacatctgttagcttcgtaccatcagacgtcacgccagtcacaacaccagttgcttgggcaatgtaattaattacaattgtcgcgtcatttccaagcgtaaccgcttgaacgccatccgttgtcttagtctcagacttacctgatttatcagtggttgtcacagtagtcttatacgttgatccatcacgtacaatctttgtaaccgtcttcgtaccattagaatccgtttgcgtcactgtatagccagcatatttataaccttgcaatgtaggtacgacaccattaaacgtcttaccgtcgtcgctaatgcccgttgtaccatcaaccgataacgtcaacgtgttacctgcattaataaccattgaggtaccatcaatcaattggttaccggccgcatcgacatatgaaatcttgttattcgttgttgccaattgcaagtcgaaattcttaatggccgttcccataacgttcatggcaccaccaccagttgatgacaaaacggcaacagacattgacgtaatgcccttagttccgacagtaaacgacttatcatactttcccattacaacgtgcaatgttccggtaccatccccgttggctgtaaaggtcgccgttaccgtatttttatagttgtatgacttgcttactaggctgtttgtttgttcaccctttgacggagtgctaaatgtaccacccgagaataggtctgccgcattagacgcctttaacgatccttggtcagccgtatttgataacgttccataggccaccattgaactagaatccgccgcaatcatgcttccgttggcgtcagtcttgcgaacacccacgacgttataattagcatcccatgatccgattccaaaaaggccaccacccaagcctgtggtcttgtacattcctacagcatcttgatattctttttcattgtttgcccagaaatcgataccccaattataggcgttgctaactccataaattcccagtccaccaccgttgccaccggcagttgcaaccttgtcaggcgcaacgggcaaaagtccgagaccgataaagtcacccataattgtttgatcgtgagtcaacgctgccaaatcaacatcaaaactaatcttccagttcttagtcatgtcgaccatgttttggaaggcatatgcaccagtttggttgttagcatttgtcaatgcaaccgtgccatcctttgcaacaaccgaaccagctactgccatgtttcctgatggtgtgaagtaactaccagcgatttgactcgtaaccgtcaagtggtgtgggtcgttagtcgcaccatttgtgcccgcgtatgagccgtagctgccagccttgttattggcatctgctaccttagcaattgtgccagccgttgatgctgagaccgttgcttgtgccaaaaaagcacgcatcgtcacaactgaaccagctgccttagcagactcagctgaagacatcattgatgacatcgcaactgaatcgtgaccattcacaacaggcgcaacagatgatgcaacgctttcaactactgatgaactttcaacaaccgtagaactctcgactgatgctgaaacgctggcaaccggcgtaactgatgcagacacacttgaagaagcctcaactgaagcggaaacgcttgctggggcaacagaactctcgacatctgatgatgaactaactgcttcgctggcaactactgaagaaatcacctcagatgatgcactaacctcagtcacagctggtacttcagatgcaactgaagaaactgatgcagacgctgacaacgtcaccgtcgttgctgattgtgacgttgcagctgtttcgtcaaccttaacgacggctggatcagttcctgacgtcgtatttgcaacttggtcagcagaggctgtgccttcagccattgcaacggcacccaaaatagatacagcagtaattcctgcaaccatccacttcttgccggccttatacatcttgtagtgctctttggcgatgtaatctgcttcgctcaaaatcttgttatttttcatactaagctttccctctcttgtatcctgaaaaatatctatatcaacgccaatttccaaactgttgattatagtgatttatttctgaaatctacttccggaacaaatcactacaatcaaccttgtgcagtctggaaatcaggtttggtgtaacacaactatccgataaaaaactatttatttctgaaaagtgccagaattagcacaaattcaaaaataactttatacattttaagacctaaatataaatctcgcttgaaaaaagtcttgcgccgattatatgttatccgccgaatcatatcgcaacgtatgatagtcaaaccgaacttgatcaggcccatatgccttcgtcaaatttgtctcctcaatcaccttgcgaatacgatggacgcttacatgtaaatcttttgccattgcagcgacactggaatatcggtgttccccatcaatcacatacggaccgctttcggaatacgtatcccaaagttgtttccctaatgaagcaacttcagcattcataatgtcaccatcatatttgctagccacagctaataattgtggtacccaattcatgatagtcctcccgattcttaactttatctgttgatattttacgcgccaggtaccgttcttttttcaaacggtcaaaaattgcgctaaaaacatattaaaagtaagctgtgcgacctgaatcacgttaaaactatgctaaaaccggtcaaatttgggacaaaaaatctcttgcaaactaaaaaatctcaactatcagactggacgtttttcgcaagtctgatagttgagatttttgctgtattttgtgtggcttaaccctcgaagcggacaccacgcaacaagtccatcacgtcacggtagtcatcacgatcagcatcggtcgccgttagtttattctcgcaaatattaagcgtttcattcgccccaactgataagggcacccccgcgatttgggcagatttcacactacggtacaattccgtcacatagctccgcaccttagtcaaatctgtctttttcataatttcgtcagttaatactggttccattttttcgagtaattgactaatcgcaatatattcagctggataggttgcaaccgccaactccaagtgaacttcttggaagaacgtcactagctctggtaacgtatccaagccaaagtgcgcaacctgcgcatgaatgctagcaataacctcgttcataaagtcattgctactttcttgaaacgccgtcaacgaaccagaaaaagtcgttagcaactgttgcagttcggctccagtcgtctcattattttggaaaccagcctctaaagcatcgtacacgtttgccaaactagggtcttgtcgcgctggttcgtaggccgttaagaagtcggcggcaatgcggcgcagcatctccggatgattttcattaagttcaactttcaaatgacgaatcaagttacgcaagttagttaaatcggcacccagtttattaactgaatcaggccgagcatcattcagattaataatcgcttctgtgacttccttcttcgctgtaataaaggttgggtgtgactcaacgtgccacgttgccgctaaatcttctagccccttgatcacgcccatggcgaaagcctttagttcagccggttgaatgactgaacaattccatccattattttcaacatccgctagcttagcctcagctgtcatttgcagtaagctttgcccgtcaggcacttgatcaaacgtgcgttgcaaagcgcggtgggccgcgtctgccaaagcatcatacatcgactttgtacgatttaagttattcatcttgttcctcccacagtgttaatgtcatcatgatattacggcaattgtaccgccagcggaacacgcaaaacaagcaaaacgttttggtcacaaatagctaaaaaaaccacgcatatctgcgtggtttttttagtggttgttaagatagagatagtgtacccaaacgcttggttcgagcacaaaaactatcttacacaaatcattgcaacgaaaatcattttgtctcaaaattgagtgaatatcgcgcacttttagtatgtaattatcgcaattcaacgccagcttcgcgtgctaattgacgtaagtccgctgtgtccatatttaaatctgctcgtaaccgggcaaacgtaatattaggcttagccgcaacgcgttcttgaatccgagcaatttgagtttgacggaagccgttcgtatgcgtccccgcattctcaatcttcacgccaaattccgccgccgttgacgtaccaaacgtatagttcaactgaccaaccccagttgacattgctgaataagctgccatcatgtttctccaccatttttaagatagccttatcatacaagtcatatatgcatagtttatgactgctttggcgttaaatctggttttatttatggctaatccgcataatttcctcataaaatgagctatttaattctggtacgtctgatgtcatcttattaaccatttgtgtcacaatatcaccaacatcccgtcgactctcaactacatcacgaaaagtcgacagtacaatataccgtaactttgtatttgattcttcaacctgcgcgtacaggtctatcaagatcgttaaaaccgtttgctttttttctgccattttcttatcccctatgccatcagtataaaggaccgttactttcatatccgctttggcctaaaattgggtcaattttttgcattatctgcgttcttaacaggttccaggtcaaaaattcacttaatcgttctatacatgggacaaattgggcactcataacacatattttctccacaataccggtataattaatgcagtggttttaaaagaagagagtgttgtaactatgttattaagagaaaaaattaatgaaatcagacaggcaaaacgtgtctcgattgatcgcattacaaaaactggtatttcaaaaaacaaatattatcgctttgtatcaggtgaaggttccctcagcatcggtgacctacaaaaattaatcgaattactgaccgtctcgctatcagaagttgtggcagattctagtgaacgcgaccaattaatttttaatgagtttggcgactattttaccttagacgtcgccgagtatgaacagcgcgcaaaaaatgccgctcgtcgctatatggcgacaaagctgacggcctattacactatttcaacagtgtatgaattaggggcgcgcataaaaaagctgaacccacctcagattatgtcgatgatctgtacaatggcttgaaacgtcaaaaattctttaccatttttgacttacaggttttcagaattctagtaccttatctgtcagtagcccgttttttcaagttgtacccaatcttcacaacatcactgctgacgtacgaagcatacaatccagccgacggtatcgaattaatgattaaaattcatgcaaccgcaatgacttacgcagtcagcacggcagctcgggcacgtaagtatctggacttcgtattgacccaggtatctaatatgcgtggtcgtccctttgcaggtgaattctcaattatgaaacgacttgcaaatatttcacgactctacgtcatgggcaatgttgatgccgcccaacgcgccttcgattctttctttggggccgctaaacgtttggatatggaccgactttacgcgtcaccaaatatgcacacattcaacgtgtattggaagaaattaacttctcacgcacctgaaaagttgcaaccaactagcgccgacaccgtccttgttggactagacgaatcggccggtatctcgttcgcagacgttccgatgggcgcggctttcgaatatattatgaagcttaaaaagttgtcggttcatgaatttgagacggccggtatgagtcactctaaaatttaccgagttcggaagaacttagccgaatttgacgtgaacgacttattcgcagccatgatggccgcccgcttagatgttcgtgatgtcgatgtgtatctaacaactaattcaaccgcctacggacgcagtcgctttggcatgcgtcatttatcagttgatgagatgcaactcgccattactgattacgagaatttgtatgctgagactggtttcgatgtttacaaagaaattgcctttgagttccgtggcaccgtcttgaaacataccgtgccacattggcttcaatctgaagaactgaagcaactctcaatggaggtatccgaccatttaggtcatttcgatacgtggcatgaagcacaacaacgtttagctgcttggccaatgctgaaccaaccggattcgaatttgattaaacgttggatggatcagactgttgattttggtcattatatggaaacattccgttatccatatgatccaattttaatcaactatgattcaccactcatccaggccgtgctaaacaaagatgctgaccgtgccgaagcaatttatgcacgtcagtttgctgaataccagcatcgaccagacatgcacatctactttaattatcgctggcatatgctcttaaatgccgaatttatcaaagttctgcgtgagggatatgtcattccattgaccatcgataatttgctaaaagatgttgaagtaataactggggagcgcgatttcattcaaccttatcaagaattgttaacgatgttgaaggaagtttatcccgtctattaatacacaaagaaaccccgtcgccattccataatcggaaaatagcgacggggttttaatttacatttaattaggcagttggttgaataagttgtgctgcattcaaccgagcgactgcatcaacagcattgacaactgacgcttgtgcacgtgtcgtttctgcttcatcatccaacaactcacgtaagtccatcttagcttcgtcaaccgctaaaatctgatcgatgtacgccatctcgtactgctcctgattttgcatcgtgaatccatccggtaccacgatactcatcactggattgtactccattgttgcttcaccatccatctcgttcatcggtgtcgacgcttgttgcaattgctggaacttctgactaacattcaaagccacgatatctgacagggcgttttcaacatgcttaacagcctgttcgacctgaccaattgtcgcaccatcatccattgcctcttgcagagccatcttagcatcctcgagtagtaagacgtggtcaatatatgcttcttcgtaatcgtccgcatcaatattagcaaacccagctggcgcagtaatcatattagcaggctcatgatccaacgtttgtgaccaaacatcatctgcttgatacgtcacacgcccatcggcaatctgcgttgcttgctgtgcaaccataaagcgttgcgcttcatttaaggctactaccgcagctaatgcccgactaactgcttggccatgttcagccagagaacgcgttgtcgcattgtcatcgatagcctcttgtaacagcatcttcgcctcatcgacagcaatcactgcgtcagcataacgctcagcatacgctgcttcattgacattaaccgtcccagctggcgcaactaattgatcagctggctcttcatccaaaaagctagcgtaagttgtcccccaatcagcccagttagctggtacatcagcatcgcgtgctaacaggtcggttgccggtgcataattcattgccactgacttcaaatcggccactggcaattgctctggcgcttgcatgtcaccaaggcggaacccagcaaatgataatggcacaatcgtcaaagccaccataccgatagcttgtgcaatggcaaccaccagtgtgggcatttcaccaacaatcgtatccgtttgactagctttcgtccacttcataccatcagctagcagactttgcatgctgaccggtgtcgtggtcgttacttgccgtgcaacacgctgtacacagttaactgacttattaggcgttgcccattcgataacaacggcctcatcgtccaattgtgcgacacgtacattgctaccctggggcagactgtgtgccaataatttgttaactgcgtgcaaaacatcatgttgcttactattatttgtatgtgccaactgtgctactaatttttgtagcaccgcactccgcacaaccatccgttggacagtcgttgtcgcagcatgtgtcgccttagaattagtcaacgcaacatgcggtacggctcgatcaacgaccgtcttttcggtaagctgcgtccgtgccaccttcgtctggttatggtgagtctggtgtgactccgccttgctagactgctcagattttggtgtcgttgcgtcaatccgtgcactagaacttggtgtgactggcgtagctggtgcaactgaggcaacacttacacttgatgtcgcaagcgatgatgcggctgacgatgattctgatactgccgacgaaacgcttgaagaagctgtcgaacttggtgccgaagcaggcaaggtacttggcgtggtcacatcactacccttgtcaacgaccgttggattaatcaacgtaaacgctggcgtcgttccttgatcaactaatgtcacacccatttgtgaactagactcaccggtgatggccttaattgccaacgccatcgtggccacattttttgcacccacaaccattgattgcttatacgaaccgtcaactgcctgaaccgttaacacccctgtaccatcaccatttgcaacatagcttatcgtaacaggcacaactatgtttggtgttactgccgtccctaaatcattagaacccgcagtttgtacatctgtcgcaaaactatcagccgtcatccctgttttagtcgtcactgagtgatttataaaatcaagccctgagcccacgtgataaccaacatattgtgtccaaatcgcattcctataactggtgtaccccagcgtgtgaccaccaagttgggccaccaaatcagtaatcgcttgggtattcgtcatagccgtgccatcagggttaatatttgctggtaacagctcaccagcagcataagcgatatcgttcttcacaacatcattggcggcataaactgtcccatcaggggcggtaaagccggacttcaattgcgtaccagccttaataacggtgccgttttcaggtgccgtcaatcggaaaccagcctgggcaatcgtattagcaagattagtgatgccatcgccattatttgcattcaggtcaagaccccaagcaaacgctcccttaacatcatcaattcccaaaccaccaccattattaccagtcgttgcagctgctttaggatcaactggcaacagtgtaaggcctaagaaatcaccaaagacgtggttcatatcttgtagattggccaagtccaattcaagatttaacgtccaatttgccttcatatcaacttgcttgttaaacgttaatgcaccttgttgtcccttattggtcgttaatgtatagactgatcgtgacttattcgttgccgcaatactagcataatacgaagcggttgccactaaactagcataagttgcacttgcacttcgattatagccggctactgtcttagctgagtcggccgctaaagacgccatcatcgccaatgaactagccatagctggcgtcagagttgtcataaccgtttgtgactttgtcgcccccgatgtcaccgccgtaaagtgcgagcccaccgtttcttggctaacttgcgtatccgacgcaacgttgcttgtagcagtcttggcggcaggtgcaactgaactagcgacgtcacttgacgtagccgccggcaatactgccgcataagacactgggacgtgagctgctgacaaactttgcgccgtcgcagttacttgggccatggcgctttgatcatcaccatctacaacacctaaatcaactgtgctgtcaactgattgactagtttcggctgattgttgcgatgaactttgcacactgaccgatgaacttacgacggcagaacttgatgtcacaactgacgacaccattgattgacttgattgatcactgacactactaatcgattcatcgcttgcgattgctgatgaattttcatttgcagatgtcgatgctgtgctagcgactgaggtagccgctaccgttaaattcgatgcactatcaacgttgggcgctatttgattggttgtggccgtagctgacgtactggtttgctcagctggtgtcacatcagctgaaacgttcactggcatcaagccgcccagtccaactgcagcggcaaagattcccgcaacgacccaacgcttaccgtctttatacatcttaaaatgtttttgtgttggttctaatgctttgaaagacttgaaattcatttcccaaacttcctctctgttttcttaaagcggttcacgtttggcctgaggatatcagaaaaggccacccatcttactagtagacgcgtgaccttttctcatttccacagtacaaaacacctacgcaaaaagcgtaaactctgtgtatcataccaactaccattccatgtttattattataacaggttactgtggttatgtataaaaaataagcaaaaaacagcggtagaatgtgtcgcttttgaaacattctaccgctgtttttaatgtttgtgataggtggctttacactaactggttaaaccactttattgtaataggtttttaaagattgttagctttgacaagagcatctgagcagcaaccgctaatgcactcataccaacagataacgctgaaaatgtccgcgctttgtcgttccacattgaaggctttggcgcgtcagccgttgaacttaataatgacccctttttaacaaccgttgtgtcatttggttgatcacgcttagcgcttggctttgctgatgcaagacccggcgcacttactggcgtcgtttgtgctggttgttgcaacgctgcagctgcgtcaataaccgcacttgcagacgttggcgcttgccaatcaatttgcttagttggcgcaattgttgttgccatcttaggcaagttaacaattgcggctggctgggttgccaatgctggcaggataacctgggttaccccgtttgattgtggcacaactggtgtggcctcagactgaacacccgtatcactggcagcaactgcagccatgcttgccggtgctgatgccgctgaactgattgcactagatggtgtaaccgtcgctgactcactggcctctgaagcagatgatgcgactgattgggatggcgctaccgtgatacttgattgtgaaggtacgttggataccaccggtgtctcgctagctacctctgacgtcgtatcactaggcatcgttactgctgaagatgatgccggtgcttgtgaagtgaccaccgatgacggcgcctcacttggcgttgtcacgactgcagatacgctgtgtgatacctgaacagatgacgcactcggtgcaacagacgaagcgcttgacgctactgacccaggatcagttgctgcagatgaatttgcatctgacgttgcgctagatgacgctgggttgtttgatgcaaaggcagcccccgtcaatgtgaagtgagcaactgagccttgaatggcagataacgtcacgtagagttgaccgccttgtaccattgcgatttgaccctgatcagaagatgatactccagttgcagtaacgccggctggcaatgcaatcaactgcatgccttccaagttaccgtcctggccggcatattcaatgcttgatccgccgttagtaccatctgcctggaaccaggtaactgggtttcctgcatcatcaaccaaattaatcacaatttgcttttgattagtacttgttgccgattcaagtcctgatgtatatggtgaagcttcaaccaatttctcttgttgaacgagcaatgttcccgtggctgccaaaccaacgagtgccgtcaacacaattttttctctctttaatgtcatgtctgacgccctctttcgtcccacaaacattcctaatgaatggtataactcagtgcaactgctttaaatatccaagcaattgccaagaacaccaacggaatattcgctaacaaacctttcgcaattccccgaagaaaaattgtataaaccagtcgcgcaattgatgccaaaattgctgtggtcagtaccgccaatgataacgtaatccacaaacgtgaattcggttgtataaacatatcgaacacactagtgacgaaatacaaaccgatcatcaccataatattttggccgcgctggttaattctctttcttaatgttttccggtacgtcttctgatcggagacgcccgactttgtttttgataccatattatccatttcgcgttcccttagtttccgaatgtatcttcattctaaccgaaagcaacttgtgtgcatatggtcttgccttctctttacgtcccagtatagcaacactttccactatccaggataaaaaagttagtgtttaacacaaaaacgggtaaactcatttgaatttaccagtcattgctaacatcacactagctattaagaaatgaattgactgatcgagtgttgcaaaaagatcgcgtcttttcaattaggtatggtgtggtatgagagaaaagtcaaccgctccaccagccaattcatttcttaacatgtataagtgtacccccgcctaaccttcatatttggtttcttccccaaattaagctctataactatggttttccaagtaacctaaaaaaagagctgaattctatgcgaattcagctcaaatctgggacgtttttgccatttgtccgttattttttcaaattaactttgcagtccagctaaaactttccgacgccaagcaaccaatctgatgataattgctaacgaagcgactgccaaggccgcaaccatgccccaaaagagcataggcaaatgggcaactctggctgaaaacatcgacatgcgcgttgtaacgaactgactatttgccatcgatgtattcttatctaaatcacttaaagctgccgtcgacacttgccacggtaacttagtcgcgtctaagtgtgtaatcgcttgattcggccccgtgttcactgggtacatcaaatcattcttgttgttcaaagtgtggcgtagccccatcgcgtggcccatctcgtgggcgataacgctggctgtgtagtcagctgccgtctggtatgaggtcaacttaaaattagtgatgattccttttgtaaaaatgacaatctttttggtgccagctacatccgatgtttcgcctaaaacatcagctgctacttggtttcctttcgcatggcccgcaatttcttttgtatcgttaaattcaatcgtgattgtcgtggcgtccgattgcgcatcagctgcctgaaagaggcttggttcgtgcaaggctgtcgtccacatcgtttcagcggccacaacagctttgcgctggtttgccgtaccagctaacacattcacgcgataccgcgcctgattaacggtgtcagcatgggctgtatgaccagcaaccagtaagacaccaagcaaacttatcacgattcggaataaaacatgttgcgttacacgcatcgtattcaacctcatctcaactcaatttctttcccgtattggattatacagtgccaagcacttttttcaagcatttcgtttcacaattagtaagccggatagacctcacgaattgcgtccaaaatcgctaaataaggcacaataaatcgacgttcgccagtcacggtctcaacatcgcgcaaaacacctttgattgtcatcggcaccacgaaaccatcttgaacaacttttagtagctgttcgttcaacaatttatgccaacgataattgaagtagatttgcaaatcagggcgtgcctggtattctgcaaacaagcgttgatagacttcttgcgcctttgcaacatcctgtcgtaagatcgcctgcattaaaaccggatcaaaattaattaaaatcggatcgtacggatacttaaacacctgtgcattgcgagtgaacgataacaaaatttccatccgttgaccaacgccaacatcagtcgtttcatccaaaaatgcccacgaagcaagccggtgttgcgactcatgccattcatcaaaatgttccaaatgggttttaacgtcgtcagacaattgttgtaattctggtgatgtcagccaattcttgactgtatttttaatgactacaccccggaattcaagactcatttccgtatacaaatctaagccggtttcttcagctaaggcttcgtacttggtgatcgcctcttgtaactccgtcagacttaggtgtcgcataccaaaccgtgggcgccccattgcagccgaactagccgttaaatacacgtcaatatcacggacatccaaacgggcggccaacattcccgcaaacaaatcttccacatcaaattcagctaggtttttacgaacccgataaattttagagtggctcatccccgccagctcaaattcatggactgataatttcttaagcttcatgataaaggcaaatgcttcacccataccaaaaacgccaaaatcaaccgtttcaatttcagctgattttagggctgtatcagattcctgaagtttgcttgggtcaatcgaaatcaatcgcttccaaaatgtttcgaaatccaacaagttgggggacacccataagcgctgaacatctaatcgcttggctgccccattaaaactatcaaacgcgcgtttagccgcatccacattaccactttggtacaggcgcacaatcgacacgaagcgtttcataatcgaaaattcagatgtaaatgggcgcccttgtaaagcttcaatttgttcaatgacaaaactcaagtacttttgggctcgtgctgtcgaactgatggcatatgacaaagcagttgcgtgcacttttaccatcaactcaataccgtcagccggattataattttcataagttcgcaatgaaacggcaaacacctcatacaacttaaagaaacgtgccacgtttaactgtggcattaaaatgcgaaaaacttgcaaatcaaaaattgtaaaaaaacgttgccgtttcagttctttatataattcatcaacataatctgaaatatcttcgccagctttacgccccgctaataattcatacactgtcgacgcaatataatgcgccttcatttgcgtttgcatataacggtgcgcgaacacgctagcacgttcgcgcaattcaggcagtgacaattgccaatagtcaccaaattcattgaagatcaaactatcacgctcatcagattcggctaccaattccgataacgaaaccgtcaagatctcaattattttttgtaaatctccgatactaacggacccctcgcctgatacgaaccggtagtatttattttttgagataccgtttcgcacaaacctttcaatgggaatgtgtttggtctgccggatctcatttatgcgttcgcgtaataacatatagtagaccacactttctctttctctatcttatccacttcttaatagtataggacattgtttccgttttgtcagagcttttgttatcgtaaagtccgatgccggttacatacaattcacatagctcagcaaataatagcatgaaaaaaagacagaaagccgattggttttctgtctttttgagaagttattatgcatttaccttagcaatcaaagccttcgtgaatgcttgtagttcttcagttgcttcaacgtcggggctcaagttaaccttcacaccgtctgcacccttggtagcacctgacttttcgaattgggcctcgaacttgtcgatagcaaccgcaaagtccttaccgtagaagtcatcccctgaacctgagacaccataaacgatacctgataggtcagtatcttccaaatcttcaaagaagtccaaagactcgtcaggaaccgttcccttatcgaacgtgtatggtacaaccacaacgatatcagtttcatcagctgagatgtcgtgagggtcaaccatttggatatcttccttagtgacttcaacaccttctgcctcaaatgtatcaataattacatctgcgacgtcttcgttgttcccagtgatagttgcgtaaaatacacgtgccttcatgataaattacctctgttaaagtttttaatttcttaattgatgtgtttagtttatagctaaattaggccactttcaaattaaaaggggtgattatcatactcaatccaaggttcgtgtgaatcttggatacgcttaaacatcttttgcatgtccaacgttgagaatgtcaccaagacaggccgaccgtgtgggcaattataagggttctctgagtgtgataattgatcaagcaaccccttagcttcaaaatcattcattgaccagttagctttgattgagcgcttgcatgccatcataattgccgttcgctcacggaattgcgcaaccgttaagctaccatctcgtagaatccagtcaaccatttcacgaatcgtatcttcttcttgtcccttttcaaaccagccaggatgctcgcgaacgatgaccgcatcatccccgaatggttccaaatgtaggccaacttgggctaactcaacttcatgtgactgaatcttcaaaatatcaatttttggataattcagcacgatcggcacgagtaacttttgcatttccaagccgaccttaccgatttcttcacggtaatactcatacttaacacgttcctgagccgcgtgctgatcaatgaggtacagcccttcttcagattgcgcaaacaagaacgtcccgtgcatttggccaatatagtctaactttgggaatgtttgtccatgctcatcaactgcttgaatactgtcatctgtcaaatcaagtgacttttgctcagccaccattgctgtcccaccttcgtcgaaggggttaatgtccgcaccatcttgatacttagtcgcaaattcactcacggcagtaccttgcagctcctctgcatgatgaacgaccacaggggtcacatcagacacagagaagttgtcagccaacttttcatagtcagctggcgtcattggcactggatgatccggtgtcgactccggcgcgtacgaactaacgtatggctgtgacgcatcgttcagttgggcaataaaggcggcatcattttcagctgcattttgttcttcacccaaataattctcataggcattcggaatcaaattctcgttagcaaaccgatccttcacagcttgttcaatcaacgccatcaactggctttctttcgacaagcggacctcatgcttttgcgggtgtacgttcacatcaaccaacaatggatccattgttatttgtaacaccgcaattgggaagcgaccaaccattagcttagaaccatagcctttaatcagggctttggtgagattgtaatttttaatatagcgcccattaatcagcaccgaaatgtatgaacgactcgcacgcgttaattctggcaatgagatgtaacccgacacctcaaagtcgttgtcttcggcttggatagcctgcatcttacgcgcttgttggacaccgtaaatggcagcaataacttgttgcaagttaccattacccgctgttcgcatcacctcattaccattgtgcgacaaccggaagccaatctctggataactcagtgccaatcgattgataacgtccacaatctgggccaactcggtcgactgtgacttcaaatacttcaagcgggctggcgtgttgaagaaaatatctgacaccgtaatgtccgttcccttacgtgcaccggtcccgatttcctcgagtaattcgccacccttgtagtgaacccgcttaccttgttccgctccggctgtggctgtttccaacacaacatccgcaactgacgcaattgatggtagcgcttcaccacggaacccaagtgaatgcacgcggaacaaatcattacgcgatgtaatctttgatgttgcgtgacgcagaaaggccttcgtcacctggtcagcatcgatgccatcgccatcatcgataatgcgaattgattttacccctgcttcttccaccaaaatatcaatttgctgggaattagcatcaatcgcattttcaaccaactctttaaccactgacgcaggccgctcaatcacctcaccggccgcaatctggttcgctaaaatatcagaaagctcatgaatctcagccatctcttaaccctcttttacttcatttgcttttgccactcatttaacttcatcatggcatctaatggcgtcattgttgcaatatttgttgctttaatttcatccaaaacagcttgcatagcaggatcaatttctggtccaactgcaaacaagtctaactgcgtatccgctggttcggccgccacaacctcgggttctggctcagccactgacgcttgataggtggcaactggttcagccaacttagcaggtcgtgttggtgccgttgcttccaatgacacatcctgtgcttccaagttagccaagatatcagccgcccggtcaatcaaactatctggcaagccagccaatttcgcgacgttgattccgtaactttgatctgctggtcctgttaagaccttgtgtgaaaagactagttcaccattctcttccgtcgcgccaacgtgaacatttcgcaaattaggcaactcatcagacaacgctgttaactcgtgatagtgagttgagaataacgttttcgccttcgtgttattgtgcacgtgttcaataatcgcttgcgccaaagccattccatcataggttgccgttccgcgtccaagttcatcaaacaaaatcaatgatcgctttgtggcattctgaatggctgtatttgcttcagacatttccaccatgaacgttgaattaccggaaatcaagtcgtccgccgccccaatgcgagtaaagatttgatcaaaaataggtaattcagcttcgctagctggcacgtacgaaccaatttgtgccatcaccaccgtcaacgctaattgacgcatgtaggttgacttaccagacatattcggtcccgtaatcaacatgatggtctcatcctcatccataaagacgtcgttggcgacatacgattggtggcccaatactttttccacaaccgggtggcgaccgtccttaatcaccaaccgttgcttatccgtcaactcaggtcgcgtaaacttgtagtcttctgccacggttgctaatgattgtagcacatccaattcggccaacgtggcagcgagcttttgaatacgcgtaatgttatttttaatttgctcacgcacttccgtaaataactgatactccaaatcgctcgacttcgtttcagcttccagaatcatttgttcgcgatcttttagttcgggcgtgataaagcgttccgcattgaccaaggtttgcttccgtgtataacggtctgggtcaagtttatcaatgttcgctttagtaacttcgatgtagtaaccaaacaccttgttaaagccaattttcaacgaactaataccggtttcgctacgttccttcgcctctaattcagctaaccattgcttaccattcttcatgacactgcgatattcatccaagcgtgtattatacccggcccgaattacaccaccatcggtaaccgaaattggtggttcttcagcaatggccgtggaaattaacttttcaatgtctgaaacagggtcaattcgacgtagcaaatcaccaaagacggccggatccaaatcacccagtgtcaccatgatgtctggcacttgtcgcaaagaattgcgcaactgcaataggtcacgcccattcgctgtaccatatgccacgcgaccagctaaacgttccaaatcataaactgacttcaatgtttcctgtaacgccgcccgcgagaagaaatccttgagcaactcaccaatcttgtcatagcgttgttcaatcgtttcccgatccagtaatggttgttccaaccactgctttaaggcacgaccacccattgcggttttcgtattatcgagcaaccacaagagggtgcctgaccgttgttgggtgcgcaaattaactgtcaattccaaattagcgcgtgagttacgatctaacttcaagtattgggcaatttcgtatgatgacgccatttgcaagtgatcgagtgaccgcttttgtgtcgcaaataggtaggccaataacacatcagcagcctctttttgttctggcatcgtcagttgttgcgtcaaatatgacgtttccgcattcgccgcttcttcatcctgatgtgacaccaaaattcccaaactggttaaattagccatcaaatcatctggcaacgttgcgtttgtaacaatctccttcgtttcaaggcgactgatttcattaagaacgcccccagttgcagtcaccgtggtcgctttaacttcacccgttgatagatcggtgtacgccaaaccgaacccacctgctggcgtcattgatagactaactagatagttattttctttcgccgcatcagcacttgtacgcattcgggtaccaggggtcaccagttggacaacctcgcgcttaaccatcccctctgcttcagccggattttccatctgttcaacaaccgcaactttgtatcccttatcgaccaaaatatcgatataattctgggcggcgtgatgtggtacgccggccataggaatcggttcagcggaatttttattccgttgggtcaacgttaattctaataattgtgagcccaaaacggcatcgtcattaaacagttcataaaaatctcccagacgataaaacaaaaatgcatctggatattgcgccttgatttcgttgtactgcttcatcattggcgtttctttcggcttagccattatgcaagtattccttccgtttaaaatgtggaaaaacgctcaccggttcaccgccggtaagcgcctctgtttaactaatcttcatccttgaacaagtcagccaaaccagccagtggcgtgtttgcttgcactggctcttcttcctttttcttgtcaaagtcatcttcagaaatcactgcccaaccattaccttcaggcattggttgattctgttcttcttcagtcaacacttgcaatggtactgacaatgccacgtactcagccaacgcttggttgaaatcaatcacaccatcttcaactaagatgactgaatcttcaatttcataacgatcagcgtgcgcttcatcttgcaagtaaacttcgtcaatgtcaaaatcaattggcatttccacaggttccaatgaacgcgttgacggcgtcactagttgtcctttcacattcgcgtgaacaatgatgtcttcacgatctgcttgtgcaaatcccgtcactgtcaacggtgtaacatctaaaatgacatccccaaatgttgttgtaatttcatccttcaaatccacaacttcattgaattggagtgcttctgtcttgtacttttggagttccacaaattgccacttcatgacttatcctctttctataaaaactgggatgcgaccggtatcctgcgcctttgcaagatcggctggtcgttgtgagaaaagttgatacaaccgtccagctcgataatcaagcgctaaaatgccagttaaatcatccttttcaactttatgtatcactggcaacgaaaactcatcacgctgttgcttgagataacgacgaccaagtgtcgtggccccaagcatgcgcaaataaggcgttgccatcgcggtttgcatttccgcgcttgtaatatttaaaacagtgtacagtaacgtgcgttgtaggcgcgcttgtgtataacgtttcgacttatatgctgccataaatgacgtgaaatcagtcgctaggtgttgcgccacctgctcttgcaatcgatacgctaaaccatccgttaactgataaatttgttcaagttcagcaattggcgttgtcatcactttcgtttgcaacgcatggtaccaagtcgttgaccaaggtgcggtttgagcgccttgggctaacagctcagcagcttgctgtccaacgtacggtaagaaagacgtcgttggtgcttgtttgtccattaattctcggatggcagttgcgctggcaatatgatcatcaaccaactgcgtctcatgataaccagctttaatccgctggattggttgcaacgtgattgcgcctaccaagtccaagtcaatgacagcggtcgcatacgcaaaccccaacatatcattaggatcagttaatcgaaagccaaccacgtctgccaggacatcattaaacgccgtggcataagtttgactgtagtcagttgaaaattgtttgtcagccattagccgttggtgagcctgttgcgccagcgctagaaagtccaagtcaccgtgttcagcaccaaaaacaatcgttttcacacccgcatcggcgagcaattgcaccgcaccacgcgcaaaaatatgcgctggctgtaccgcaaatgcgaacggcaattcaaaaactaaatcaaccccacctcgtaacgccagttccgctcgttgccacttgtcaaaggtagctggcaccccacgttgcacataattaccgctcatgacagcgaccacgacgtccgcaccggtcagtgctttcgcttgcgctacatggtaagcatgcccattgtggaacggattatattcggttattagcccaacagcctccattaccagctcactcctttttaagctttcgttgcgttaaagaaccaacgtggcgattccgccgttactgtttcgcgaccaaagtctgctaatacctcaatgttggtaaaaccagcttcagttaacaagcgcttatatgtttctaactcgtacgtgcgctctgtgtgcacttcttgaatttgttggaagccatcaatttcttcattgtaaacaaagaatgttaactcatgttctaccgtgtgggcttgctcttcaacaccatatgatgaccacataaaggcggtttcatcatcatgccaattgtacatataccccggatagtacacgtctgtctgccaaggtgaaatcacgtcaaacaaaaattgaccatcagcttccaagtgggctgcaacttgcttaaaggcttgcaacgtttcttcttcagacgccaaataattgaatgaatccgcaaacgacgtaatggtagcaaacttttgctcgtaatctgaccattcacgcatatcgccttcaattagtggcaacatcatgtctgcttcttgcgcatgttgtgctgccaaagccaacatttcagttgataaatcaaagaccgtaacgtcttcgtatccagccttctttaattgaatggccaatcgaccagcaccacccgctaactccaataacttaccatctttgttcttaatgaacttcgtggcgtattggaaccaatcagcataagcatcctcatcgaacaggtcatcatacagcttcgcaaaagtttgataattcattagaactcttccttaacaatccattggtcaatatcaatttcaggtgcagcgccccacaacttttccaaattgtagaattggcgcatttcatccttgaagacgtggacaaacaagtcaccaaagtccatcaaaacccactcaccttcacgacgaccttcgtggcgttgcaactcgaatcctgcttcagccatcttgtcttcgatttcatcaacaatcgccaaaacttggcgttgcgttggggcatccaaaataaggtaggcatctgccaccaagctaatttcgtgaatgtccaaagccatcaagttttcagcgcgcttttgatcagcggccttaacagctacttccaacatttcatttactttgttttccattacttctctacactccatgcgttgtaagtcaaaagcgttcccggataaaccggtacgcgcttttcaatgaggtacgctagtgtgtggcctgtctgccatcccacactagccgcaaggtcatcaaacgccaaagctcgaacttcttcgacccctggaaaatcacgccctgcttcaatataatctgccatataaatgatttggctcagcgtcgtcatataaggtgcacctgttgtgtgctgacgaattgccgttaggatatcttcgttttgaatgcccagctcatccttgaccatttctgcgccaacgataccgtgccaaacgttattcccccaattaaccaaatccggatccaattgcttttccgcaatcttcgccaagaagtcagcatctgagcgttccttggcgtaatcgtgcgtcaaagctgccacagaagccaactctgcatcaacgccccacttgtctgctagccgaactgccatttcctccacacgcaggacgtgttggaaacgataatcagacatagcagcttgtgcggctgcgactaaacttgctcgtgacccgttatagtaccggccccgataaatcatctcgtttgtcatccatgtataacccgttttctacaatgtaggctgctaccatatctggtagcaagtagcgaaccgactgcttggtcgcaattcgctttcgaatatccgttgaactgatttcaaggtttggcacctcaacccatttcacgggataatccgattctcgtggttgtcctggtcgattaaccccgacaaaattcactaacttcaacaagtcatcaatgcgataccatgttttcagataggcgacttcatcaccgccgataatgaaatagtattcataattagggtgctcaactttcaattgcaacatggtgttgtacgtataactcttaccacctcgctgcacttccagcagttccaagccaaaatgactgttccctgcaatggccgcttgcaccattttggcacgatgcaagggatcgattgcccctttgggatcaacatgtggtggcttagcatttggcataaagtaaaccttatctaagccaagctgttcagcgacttgttcgccaatcaccagatgtcccaagtgtggtggattgaacgtgccacctaaaataccaattttctttgtctcaccgacaaaactacgctcagcttgtgcctgcgtcattgtcttctcgattgtattaatcatgcccgaacccccgttccgagagtgatgttaaattttttgaacggcgacagagtagcgacggttttctttgtcagctgactctccgaacaatactagtgtgtgcccaatcgtttgaacaacttgaatatccgtgttctcttcgataaatgccttcaaatcatcaacttcaacatctgaatttgccaagatattaaccttgaacaactcgcgcttgttgatcgcatctgaaagttggtccaaccagttttgtgtcaatccttgcttaccaatactaaagagtggtcgcatgtcgtgcgctgaggcacgtaggtaacgcttttgcttaccgcgtagtgaaatcatattaaatcattgcccttcgtgttaatactgaaacaccctcaggtgcccagcctgctactaccgtgttggcgggaactgtaatccagcccaatccatcaatcacgatatccgtcttctcagtcaccttaaactcgtgacgttgcaatggtggcaacatgtctaagttttccgttgttggtggcatcaaaagttcaccagcatgcttgctgtagaactcatccgccttttccagcttcgtccggtgaatcatcaaattattttcaaagtaagccgtaatgccggccttctcaccttgaatgaaatcaaaacgagccaaggcccccatgaacaacgtttgttctgggttcaattgatacgtctttggcttcaattccttttgtggtgagacatacttcaaatcctttggcgtcaaatagtgtgccatttgatcttggtgaatgattcctggtgtatcaataatgaacgtgtcatcatcaagtggaatttcaatacgatccaacgtcgttcctgggaaacgtgacgttgtgatgacatcctttgaatcaccagttgcatccttaatgatttggttgatcaacgttgacttaccaacgttcgtcacaccaacgacgtaaactgaacggccttcacgatacttttcaatcatatccaacaattcagggacatcatcaccgctcttacctgaagtcaacatcacgtcaattggtcgtaatccagctacgttagcttgttgacgcatccagtccttaatctttgaacgcttcaaagactttggcaaaacatcaaccttgtttccaaccaacaaaaccgggttcttaccaacaaagcggtgcaagcctggaatcaatgaccctgagaaatcaaagacgtccatcacgtaaacgaccaaagagtcagtcgttgaaatttcgttcaacaacaaacggaaatcatcatccgtcaaatcaacgggttgaatttcgttatagtgacgcaaacggaagcaacgttggcacaatacttcttcattttcaaagcccttaagcaaggctgacattggggcataacccaattcacccttacgctcagtttgaatcaaagcgccacaaccaatgcagcgcaaaccatcgtccaagtaaccttgtacttctgtttcactaatcaagagtagtcctccattgtagttctgggtgggcattcaacatgcgcttcttaacacccttttcgaaaaaacgattaatctttgtattccactggtcagtctcaattagcggcttaaccaaaatactccgaacgccataattattagatgaccagacgtcagttaataattgatcgccgaccatgacaacttcttgcttcgccaagccaagcgttgttgtggcctcgtttaggccacgggtcagtggcttcaaagcacgtgagacaaatggcaacttcaaaggttcagcaacgcgtgcgatacggggtgctgaattatttgaaacgatcattacaggaattcctgcctcgttcatttgttcaagccagtcgtgcaattccgttgtgccgtctgggttattccaagcaatcaacgtgttgtccaagtcagtcagcactgccttgattccttgagcctttaattgttcaggcgtcaaacggtagattgcatcaatcatccaagttggtgtaaatgattcagtcattttaagtccttttctacaaattgtcttactataaattatacgctaaataacggcgtttataaagtagagatagctagttaagcatcgcgtgttgccacccgccaccaaataaaaaacaaccagcaacaacactgttactgattgtttttaaatccatattacttagcgcgctcggcgttgtacttcttttcaccaacgtgctcttcacccaatgacacgaagtcgtatgacaacttggcattgcgttcgaattcagctaaaccatagttgataatttcatcaatcaagttcgtgtagctgatacctgaaacttcccacatttgtgggtatagtgagatattcgtgaagccaggcaacgtgtttggctcacccaagtatggtgtaccatcagcatcaatcatgaagtccatacgagtcaacccaacaagtcccaatgccttgtaagcatttaaggccatgtcagtgatttccttttcaaggtcatcccccaactcaactggcaattcaaagaccatgcctgaggcgtcaacgaacttgttgttgtaatcgtaccaaacgtcttgttcaggcaaaacaataccacccaaacgagatgcacgtggttgctcattacccaagattgaaatgaagacttcgcgtggcttagtcaacgcagcttcaaccaaaaccttgtagtcgtattgcaaagcatccttaacaccagcttcgaattctgcggcgttcgtgacgcgtgaaataccaactgatgatccttgcttagcggccttaacgaatagcacttccgtaccaagttccttaacaaggccctcgtacgtgtagtcttggaagttttgatccgtcaacaatacatacttcgtgttacgaatgccggcttggttcaagatacgcttcgtcaaatccttgtcaaatgacatcgctgaagcggcagtaccaggcccaatgtatggcttttgcaacaaacggaacaacgcttgtaacgtaccatcttcacccaagttaccgtgcacgactgggtagaacaagtcaatttctgacatctcacccaaaactgcaattggtgccaatgggttcttcaagtccatctttgactttgcttccgccacaatcgtatcttcgtcttcaccatcaaatacgcgctttgaatcagcggcattgatcatgattccgtccttagaaatcaagaaaaccgttacgttgtacttttccttgtccatggcatcgtaaatgttacgtgctgaacgctttgaaacgtcgtgttctgatgaattaccaccaaagaacatcgcaatgtttagcttttctgacatgtctatctccctgtcaaactgatttatttggaaccctcagtataacacgttcctgaattcttgataagttacgctagaaagtttcgcgcttcgttaagataattataaatttctttaggcaacttttcgcgtaacagtagcccttgaagcaaccgctgctggttgtacatacgatgccaatcggcctcaacttcaggttgcatctgacgggtcatttcttgacgccattgctttaattgctttaagaaataatcgcgatacagtggattcatgttcaccagcgtcacgatataactatcaattcgacggttttcacccatcaccagcggcgtctccaaacgcttgatacgttcaatcagcaccgtcaataagaaaattttgtctgcacgggtcacagcatcatcgtttgataaatcatctaacatattgccaacgtgcaagaatgtgtgggcccagcctttcccctcaacaaagccacgcgtgtcatgctctaacgcgatataagtcgctaagttatcaatcatcatttcatgcaaatcatctgtaaacaaatcaaagtcattcgtccgattagcatagttcaacatcgatagaataaacacagcgaatgatcggaagaaaataccatcattattcgtttccgtaatgtgcgaaaacaagactgaatcctgtagcaggtagcgtgtcatcatgacaacttggttatcactgaaaatatgattctgtaagccatcactgacaaagaaaaacacaccgcgatcacgtagttcaggatcagtctgacgcaaccctgtcatcatatctaatacgtcttgatccgtgaccaccactggttcaccagcaatcaatgctgtctgccaatcagaaagcttttcttgcaacgtactagcagtggccgcatctaattgcgcaacggttgttggggcatcataatcaaactgatcaatcaagcgaccaatctcagctcccattgaatcaaataattcgccatggtgcacccgttcacggatggcttgtaattcttgtcggacttcatcaacggtataatccattatctctatccctttattttctctaagttttttgctttcaaaataaaagctatcatcactaggttaacacaacctcttgatgatagcagatgaaaatattcgtttttaacaactattcctttaggtggaagtagtacgtcgataccgtgacgtcacgtgaggccaacgccgtgcgcaaacgcaaactattttggttgtgcaaagcattttgccaaccgtgacgtggtacgaattgcggaatcaagatagtcaaggaatgattgcgttccttagcacccttcgcaatttcgtcgacgaaacgtaatgacggctctgtaattgatcgataagacgagtgaatatccacgtagcggacatccgggaattcacgcttgaattccacacccaaacgatgttccttttcagggttcgaatcaaacgaaacgtgcattgccaaaacgcgatcacccatcgattgggcatagtcaatcgcatcagccgttgccttcgtcaagtttgagaccaacacaatcacagtcgcaccatcgtaatgatgacgcttgaccggttccttagacaaaacacgcaattgctttgcgacagcgcggtagtgcttgtttacagtccagaacatcttaatgagcactggcatgataatcaagtaaggccaaactgacttgaagtgcatccagaataagataaccaccaaagcaaatgaaatggccgcaccaacgaaattgattgacgctttaccaagccaaataccttcacgttcacggaaccagtgaataatcattcctgattgcgacaacgtaaacggaatgaacacacccacagcatacaatggaatcagcgcttccgtcgaaccgttaaagattaacagcaagacgatggccccaatggccaatgacataataccgtttgagtaacccaggcgatcacccttgtccatgtagatgtgtggcatgaacttgtccttcgccaaattaaaggccaattgtggaaaggctgagaatccagtgttggcagcaactgccaaaatcaaagccgtggcgatttgcaacaaatagaacagcacgccgtgaccaaaggttgcctgaccaatttgggccaaaacagtcacgtggtcatttggacgaataccataccagtatgacaagaatgtaatgccagcaaagaagaaggccaaaatcaaggccataattgacaacgttgccgctgcattacgaggctttggttctttaaagtttggtacggcatttgaaatcgcttcaacaccagtcaatgaagatgatccacttgagaacgccttcaagaacaagatgatgccgatattcgatcccgtcgtaccgatagccgaagcagcatggaacgctacctggccagtcgcgatgttatacaaaccatatagcaccatccccgtaatcatcaagataaagaagtaaaccggcaccatcaagaagccagctgactcccggacaccacgcaagttgattcccatcaaaatcaagataatcacgacaccaatcccaactgcatagggatgtaaggctggaattgctgaggtaatggcttctgtacctgccgcaacagatacggccacggtcagcatgtagtcaaccaacaatgaaccacccgcgacaagtcctgcgttacgtccccagttagttgacgttacgacatacgcaccaccacccgatgggtacgcatgaatgatttggcgatatgacaacgtaatcgctgccaacagcaccaaaaccagaattgcgatcggaatttgcatccaaagggccgcagcgctcgcagcgatcaacgccgtcgtaatttgctccgtaccataggcaactgatgacaacgcatcagaagacaacaatgccaatgccttggttcgactcaaatgttgcgagccttcttccagggtcttcaatggctttccaatcaacaaccgctttaaaaagcgccacatgattaattcgctcctattaaattagatttagctgttacgccaatttgtaagacgatttaaaatttctacaacgacttattttagtgctatttacacccgttgtctatcattgatatttagataatttttcacaaacaaagaaccaccgccaaaagcatgacggtggttcattagtttgtattaaattacatcatgcccggcatcccttgagcaggcattgcaggggctgcgtcttccttaggttgctccgcaacaacagcttcagtcgtcaacaacaaagctgacactgaggcagcattttgcaaagctgaacgcgtcaccttcgttggatccacgataccagcagcaaccatatcaacccattcatcagtcgcagcgttgtaaccaataccaggcttttcggccttcaattggttcacaatcactgatccttccaaaccagcattttcagcgatttgacgaactggctcttccaaggcacgacgcacaatgttgatacccgtttgcacatccccatcctcagacaaggcagcaaccgcagggattgcgttaaccaaggcagttccaccaccggcaacgaatccttcttcaacagcggcgcgtgtggcattcaaggcgtcttcaatacggtacttgcgctccttcaactcagtttcagttgcagcaccgacgttgatgacagcaacaccaccggccaacttagccaaacgctcttgcaacttctcacgatcaaaatcagaggttgtctcagcaatttgacccttaatcaagttaacacgctcagcgatggcatccttgttaccagcaccttcaacaatcgtcgtgttatcctttgataccgttaccttagcggcttgaccaagttgggcaatcgtgacgtccttcaagttcaaaccaaggtcttcagtaatcacggtaccacccgtcaagatagcaatatcttccaattgggccttacgacggtcaccgaaaccaggtgccttcacagcaaccacgttaaacgtaccacgcatcttgttcaagaccaacgttggcaaagcttcacccgtaatatcatcagcgatgatcaacaaagcgcgaccttgctcgacaacactttgcaacattggcaagatttcttgaatgttcgcaatcttcttatccgtaatcaaaatgtatgggttgtccaaagatgcttccatcttgtccgtatccgtgaccatgtattgtgacatgtaaccacggtcaaattgcataccttcaacaacatccaacgttgtttcgataccctttgactcttcgatggtgataacgccgtcgttaccaaccttctccatcgcctcagcaatcaactcacccacctctgggttagcagctgaaattgacgcgatttgcgcaatttcttccttcgttgacaccgtctttgacatgtcatgcaatgacttaacagccgcatccgttgccaattcaattccacgacgcacaccaactgggttagcaccggctgtcacattcttcaaaccttcattaatgatagcttgtgtcaaaacagtggctgtcgtcgtaccatcaccagcgatatcgttggtctttgaggcaacttcagcaaccaactttgcccccatgtcttcaaagtggtcttccaactcgattgacttagcaattgtcacaccatcattcgtaatagttggtgcgccgtagctttgttcaatcacaacattacgtcccttaggaccaatcgtcgtcttaaccgtatttgcaagcttgtcaactcctgcttgcatcttggcacgtgcatcttcagcaaacttaatgtccttagccatgatttattcaccctctattttaataattttgattaattgtgttttgtaaattaaagaaccgcaacgatatccttttcgtgtacgaccaagtagtcgacaccgtcaaccgttacttctgagccagcatacttatcaaagatgacctggtcaccttccttcactgcagctggggccgtcaagtcaccaactgattgcgttgaaacagcaacaaccgttccggtaactgacttttcttgagcgtttgacgcaagcaaaatgccaccaactgattgctcaggtgcttcttcaacttgcaaaacaacacgatctcccaaaggcttcaacatgttatatgacctccataggcaattataatttttagcactctcttttgttaagtgctaatcaacataaataataatagcacactgagatatttttgcaacaaattttgtgcaattatttacccggataagacaaaaagtctcgacgattcccgccgagacttttgtcttaatcattaaattcttccagtgccatacttgcttcagtccattgttcctcgactgtggctaattgtgcatccaacgcagcgatttccttagacaagtccgttaacttacccaagtcagcaccgttggctggatcattcaactctgcgttcagtgcatctcgcttggtattcaacgtttccatctcttcttcagctgctgacactgcccgttcaagcttacgttgttctttctgacgctccttgcgttcttcacgactcaagttctcaatcggcgtggctgacgcttctttgaactcttccgtcgtttcaaagctggccttggcccggtgtgacgctgcttgttcgccagccgtcttctccaagtagtaatcgtaatcaccatcaaagaaacgcgtgccgtttggtgataactcaaccacctcggtcgccacggcgttaatgaagtaacggtcgtgcgaaacaaagaaaatcgtaccgttaaactcatttaacgctgtctcaagcacttcacgtgaatcaatatccaagtggttggtaggttcgtcaagaatcaaaaagtttgcgtgttgcaatgacaacttcgttagcagcaaacgcgcgcgttcaccacccgaaagcgccgacacaatcttatccaccgattcacccgagaacataaatgaacccaaaattgagcgcacatcgcgttctggcatcgttgggtgttcatcccaaatcgtatttaagaccgacttctttggatccaaagtttgttgctcttggtcataataaccaacttcaacattcgcacccattttgattgtgcccgcaatcaagggtaacttccccaagatcgtcttaatcaacgttgacttaccaattccattcggtccgaccaaggccactgcgtgttgcttgtccacatcaatattgacgtgctcagccaaaatattcgtcaagtcgtagcctagcttcacttcattgacacgcattacttcattaccagactcttcgtcagttgaaaattggatgtgagcgacacccgtttcattcttaggggcttctaagcgctccatgcgttccaactgcttacgccgtgactgggcccgcttcgtcgttgacgcacgcacaatgttacggttcacaaagtcttccaacttggcaatctcttcttgttgcttgtcaaacgccttctgttcttgcagcaccttagcggcctttagctccataaagcgtgagtaattacccgtgtagtgatccaacacacccgagtgcatgtcataaatttcgttcacgacccgatccaagaagtaacggtcgtgggaaacaatcaacaatgccccttggtagttttgcagatattgctccaaccaagacagcgtttgcatatccaagtggttcgttggctcgtccaagattagcaaatcaggcgtctccagcaactgcttcgcaatcgccaaacgcgtgcgctgaccaccagatagtgatgaaatcttttgatcatagaatgattcgtcaaagccaaatccatgcaataccgatcgaatagttgcttcataaccgtaaccattcatttcattgaaatcgtgttgcgcttgatcatacgccgacaataaactcgtgtagtcatcactttcataatccgttgccgatgcgattttggcttccatctcacgcatcttcttttccaacgaaatcactcggtcgaacgccgttaacatctcattgtaaaccgatagatccgaatctaaacctgaattttgtgccaaataagcgagcttaatgccctttttcatcgaaacagtcccctcatcaggttgtgtttcgccaattagcatcttcaaaagcgttgatttgccggcaccattacgtccgaccaaaccaacccgacctttatcttgaatctgcattgatatgttttcaaagaacgtcactccgctaaagcggcgggcaacattacttgcttgtaaaataatcatgattatatatctccgtctcaacaccccgcgtccagggcattgcctaaatctctctatctagtgtaacagaaaacgcaaaaaattccgcgatagtcaaaagactaccccggaattatacttgttattttagcctgctcgtttgatttcccgtcgaaacgattgccagactaatccgccaatcgttgtgacagcaaccaccaccagaccgagccatgtgtaacccgccaacgtatgattggtctggttaccagccttcattgcctgcacttcatcatgcgtttgatattggacaaccgcgccaccgtcaagttgcgcactggtggcgtttgcgccattggtagtcgtctgacttgtcgtcacccgactaaccgccgtttcatcaccaaacgccgtgccacccaccaaactcaaaccgaatacaatcaacgcaaccactattaagcgcttcatgatattctaacccctttctctgttcgactaacttacccatgttagtcccattgaaagtgtataccatattacgctaaaaagagcagattactggaaaacgacaccttgcttttgcttttcgtgctgaataaagtactcccaggcatgcatttcactctcaaaccagagatgctgcccatcgtagtccataacttccaatgatgtttgaacaagtggccattcattattcggcttaccttcaatgtgttgccacatgaatgaggctcgtgcagcaacgtcaccagttggggtatagaaaataatgtttgagatattcccattcgtttggtaataacgagttgctgacttaaacccacgccagtcccaaatatccgttacagcaacattgtccaatcggtcaatgtaatgcaacattgatgaacgaccacctgggttgccggcaaataactccacatcaatcacattgcgaccgtaagtcgtcccaaaccgacgagcctgagccatcccccaatcaataccgtccaagtgatagcgtgtcttatcaatttgcggattgtgtcgatagtggaccattttaggatccacatcagttgccttttgaaacacatcatacatattcaacaaatcttgatccgttaaaccgtgattagccaagtgcatatgttgatctgggtaatacccacgcacaacaattttcgcatcattgcccgccgcacggtcctcttttacccgtgcagccacgttgacatcaagcgttggtaaatctgaattatctatatataagttcatcgctgatctccttaattcgctgcaaagtaagtgacacctgcaacaccattaatcgtcacttcatccgctcgttgaccgagggtgtacgccgtcatcgttgtaccgccttcaccaaccccaacgtttgatagtgcaggagcctgcgctgccattgctggccagcgcttgtttgcatcatctaacaaaccttgccaagcttgccacacattttcctcgtaataacggtcactgtggtcataagccgcatctgaaaaggcttgtaacttttgtggatcgttgaataattcaaggaagcggtcagccatttcagacacaaattcatcttcttgaccttctggtgcccaggccgtcaaataaccattctcgccatcaataatcaagtcatttggaccgtagttcacattcgtcgatacacccggtagcccatttcccatggcttccatcatcgaaatgttgaacccttccatcattgacgctagaccatacacttggtgtgaacggtgaatagcatacagctcatcacgatccgtaacgtagtcatgcaacgtcacaactggtgaatccaaacggcggacttcattaatatcagtcgtctcttcgcccttctcattcagcatcgttggctttggtagtccatacttatcgaacaagttaatcaagtccttgttggtcttattgttgccagtgttgtcaaagtaaccataaacatccaagtgtgcatttagccccggttgcttttggttcgcaatcatcaaagcttctgctactgcagcaggacgcttatctggcgctcgacgcacaatcatcaacactgaatttggttcacgatcagccatcggcacacggtttgcctcacgaatttcagctgggacaacccccaccggaattgtaaacggtgttgcctttggtgcgtaacgtgccaccacgtcagccgtttgacgtggcatcgctgaaataattgcttgatagtcattcatgtgcatgaaatcaaactcataattgttattttcatcagtcgtcataacatcacgagtgtccgaagcgtgcaaattatgcaaatggaagccaatgtacgctggtcgatccatatgcaacaaaccttcatctgccgccgttgttcgatccataataaagacatttggctgttcagctgagtagaagtcattattcaaatcgttcacaaattcggccgtcaactcatcaaaggaatcaaaaatgtacgtcatcccgtttcgcttgatcaaccggtaacccgcaataaagttaacaaattgtggtgcctcaaagggcttagcttcaaacggttgtcctgacatgcgtgcgttatcggccaattgattttgtgcatcaatatgttgccggttcatcagcatcgtttcagacatacgcggacccttgcgacgtagaaactcttcaatcactggtcggccttgacggtccacaaacactttcgtattaggtgtaccatctggatcgatatattgttggcgactaataaagccacgtgaatcatacgtatcaacccggaacaaattaccaaagtgttcaaacacttccaccatcgttacccgattttcgtgttccaagtcaacgtgaatacgccccaaaaaacgtgttcgttcaatatcttcaaacgccataaacgtctcaggcttatcagccattggctccactactgcaactgggcgaccaccccattcaacatcttcagccgtcacgatgcgatcgggcacatattctgtccctgcatagtaatcatacatattaattacttcagcatcgtttagttgccatgccagcaaatctcgatgaccattggcgttgtaaacccgggtcacgattttaaatgactgaccattcttacggaataacttaccgcgttgcacttgggcgtgttcaatccccgagccctgtgctgcaagtccctcattgacgaaaaaattcatcgcacttccctcttcttatccattttaataaagtagccaatcaaacttgtgatgcgaaaccaccgctatttccaatcgccactgtcttgatttaagtataccaaaaaacgcccgcagattagtgcaggcgtgtgtgcatttttatagattagcgcgaacttctgacacgaaatataatgaccctgtgaacaaaatcatatcattttgcttcgcgagcgctttaactgtctgataggccgtttgccagtcctgatggacagtaaccgtgtgtccagtcacttgagcggccgcctcagtcggatctagaaccgtccgactgcctgggttttgaaaaccaacgacgtggaggtccacattaggcaagtcagccaacgtatgaagcatttccggataagctttatccgctaacgctccaaacaagatatggacagttcgttgcttaaaacgtcgcgccaatgttgcagctaatgcatctacaccgtgctgattatgtgcaccatctagtacggttaatggtgtgtttgatacgcgttcaaatcgaaccggccaagtaacgattgccaaggccgtctcaaccatctcaggtgtcagttcacgaccaagcaaccgcgcggctaacgtggcagcttggatggccacggccgcattttctatttggtaatcgcccatcaaatccacgaaaacgttttgttgtgttacggtacctgacaaattaaaacgttcaccccattcagtatcaccaggcaccatggcaacttcaaattcatgaccgagctcaaaaattagggcacctgcggccttggcgaccgtcgttacgacttggcgggcttcttctggtaatcgtcctgttactaccggacgttgacgttgaataatgcccgccttttgtgtggagatttcagctaatgaattgcctagcacctgcatgtgatccaacccaactgttgtaattaccgatagcaatttatcaggaattacctcagtcgtatcccaggttcccccaacaccaacctccaagactaccacgtcaactggatgttctgaaaagtatacaaacatcatggctgttaacgtttcgaactcagttggaccgccgtcaggcaattcttggtccaacgcttccgtaattggcgcaatgcgctgcataatcgccaataaatccgcatccggaatgttaccgtcatttccttggacgcgttcattgaacgtcataataaagggtgatgtaaacatccccaccgttaaacccgtttgccgcaacaattgggcaatcatcttactcgtcgatcctttgccattcgtcccagtaatatgaataaacttagaagcccgttctggatgatctaatcgatcgagaagtgcttcaattctggcaaaactaggtgttttcttccacttgtgacgtccgtgaatataggcaatggcgtcagctgccgtttcaattgtaatcatctgaacggacctcctttttcatcttttcaatcctaacacacccaatctcccagagcgattttttggtgtaaaaaacgaggcacctgaactcagatacctcgtcattttgattttactaattgtcatcagcgtccccgccgattataaaccattgtccctaccacggttacgactagtgcaccgccaaaactcaacgccgcaatttctaaactatggggccgtttgaatgttttcacaactgtttctgttaacatcgtcaaccaacgtcgtggcgcaaaccacgcgcgatcttgtcgtgccaaatcttgttgcacaccatttcgtactgcaaacggtagctgacggacatcatcagccgtaatatgttgcgttggcccaagtgccattggatacatcacgtcatgcttattcgtactatgtgtcagccccattgtatggcctaactcatgcacaataatcgtccgaagttgctgttcctgtgtggcaaagccgtcctgcttaaacgctcgattgatatctcgtttatacaagacaatttcataggctggtttcgtcaagtttcccgtctttttcgtcaccgccaccgcatcgtcttttgcgactcgggcatcgtgtgctgtatcccagactactgtcacattcgtacgagttggttccgcagcatcaaacaaatcatcatcatttaaaactgtttgccattcttgagttgcctcaaaaacggcttgtttgaccttatcgggcattttagcattcccagaaacgctaaaacgaccagctggtgccccggcagctgatacgtcagtcatcgtgcccacggcgagcaatattgttaggctggccagcacccatcggccaattcgttcgctacgtcgccacatagttctcactctctcttacttacgctttcgcggtttattaaaccgacataatgtaagtatatcggttatcagtgccgtttgcacggacaatttacgctttgactgtttcaaaagtgcacaggaatagcaaaagcgccatccacaaatgtgaacagcgcttttacaagtgtaatttactaacattgtaacgacgaacagcttaaattcgttattaacaatatataagataatactctaaaaaccgacgacctgcaagcctttagaagtaacaatctcatttcagggtggctggtgcaacttcaggcaccactccgataagcaaataaattttggcacgctgatagcgcaccaagaatttcttcacttatctccggacacctgatttttgactttcagccaaaaaacgttgctctatgctctgcttaaacgcctggcgtgttttcggtcaccactgcattaagtcaaaaattttcagcacgcctgtggcgcaccgagaaattttcgtcttaattccggataaccgattttcttgctccgcaagaaaaccaacactctatgctctagtcttacttcgcagcctgcaattcggccaaacgagactcagttgctgccaactttgcttgccagtcagctagcttctcacgttcttccgcaaccacagcttcaggtgcgttgttcacgaacttttcgttacccaacttaccttctgcacgctttacttcgccagcaaacttcttaacatcaccttgcaaacgggcaatttcttcatccaagtcaatcaactcttccaaaggcacataaacttcggcaccagaaataatttgcgtcatcgccaactttggtgcagccacatcagcagaaatttcaagtgactttggctttacaaagcggttgatgtagtctgagttttcatcaaaaatgcgtgccaagttttcatctgacgtcttgatcaaaacgtcgatttcagttgacattggcgcatttgcttccgtacgaattgtacgaacagccttgatcaagtcagtcaagctttggaagtcagcttcagccgttgggttatccaactcagccttctcttctgggtaagcagcaaccacgattgattcaccatcatgtggcatctcttgccagatagcttccgttacgaatggcatgattgggtgtagcaaacgcaatgtgttgtccaacacgtaagccaaaacagcttgcacattcttcttggcagcttcatcgtttccgttcaacgtttccttggtcatttcgatgtaccagtcagcgaagtcgttccagatgaagttgtacaatgaacgaccagcctcaccgaactcgaacttgtcaaagttctttgttactgaagcaattgtctcgttcaaacgtgacaaaatccacttgtcggccaacgtcaaaactgacaagtcagcaggcaactcagccttcgtttcgtcatccaagttcatgataacgtaacgtgaagcgttccaaatcttgttgatgaagttccaagctgagtccatcttcgtgtatgagaaacgaacgtccaaacctggcgttgaaccagttgccaagaaccagcgcaatgcatcggcaccgtacttctcgatgacatccattgggtcaattccgttacccaatgactttgacatcttgcgtccttgttcgtcacgaatcaaaccgtgaatcaaaacgttcttaaatggacgacgacccgtgaattcctttgattggaacatcatacgagcaacccagaagaagatgatgtcgtatcccgtaaccaacgtgttggttgggaagtaacgcttgaagtctgcagcgtcttcatcaggccaacccatcgttgagaatggccacaaagctgatgagaaccacgtatccaaaacatcagagtcttgctcccagttctcgatatcttcaggtgcttccataccaacatacatctcacccgtttgcttgtggtaccaagctgggatttggtgtccccaccaaagttgacgtgagataacccagtcgtggatgttatccatccaacgcgtgaaggtatcttcgaaacgtggtgggtagaagtcaacacggtcgtctgacttttgcatgtccaaagcttgctcagccaatggttgcatcttaacgaaccattgcgttgacaaacgtgactcaactggtacaccagtacgctctgagtgaccaactgagtgcacgattggctcaatttcaagcatccagccttcagcttgcaagtcggcaacgattgccttacgtgcgtcaaagcgatccataccaacatacttgccggcacgctcgttcattgacgcatcttcattcatcgtgttgatgcgctccaagtcgtgacggttaccaacaccaaagtcgttagggtcgtgggctggtgtaatcttcaccattcctgaaccaaattctgggtcaacgtattcatcggcgatgataggaatctcgcgaccaacaagtggtacgcgcaccatcttaccaaccaagtccttgtaacgctcatctgatgggtgaacggcaacggcaacgtcaccaaacatcgtttcaggacgtgtcgtagcaatttcaatgtagtccttaccatcgtaagttaccccttcttcaacgaatgggtactttacatggtagaaagcaccttcatcatcttggtgaataacttcaatatctgacaaagccgtacgagccttaggatcccagttgatgatgtactcaccacggtagatcaagcccttttcgtacaacgtcacaaagaccttgcgaacagcttctgacaatccttcgtccaacgtgaaacgctcacgtgagtagtccaaagaaagtcccatcttaccccattgtgatttgatggttgcagcatattcgttcttccagtcccaaacttggtcaacgaacttttcacggcccaagtcgtaacgtgacacaccttgttcagccaaacgttgttcaaccttagcttgcgttgcgataccggcgtggtccattcctggcaaccacaatgtgtcaaagccttgcatacgcttttgacggataatcatatcttgcaacgtcgtgtcccaagcgtgtcccaagtgcaacttacctgtaacgtttggtggtgggataacgattgagtaaggacgagccttatcgtttcctgatggcttaaagcggttctcttgtacccacttgtcataacggccagcttcaacagcagtagcgtcatactttccaggcatatcaatttcgcgcatgtgaaattctccttatgaataatagctatcttatataacggatggtcgcaaataaaaaacgccctaaccatactaatttgtatgatcagggcgacttaatcgcggtaccacctgatttaacgggactactcccgctatctcgttagaacttaacgcgtttctcacggcatcgactactcacgttcaccggtgcggcccactaactactttcacttaaactgattgatgcacttctcatcacctgtgcactcgctggacaatcgacgtttaacttactttttagtgaattgctataaacgatattttacgtttatttagttagaaaagcaaggcataccgctcaaatgaagcgtgacaccaagcgctcaataaacggaagtaaaaccactagtacaaagatgtacttgtcccagtttaatgtggtaatgatgccatcaactcgttgtgtcagagccttcacctcaccacgtaattctgacaattcgatgcgaattaccttcaaatcaatccgtatttcccttacgtcattgcgtaagtctttgacaccttgctttaattcttgaaaatcatggtccgtaaactcctcaaatttctcatccgtcacataacgcccccttgtctctaccgacatgatattttcccttattaatacctaaaaaaattttgaaattagccgttcaataaatagtaccaataccacaagcacaaaaacgtacttataccaattcaatgaggcaacgatgccgtctacccgctgcgtaagcacattcaagcttccttgcatctcacttcgcaactctgttaattcaatccgaatttctgtcatgtcgccacgtagttccttcacctcaccacgtaaatctttgatatcatccttcacttcctgaaaatcatggcgcttgaagtcattgaattcttcatatgtcacgtagcgttctttggtctctgtcatagctcccccatagttcaatcaatagaaataatgtatgaatcccattaacgcacctaataccaccgtcataagccccgtcgcttgataaatatctttcctaaaattctgtcgtgactctcgattggccgcttggaaagcttgtacgacgtcccgcagcatcactcgcatatcttccttagtcgcaaacgtttcgagtgttttctctacatttaccatgcgccaattcaaaattcgtagttcaccacgcgcttttgtcaactcgactcaaatttcggccatgtctgtacgccactctttgaggctatcattcattttccaacaatcgtgatgcttgaaaccattgcatgtcgtctgtgtcttatagcgttccttgtttgccataacagcccccctacatttaatttaaatactgcaaaatactcattaacacgcccaagacggccgtcattacgccgagtgcacgatacatttcctttcggtttgctgacgagtggtcatggaacatcaactgcatctcgtccttagtcgcaaacgtttcgagcgtcttctccacgtttgtcagacgagtatccataacccgcaagtcagctcgcatttcggtgacatcttcgcggagatctttcaggtcatcctttacttcctgaaagtcgtgatgcttgaagtcattgaattcttcatatgtcacgtaacgttcttttgtctctgccataatgccatccccctgttaattgttaacggtatcgttatatccccttaaagcaggaaagaggtacctggcgattgccagatacctctttcgttaatatattaattataacagaaataacttttagtcacaatgtaactttacaagtcacccgtcaagaattgcgccttacctaaaccaaagctccaatcctcatccgtgtttgataccagattaatcatcacgtcttgtggatcaatccccaaatcgctatgaatgcgtgccaccaactcacgatagaagttttccttctgttcagttgtgcgtggacgcgtacgaactgacaaagaaataaattgattcgttcgcgtaaagccaagccctgtgtctgccataatgaaatcttctggatcatggtagctcacgatttggtaacggtccccttcaggcgcaccaaacgtttcacgcatcacttcgtatgataagtccaacagttgcttcacacgtgacttatcttcccaacctgccttatataaatcaaatcgtagtaatggcattttttcgcctcatttcttaaattaacatactgattgcttctaccaataagtatacgccgtatcccagtacaatgattgcagaaaggatattgacccagaccaagactcgtttgggtagccgatcttttaacagattcatcgtaatcgtgatgccattaaaccaaataaaagtcgctataataacaccgataataaacggccacacttgtgaatctgccaaagttccgcgtagtgcaccaagcatcaaactaccgtcgatcaatgcttgtggattagcccacgacacaataaccgctgtcaccagcgccttcttcaaggagacagcattttgctgcgtattaagttgcactgaattggcgcctcgtagaatgccgtaaccaatccacattactaacaagccccccaacagcatcacaattagtttgagcgtatcatgagaactaatcaacgcccccatcccgaagaacgcggccattgaaaacgctgaatctgcaatccacacaaacaggacgtacaagaatgcccgccgtaagcggttgttcattgcgttattaaacacatacaaattttgcatgccgattggtgcaacaaacgcaaaaccaatcatcatgcctttcaacaaggtcatcattatttttcaccccaacattttcactaccgatacagtatacagaaaatgaccgtcagtaaccatttgaagtcaaaattcagttcatctagtttacaacactagatgttcgcgttatgatagttacaacaataaaaaacgaaaacacggaggtgtgcatcatgcctgtcttaacaaatgagaatcgccgttacttaattacctatgaaacactaaacgccgtcacccacggacttggcgtattagccgccgtcgttggtgcaacattgctactttgggaaagtatgcacgctgactttgatggctttacaatggccgccctttggatttacgcggtttcaatcatcactttcctgctcgcttcaactctctttcatgcgttggtcttcaccaaagctggtaaggtatttcagttcttagatcactcgggtatctacctggtcattttgggaagttacacgccttacacttggttgttcttaccacataatgttggctggccaatttggggcacaattcttgggctaacaatcgccggcatcgtctacgacctattcttcgtcggacgctggccttgggtgtcggtcctcatttacgttgtaatgggctggctaatcatcttagcctttccatcattacaccattcgttaacaccgtttgcatttaatctgctactagctggtggaattacctacacattaggtgccggcgtatacttaattccaaagttgcccatgagtcacgtctactggcacctattcgtccttggtggagctgccttaatgtacgtttcaatcttcagcatgctcttctaatagcatagtcaaactaattaaagcaccccaactatcacaaaacatggtagttggggtgctttttcgtgcgtcaaattaaaaatcccgcagactaatgcaggacttttaatattattgtttcgtcgtacctgacgtgacccacttggtaaagtcttgattatcaccaatttgaccaccttgttggtgattcgtgtaatcattcttttgttgttgtgagaacgtaccccagaccgagccaccgatatagtaacgacttgcattgagcaacaaatccttcatcgacgtattgtctgccaaggtcccagcattcttcaattgatcacccgtccaataaccggcaaccgcaaactcagtaccatcttccaacttaacttgacgcgccacataaatgtccgtcatcttacccgtcttggcagctgccttcaaaatcgcaaccgctgatttcgcataagcacctgtgtaggcatcaaaatcctgatttgcattatcagctaacacaacttgcgctgacgttgcaccaacgttcgttgacaacactgccggtgccccatcgacacccttcaaagttgcagcaacgtcaaacttatcagcaacactgcttgctgaactagcgctcgccgaacttgatgatgaagatgaagccttgctagaactgcttgatgccttgtcatgcgcttgcttacttgaagtggtagctgacttagcagcgctagccgtcttttcagacgatgactttgtcgtctttttcactgtcgaagaagcctctttagcgcgatttgattcattgctttttgtgccattcgtgacaatcgcaaatacaactgtgaccgctgctaaaaccataatggctgcaacaatcacccgtttatccttaaacatacggttatcctcgtcttctcttaaacttatctttactattctaacataacctcttgcacaattttgctggcttgtgcataataataactgtattgacgcctccttagctcagctggttagagcaacggacttttaatccgcgggtccagggttcgaatccctgagggggtataaaccgtcaatgaaaaaacgacattcagagcacacgctctggatgtcgtttttgttttttgattactttccaaataactttgagaaaaagccacgaataccgcttggcttctcttgttggcgagttgttggtgcctcttccacaacttcttctggaatatcaacgggcgcggtttccgctgctggctcaaacggacgtggtgtctgttcagacgttgcttgctgagccacggcctgctgttccttttccttagcaacgtactcggcaatcatgtcatctgttaatgctggcatgacaagcgtcttggtcgtaacgcctagaccaaccttggtagtcgccgtcttgccagtaattcgactcttcgcaatcacttcaacctgtgcaggtgtcgtgttctcaggtagcaccaactcgaattcgtggctattatcaactaataaaaagaccggatcatcttcttcattcagtttaacagtcacatctacatcaggctgattaacacgaccttccagcaagcgttggttgtcttgcgttgaaataattgccgttacaactggcgctggaatatcaatcgtcaacgtgactgtttcctttgaagcaacatccccaggcaactgggcctccaccaaaatgtcaccatcaattacgccaactggcgccttggtcacgaaatcaccttggttgtctgaaacaaccgtatcatatttaccatttggatacttcacattgataacagctgctggtaccccaacgtgtccaatgaccgtcgtccctaggctatttgtcaaagttgaagcaactaaatttacttttgtttcactcattatgagatcctcatctctttaactgtttatctttaccttctattgtaacagaaaaaccatgggcagcacccatggtttcgctgacctactagtaagagatcaccctagcaggtctgtatggttatatgaggtaaaggaacaggccattggttagatggctaaaaagataaactgttctttacgtatcattaattatacccttttccaccaacgcgaacgaaaaatccctaaaaaaggaacgttcttaatttgttgtcgtaccgggcagattatttaactgccatgttaatgaaccggcgtacgttttaccagcttgaacgcccgtaatattcgtcatgccaaccgaatctagcgtcacatcaaaatcaacattgtcagctgtcgcccgtaatagctctgtactatcacccgccacaactgcttgatcaacccccttattattcacagcgtcctcgccggtcaattgcaaggttggtgcaaaactactcgtcccatccaaagccgtccacttgctagctaataagcgcaaggattgtcctttcgtgacggtacccgtaacacgtagcccggtatcagctttaatcacacttgttgcctgaatatcagtgacattcggtgtcccaaaagatatggttgtcttgtctacactgaccttgccatgtgtcattggtgctggattacttggtacaactggcgtgctggcattaggattgtcgagaatatcttgtacctttgacaagtcatcagatccaacaaccttcgtaatcgtttctttttgttccggtgttaaattcgtaacgacggatggtttggttgcggcaattgttgccaacgtgtccgcatctagttgccccgcctcagccaaattattaattaaccccgatgtaatcgcatctgggttgtttgccccaactttactaatcacatcgggcgaaataactgtcgcattcgtactagccaaatgttccaatgtatctgacgtaatggctgccggattattcgttgccagtttcgtcaacgtatccgcatccacaacattggggttggccttcacaatttgcgtcacactatcacccgtcagcgcgctggcatttgacgccactagtgtcgccatgaccttatcatcaaccaacgtaggcttggtcgttgcaattttatccacagtcgacgagtccaactggtctgcaaccttatttaacccactcgcgttgacattaacatcattccaaccatcattaatcgacgctgtaattaattgattcgtggctgtgtcgctgagctccaacccacctttacccgagttcaaggctgaagccaaaattttgtgcgtacttggatctaaatttgtaaagtcagcattcgacaaatctaccgtcgcttggttgaaaacaccctccgcattcgttgtgattttcgaatttgcgtatccaggactgttaactgattcgattgtaaatccaaattagccagagcaggtaaattcaacgcgtagttatagtaggtccaggcattactctggacctcgttcgcaataatcggattaaaccctaaggccaacgactgcaaggttgctgatttgttgaccatcataccaataagtaaccccgccttactaaagccactatcaaacggcacttttgaaaaggcacctgttaagtctaatgtggtcaacttagggtttgtggcaatcagggcaacgagttgattaagccaaatattcgctgtcgtataaactgtctgacgattaccttgctgatcccattgatcagtcgcataaccaccattctttaataagttcaccatatctgtctgacgactatcgctgatgaaattttgcgataccagactggttggcgtttgtgaattgctatcggctaacgcccccgcgttcaccatttgtacggacccaaccgccgttgcaaccgcgtcgttggtcattgacgtatacgtcccatcaacatcctttacccgattagctaaagacaccgttgttaaatcacggaaatctgccacggtaaaattagtaactgttttaccatttgctttggccgtcttaccgttggtagcgacactattatcaataatcgcttgaataactgcacttggaatcttataaaccgttaagagattctgggtgtaatcatctgccgcatgaaccgtgtcataagataaaggtgacaacgagctgaaagttgagaatgtggttatatttgtcccgattgcgccaacgactgacgctaacatcagtatactcatgacccgctttttcataacgccacatccccctttcaattcatcttcctatctatcagattaacctacttttagtcagttaatcacggtgtcccaaatcccccaaaagacctttttgggtccgagaatctcctgtcgtggtgcatatttatctgtcccagataacaaaaagggacaccttattcacaagatgtcccttttgctattattgttgtgtggcactctgcgtattgctgagttgccaattgattgtcccggtataggcttgtccagcaacagcgccatcaaaatgcgtcatctgaatcgatcccatttgtacgtcaaacgtttgagccgccgtcgcgttaccaactaatacctttgtacgaccatcggacgttaattggatggcatccagcgctttgttatttgctttgtcttgcactgtgccaaaggttaacgttggttggaattgatgctgaccatcagcggtttgccaagccgttgccgatactgctagtgaccacgacttggggatggttccagccacttcgatagctgtcggtgacgtaataacatcatctgtaccaccaagattaacctggccaaacccaatgttaccaccagacactgcaactgatccttgcgtgtctgattgcggtgcaacaaccggtgtatccgtcgccggcttagcggcctcagagttagggaccgtagtcggattgttgacaacatcaccaaccttgtcacttccaccagccgcggcaataactttctccttatcatcatctgacaagcccgttaacgccgctggattattaactgcaatggttttcaaagcagtcgcatccaatgcccctgcatcagccaatttcgtcaccaaatctggcgttaacgtggctggattctgcgtggcaaccgtcgcaatgacggttgcatcaatcgcgtcgggatgcgtcttagcaatcgttgccaaagtcgtcgcatccaatgcgtcggcattattcgctgccacagctgccaatgaagttgacgtaatcgcatcgggactcgtcttcgcgaccgttgcaaggacgtctgcgttcagggctgccccgttacctttggcaattgctgacaacgaatccgccgtaatcgctgttggatttgaattgaccacctgtgatacgacggccgggctcaaagcatcggcactacctgatgcaatcgccgacagcgaatctgatgtaatcgcatcgggctgcttttctaagatgcttgataccaaattactggttaacgccctagcactattttgcgcaattgccgacagcgaatctgacgtaatcgcagtcggcttatttgctagcactgatgacaccaccttatcatcgattgcagtcgcattattcgctgcaatcgatgatagcgcatcggccgtaatcgcgttggcatttttatctgccaagctggttaaggtgttggcgctcaatgcatctgcgttcgttgtcgccaacgtttgaaggacgttggacgtcacagccgttgcgttttgactaacaatcgtcgtcaccgtactacccgatagttgcggtgcaatcgactggaacccagctgaactaacccctggccaggcactttgactcgccaattgattcgtagccaaatcattggccgtcttatcatccaaagtcaacgacgcaccaccggaattcagggctgaagcgataacataagctgtattgccagagacgtttaggttttcactacctgccaaattaacactaccaccatctgatttcgacgcgtttgaaaagaccgaaccgttattatagtcaatcgaggtaatgttattaccacccaaattcaatgctgaaatttgtgagccaattcccgataaaatattaccatctagcgttgtaaaatcattattcgacaaatccaggtctgtgaccgaatttgaggttaacgtatttgaccggaacaaatagtaggctgagccatcaatggcagcagaaccttgttgatcagaccctaaccgattgccacctaagtttaaggtcttcaaatttgttagtttattagtttgaaccaaagccattgtggccatgtgtacggtgctatacgcactctgcgtaggcacctttgataacatccccgttaaatcaagagtcgttgcatttgtggctgaattaattactgccatcaacacgttcaaaataggagttggcgtgtagtattgatcaccaccactccacttaggcacacctttatcaagaattgtgctagcagctgtctgccccgtcgacaaataatcggcaccgagcacgacatcatttgtcacaaccggagacgcgccaccagtcgttgctgtgtaatccaatgatcctagccaatcagccacattactgttagctttcgatgtgtatgtgccatccgcatttttagtacgcgttgctagcgacagcgtcttcaacttttgtacatcaccaaccgtaaaggtattcactgtttcacccgcggcagtcggcgtgcggccatcactctcgagactattgtcgagcatcgtttggataactgctttaggaattcccaattgcaagagcgtcgtcgaagccgtatcggcccgcaccacttggttaggttgcgccatagttgcttcatagccaactacgccaccaaatcccaacccaattaatgtcaaaaaggcgacgactgcccgtaagcgcctcttattcaagcgtacatttaccatgacaatcgtcccctttcccaatttcaatattgatttatttctgatttgcctttaacttagcgagttcagcttccaagtcagccatacgactatccgcccgcttacgacgcttcatcatcaagaaaatcataccgaatacagccacgaccaatacaacaattgctgaaataccagcaataatacttgttggcacaccaccagcggcttgcttaatatcagcgttcaattttttagcttgctgactggtcagcgttacgtcgttcgtataggttttcttgtaacgatagcgttggcccgtaccatcctggtattgcccagcactatccttaacgtagtatgccgtcgctttcaccgtgtacttaccggcagttgcgttttccttcaacggtaccagatagctaaagttcgaatttggcgccatttgcatatcacgttgcttacgcgcatatgttttaccatcttttgtcaccgtggcttcaactgctaattggttcaaatacgtgctcgttgtgttacgcatcttaatcgcaatgttcgtcgtaccagcctcattcttcgttgctacccctgcaaacgtcaaatcaggctcccatgtacgattttcattacgcgccaaaatgccgacagtgtattggaatttattgacaatccccatactaccttgaccggttgttgctttttcacccgtttcgggctcaaaaatcaatgccccggaaaccatcccaggcaacgttgcaccaggcatcgttagcttagctgtatacgtcactgtttgcccagctggaattgtaattttgtccggcgcttgcaccaacttgttcacgttgtacaccaacgatggatctaactttgcttggttatcgtactggacaatcccactgttactagttgatgctggtgccgcctgggcatccaccaccatgtctttcttggtggtgttttgtaacttgacggacaagttttcactttggttcggctgcaacactagatcaaagaaactttcactcttgtcacgttgactcgctgcttgtacgggtgtgacgtttaagtcagcctgggctgcatgaatggttgtcccagacaacgttacagccccgacaccgactgcaaacgctagccatgtcatctttttcattatgtatataacctcttacacgaaatactctctctttaccaagccaaatgatgggaaatcaaagatggtttaaaagctttagttcgttgcggcaccagcaacgtttgacaatgaccaagtcaacgtgttcgtgtatgtaccagcgttaacattagtgttcttagcaacgctcaatgagtacgcacccaaatcgattgccgtaccgttgtttgctgcattaccagtggcaatatcaacaccgtcggttgtcactgtcttcttaccaatcttcaacgtggcattgttgttcaattcagtttcaccggcagttgtaccatcagtacccttgacccaaccaccttgcttaacgttcaacgtccattgaccgttatcggccaagaaatcatcaacgttcactgattcgtcatcggcagtcttatcgtacccacttgcataaacagttgcggcatttgcactaccaaagtcaacggcatcgttaacattgtatagtgacaagtgaccagcttcgaacttaactgatccagttgtcgttgctgaagtaacatcagctgtatctgaagcagccgttgtgttagcagcaaatgctgcaactggtgcaaccaaaacggcagccccaagcacagcagatgccaaagtcttcttaaacatcatattcgtttcctcttttctctctactgggacaagtctctcctcaagtcccaccattctctattgctaaaagtttgttatcaacttgatttcccatcatttggcttgataacttctcatggataaaagaatactttttacccacttacattatgtaatagaagcccccaaacattttactttttcccaaaccctcaaaagccgataaaaaccttaatttaaggtcatttgaaagcgctaacagaattcccaaatgctcgtatgtcagatgccgattacgtcactgaccgatttttcgctgataaccaaaaaaacgctccgaagcatcattgcttcagagcgttttgatttattaagttagccgttacttttctgctttatgtgtcatcttgcgccaccattttgctggtaacacgaaaattgccaagttaggcttccgcatctttaagaaccacaaaatgataaaggcaactaagccaaacacaatgactaagagcacaataataatccaggcccagaccggtaaatgatttgccgcgttttggacagcatccgttcgattcaacttttgcgcttgatttgcactcaaggtaaacgttgatttaaacgtctgcttgtaattatacttagtcccatcagcggccttatatttaccgttggtattctgtgaatagtaagcaaccgtcgcaacatggtacgtaccagccttaaacgcttttccctgtaattgcatggcccagttcattgttgaatttggggccatttgcatcattgattgggcaaactttttaaccgtcttacctttgttatcagttaccctagccgtgacagccaagcgattaacaaaggtactcgtcacgttgttaaatgttaacttcacaacgttttggccatcaacctgactggctttggcaccaccaaaatcaagctttggctttggtaagtcatcactttggcgcgccattacagccaaggcataggccaacttcgtttgaatcgcattattgtttgtcacgcttgatgtatcatcaacttctgaaaaacgtaggccgccggcaattaagcctgtcaccttttgcttggtcatcgtaaacttcacaggcacatcaacagaggtctttgccttaatcgtgatatcaggatgttcgacagacaacagctcacccatttttacaggtaactctttcaccttgtcggccgccatcacattatcaaccgatcccgtcgctgtagtaccggccgacccagtctcaatgtgaattttgatatcctttgaggcgacgttctgcaccgtgacatacaaggtttgactagcacctggattggctttcagattataaaagccgagggttttatcaatttgattatctggcatctgtggtgacaccacataattcatcgaattatccgccgaaactgtctgactagccaatgacacaaatgccgtcacaagtagtgccattaataatttcattcgtttcatttcaagcactcctattcgccagtgaccgctgcaccagcatcttgcgtcaattcataattaatctggcccatataagtgcctaacgcaggcatttgccggtaaaccgtcacgattggcacaacgttcaaatcagccagcttagtttcaccaaaagcattcgccgttacccgcatcacactatccgatttattggccattccgtacgtcttgccaccctcaattaacgtcgtgggggtattttctggtaacgtgactccaaatagttgcatctgcgtttttagctctgccccatttgggtcataggtggcgtttcccttagcgtccgtagttgctttgcgaaaaccagtaaacgtcgccattagttgccagttaccatttgacgtgtaattttctatattaccggtaatggccgcacccgctaattggtagccatccgtatctgttaaggccgtcgagttatttgccgtcaaagcactgttattgctaaacagttgggtcaaactaacccgtgaaaaatcaaccgcagtatcaacgtttaatagttgcaacccaccagatttaacagtcgccgtcatatctgtcgtggcgctgtcttgttgtacgccgtcatcatcgtcggcgtgaaccacaccaccggccaacccaagtacagcggcaagcgtcaaaagccagtatttacttgttcgcttcatctttttgcctcctactttgtatcgccgagtgtgttaccctgcacagcattaaccgtccaaacaatcgttcccttgtaatcaccagtgccaatcggcttattacctgaagttggttgtgggatattgaggtaaacgttattgtacgtcagcgtcgtcgtcttcgtcatcatacccgatgcaatcgtaactggatcagccccaattgcaatcgcatttcgcatatacaatcctgaacccaacaccgtcgagcccgagcttgcaacttgcgttaacgcatcatcgcttgccgttggcaaagtcgtcttactcataaagagttgcgcattttctaattcacctgtatttgaacggaaattaggtgccaattgagctgtgatattaatatttgtcttgtacttacgtgtatcagacaaaatgacttgcatattctggttgtcattttgcaccaaatcacttgaactggtgtgaaccaaactattaaacatgtttggtgacgtgtaaatgtcgaatggatttgatggtggcgtcaccgctgcaatggcaaccgttccggtttcatcatcatgatcatccgttgcttcactatcggcatcatcagatgcacttggcgcaactgatgccgtactatccgcgatggcactttgcgccttcgaaacggtatccgtaattgcaacggatgagttaaccgttccatcggaattcaacacagcggccgaattacttgccaatgcggaagcgacctggcttgcgtccgtcacgacgtgtgacgccatgcttgacgccatactcttggccacactagatgccaatgatgacattgcggcactatctagtccaccaacggctgacgcaaccgaactcgcgatttcactggcaaccgaacttgcaaccgaacttgcaacggccgcaccaacggcggctgacttgttcaacgtaaagtcatcggcagccttaccaacggccgaatcaatcgcgttcaacaagttatttcctgtcgtcgtatccaaattaccacgacctgaactgtccttggtgttcatttgctcattcacattgttacgaatatcagcaaccgttgacgtgtccttcaacaacgtatcacccattgatgacgaaatcgttccgccatcaaccgcggtcttaataacgtccttcgccaactcgtatggcgtgtttgatccagctgtaatcaactgttgggctgcatcagacgcaaccttaccagtcgtcacggcatttgacaaagccgccttcgtatcttcattagccaactgcgtaactgtcttttcagtggcagtcgtcgttgtttccgtcgtcgttgtttcaatctgcttcgtcaaagaacgaatatagaagaaatcagagtccgtatcggccggtgccacaacgggcacttggttcaacacgttttgcactttatcaatctgatcttgcaaagcggccgcaccagccgtatcaccggcggccaacaaggtgtcctgaacttgctgaatcttcgcgattgtaatgttggcatcggtaatcgcagcttgcttaactgtactcaacaacgcaccttgcgtgtcgtagtatgacggtaccggtgttccatcagccttcgtgtaatcgttaggctttggggcaaccggcaaatcaccataactggcaaccgccttcgggtccgtttcaaccttcgtctgcaaatccttcaacgcatccgttggcactggattaccgtccgcatcacgaaccgcattaccattggcatcgacttcgtagtacttcgccatgactgacttttcatccgcgtgcttttcaacataatcaagcaagtcagattgcgtcaaaggtgtcttaactgatgcgatatccaagtcatccgttgacaaggcagccaattcagggtggctagcttgcaacttagacaaggccaatgcttgtagcttagccatttgtgctgggtcgttcatatcaaccggattttccggatcatatggcaacttaaccgtatatgattgtccgttaacaaccactgaggtcgtaactgtaatcgtaaccgaaactgattgctcgcccggattcaattcggcacgtgatagcaaatcagtatagtcgttcaacgtagcttggtattcagcacgatccgcaatttgctgacgcagtgccgccacttgctgggccaattcaccattcggatcgttggccaaccaaatttgcatatcggggtcgttcataatcttgttgtattgctgaatagcttgcgtacctgagttgtccaggaagaaagaatccaacaaaccgttaccggttgtgtcacctgcttgttccgtcaagtccaagaattccagagatgatggcttctgcaaaagtgattggtcggcagacgtcaacttgtttccagtggccgtcaaaataatcaaaccgttttgggcagcaaccgtaatccaagctggcaatgacgtgaaattgtcattgtcgatttgcaaagactgaatacgcttagcaaaatcgttattagcgttattcaattcaggcgggaacgtagtcatcgccgccatgtttgacatattcaagttaaccaacttgggataacctgttacgacacgtgaacttcctgaagaaccacccaaattggtcatgatgtttccagaaatatccaatgtcgtcaatgtcttgttgttgaaaatacggaagtcctgaccactgaacaactggttacccaagttatcgtaggccaatgacaactgcttcaaattagacaagctctccaagttcaagaaaccaaatgagtacgaccatgatggatcttcttgcgttgaagcgttggctggattttcagcactagctttccagtttgacatatccagcgacgtcatcgtcgtggcacccatgataatggcatcaaaactggcaaacaattgttgtccgttgttccagttaaacttattcgcactcttccacgtatcggcatcataaattgacaattgccatgaaggcacactcgcaaaataatcaccaatgccgttacgttgggcttgcttaatagtctttgaaccttccggattagtattagcatcgtatggattcttcttcgcatcatacagtggatctggcgtaccatcgtaagtcgttgccttaacgatttggtctgataggtccaactttgagatgttcatcaaatcaccccacgtcacgttatcatctgtaataccgtgcgcagctagtgaatttccatcgaaggtcattgagtagtaaacaatggcgtgaatgaattgttcgggcaggccccattccttcaacgtcatctttggtgagacaccgtttggcaacaattgcttgttatcacccgcggccaccttcaaaggcgtcgacaaacgcgtatcaacatccccggttccggcttgcccattggccttcatcgattcagccaatgaagaagccaaatcggccgctgaagaagttgcagcactaccagtcaatccaccagatgaccacgaaaccactgaactgctattcataatagatgatgccatcgattgcgttgcgctcaacaacgtttgcccatttgcaaattcgctggcaatcgcagaactgatgcgggttgccgttgacgttggattgttccccaacgtggcatacattgatgacgcttgtgaggcaagttttgtcaaatatgaataagccgtgcttgcactacttgcatagtacgacgcactagtagctgtaagcgacttcgtatttttcgtcaacacattcgcgtttgacaatgcggcatagtatgcactggctgatgctgaataggtattcatgatacccaaattcagagccaatgctgaatcattaccagcttcttcacccgccgtcgccgcatacaatgaattcatcactgattgggcttgtgaagtaaagacgcccgcttgattggcagcacttgcttcgtaactcaaagcggcactcactgaggcatttgaatccgtgatcaacgccgcaatcgaactagccgtactgtacgctgatgatgccttcattgctgcacttgcgatttggctagccaatgatgatgcggtatcaacatttgacaagccagatgccgttgctttcgtcgtcaacgacttggccacactcaaagctgatgatgccacgtttgaatacgtaccaacaacttgcgccttgtacaaggcttgattatcaattaatgaagccgtgctcgtggcaatactgcttgccttgaccgtttggtcggcgatgattgacaattcagcttgcgcaatatcaccaagtggatcaaagctagcagcggctgacttcattgctgcattcgcgtttgacaacttcttggctgcagatgaagcaatacttgcacttgatgcaattgaaattgcattcgcacttgtgcccatcgctgacaaagcagatgccacgtttgacacttgcttgtaagcgactgacgccgtaaataagttggatgccaacacgttaccttggctcatcgcctggaacatgctgctaccagccattgaggcactagcaatcgtcgacaatgcttcggctgttgccttgttaatagaacctgaaatcagcgctgatagtgaggcagctgcactattcgtagacgtcaacactgccatcatacttgaagcagcatcggcgtacgattgaatgttatccaatacgatggctgacgatccacccaaagcaagtgacatccgactgtcagccgcagccagtgacttcaacgtattagaagccgtcactgctagttgcgacttgatttgcgtcgtatagactgtattgggatccaaagctggatcatcaccagccgacgttgcaacggaactcgtataagctaattgactcttcaagttagctaaggcgttcgaggcaatcatccccatatcaccgtcaatgccagtaacagctgactgagcagcctcattattgcttgcgataattgacgcatcttgcgccaacaatgaggcaatacttgccatttgcaaaatcttaccggcagttgaagctgttgcatagtctgagaccaaccctgaagcctcacgataagccgccaaggcactcaaatagtatggcgccaccactgctgcattgctcgtgaccgtcgcaaatgaagccactgaggtagcagcttgcttcattgccgttaacgcactcttaaccgcactggtatcgtgtttctcgtctaattgactggcttcagattgggccaaatcatatagtgacgatgtcaaagctgccgctgatgatgtcttggcaacatatgacttcatgttcgtactatcatttgtaatcgctgcagcactggctgcatctgtcgccgctgacaaagccgctgcaacggatgaattaaagccattcacaatgtcatcttgatacatcgcttggctgtcgatgtttccactggcagcactggcaaagttacttgcttgtgtcgccattgaattcattgctgagaaattctgcttaacaatgtcaccttgcgtatcacccatcttatcaatacgactcgatgtagccgccaatgctgacgatgctacgttatatgctgatccagctgccttggcatagctagcgatactatccacgtgcgtcactggctcagctgatgccttggcgttcatatctgacgccacacttagtgcactcgataccgccatatagctgttcacaataaccaacgcgttacttgttgctgctgccaacgaggtcgtttgtgtggtctgtgaagcaatattcttcaaagccgtttcaacagccgctcccttatcaccttcaattagcgatgcaaccgaatcagcaccctgactcgctgactttgcagctgacaaggcagcttgtgcaattgcatcatatgaggtcaggtctgtttggtttgatccaaaggccttaaccgcattcgattctgcatcagcagccgacttataagccgtcgctacggcgtcagaataagttgtcttgataatacccgtcttggctgaatcagaattagaagaaggattcgtgctaggcgctgttgcgttagacgaactcgaagcactgccatttgatggtgtgctactacttgatgacccattagatggtgcaccagaatcagttgagctattttcagccccaatggtgatattatcctttgccttctgtgaaacagcttgcttagcgtcattcaattgtgtcgtcaaactatccaattctttttgaatcgtatcaatttgcgtattgatggttgttaaactagccgtcgcatcagcccagtttgcattggctgaaattgtcttctgcgcagtaatcgcatcttgataattcttttgaatcgtttcataggcatcggacaagttcttaacaaccgtcgctgcagcgcccaattccgtatcagacgcggtcagcatatctgacttgctagcatataaactcgtaaatgaattcttcgccgccgttaattggttcaaggcaaccgtggcgttcgcaactgccgcatcaatggccgtttgcgcatcttttgtcttcgtcgtaatagccgcattcgctgccgttaagctttcattagcggcattgattgctgctacaacttgggccttcgcagcactagccgctgtgttcgatgttgcatcagcctttgttgcatcaatataggcatcaattgcttttaaggtgtcattcgcatcatccaaggctgacttggctgactgaacagctgcattggcgtcagcgtaattggtcgctgaaccagctgttgtcaaatttttagacgcagcatcgaccttcgcttgcgctgcggctgctgtatcttgtgcattcttcaacgcttcattcaccgctgtcatatcaacagttggtccagttgaaacttgaagcttaccactatctgaatcaaacttgatattatttgatggaatcgtaatcgtctttgatcccgtcgtggttccagcacttgaatcatcagttgccgcgttcgtaatcgcttcgttttttgacgttgccaatgtcttttcgtctgccgtgatgttaacgaccgcatcacccgtcttttcgtctgtcacgacggtcacaaccggcgtatccgttttaaccgatgtgtcgactcccaagatatcctttttaactgatagcaacgtatcgtcattatcgttataggcaattgacggtggcacagacgtatcgttctcagtttccgcctttgccattagccccgtcacataactgggcaaccagtctgcttcaataccaccaacataaacggctgacaactttgaggcgaaagacatattctggccccacatgttaaagtcaccattcgacgtaaacggattgaacgaaatatccaaactggtcagtgacttccaaattgccgtgacatctccattagccccgctagcagcaaaaaagtaggttcccaaatattgtcccaatgagcttggtccattatttccctttgtatcaaaggttgaaaacataccagcaatattcagcgacttaatgcttgtcgctgcaaccataactttttgcaatttagccgcaccagatccaaggctccagccatttttccagaagtttgtttgacttgtaatcgcagccaaaccagggtttgcggcggctgacaaatccagcgccgtcaaatcagctaagttatcgtatgtgaccgtgttgacgttaacaccatctttaacagccaatgactttccaccaccagccggactcttcaaaaccgcctcaataatcgcttgtggcacaccatctgattgcaaggtggtaccggccgcaaatgctgtggcttgacgggttaaattccattgttgaataactggaaacgtctgcatcgccgtcgacatcgtcaacgtacttagcaacgtaattgatgcaaaccgagtgacaacccggttcatcgttgttttactctctcttttcatttcgtgctacctcacaaaaatgatccctctagttaagtatttaatatttaaaaataaatatgtatgcggccattgcgaccactgttttatatatgtgtgttgattacttcaacttatccatgttttcttcgcgttcttccttacggcgcttagccaagacgaaccaaatcaaacctacgataaccaagacaagtaagacaacaacgccaatgattacccacataatgactggtaggctaccctttgccttaatcatggcatcgttatcgttaaactttttcgcttggtcggcagttaccgtaaacgtttctgtccaatccttacggtagtcaaaacgtgtaccagtcgcatcagcgtactttccattgacattttcactccagaatgcggtatacgttgcggtatacttaccagcagccaaacgttgtccatttgaatcgatcgtgaaatcaaactttgagtttggtgccatttgcatcatcttttgtgcacccttataagcaaccttaccctcagcgtcacgcaccttaccggtaatctccaaacggttcaacaaagcttgctttggatttgatacttcagcattaatcgttgtgtgcccattctttgaaaccggtgcgacacggccggtattcaacgtatcggccacgtcattgttatccgtcgtattccgagctagcacggcaaccgtgtatgacaacacggaattaatgttcatgccagatccggccttttgcgcgttctgaccttcttccaagaagtgaacaccaccggccatcacacctgtcactgctttgttaggcatggtcaattgcacgttgacagcttgcgtttgcttggctggaatcgtcaccttttcaggcgcctgcatatacttgcccagttgatcaggcaaagatgcatcgaacggcccattagccgtataatcgaccgctcctgcattagacgtaccagccgttccagctgtcacatcgatggtaatgtccttattagacgtgttttgcaaattaaacgttaacttttcttgctgaccgggattcaatttcaaatcaaaataacttgtatttgacttgtcaatttgtgtcgccggcaccaccgcttgcactgaaaaatctgacccagctgcgtgcgctgttgagaatggcaaaatacccatcaacagagccgcccctgctaatgccactcgtttaatattcatgacctatataaacctatactttctgtaaaatctgtcttaatagtagaaaaaagtgacgtgtcccatagtggtcgcgtcaccttttcgtttgcatgtcgatagattattctatgtccacaattagttagctggaccagcaaccaacttccagttgattgttcccgcgtatgaaccagccgttgcagttgatggcacgttcaacttaacatcagccgctgcagttgtcttttcaattgcagcacccttggcagccgtgacatcatcaccatcggctgagtaaatcatttgatcgtcagccttcaacgccgtcgtaccaagcgtcaatgtgtcgcccaatggcttagcagcagcatctgttgacttcatacctgagtagttagccgtcaagtgccaacccttacctgaacctgacaagtcagtaacgtgagctgtaataccgtcctttgcagcaacggccgtcgtgttacctgccaaaacattagccattgtcaaatcgccaaatgatacagatgacgtcacgtcattcaacgttaggtcaccgcttaccaagttaactgttcccttagtcgttgccgtgttatccgccgtgtttacgttcgtgtcagcagcaaatgcagccgttgaagctcccaacattgaaactgacaacaatgaagccaaaataatcttcttcataactcttttctcttttcttctctataagttctctatttgttcaagtctctcctcaagaacaaaacttattataggactacttactttccgtgtatacgaaattcaccacttgtgttcaaactgttcacaatttgttcacatttgccgacaaatttgaattttccgttaaaacaaacgtattttcgactcgatttgcagctaatgcaaccactgttttcgcagtggtttgggtcacaaacccgcttggcaccacaacattacgcttttcaaagcgtcgcatccgtacactaccacgatcaataatttgaccgtcagctaatataaataggtagttgaccgttcggcgacgtaatacggcatacagaattccaccagtcaggccaccgagtataactgccagtagcaaccaaccccaccacggcattacaaaacggtgttgtaacaacgcatcatccgtcgtcagtgtcttggcatgcttagcggaaacgtggagctttgtttgcccacgcgtgtgatacgtgtaacgcttgccatttggtgcatcaaaccgcaaattatccttcaacccataatacgcatcaatctgcacatcataatcaccagcaactaactgttggccattcgtccagacgttgaattgcatttgtgaatttggggccatttgcatattactggcattgcgctgtaagtagacaccctgtgggcccgtgactgtcgccatcacataaagaccattcaagaatgtttgcgtgttatttagcatctggatgccaaccgtggcctgattattaactagcgtggcattgacatccccaatactgagattcggcaccagaatcgcattcgtggtccggttcaaaaccgccacggtataaccaacttccgattgaaacatggtttttgaatcagttacatttgtttgttgttgctgcacgaaagaaaccccaccggcaagcacacccgagataccactatccggcgttttaactgataccgaggtcgttgctgatcccttggccggtacggttaccgttttggcttccggtgtaatcagctgttccatccgcgctggcaaattcacaaaatgattctcaccccaattttgtgtgccgtagaccacggcaccattatcagacgtacctgctgtacctggcgtgacatcaacattaatcggtgcgtcagacgaattttgcaaggtaaaggtcagcttgttggtagcgcctttttccgtcagcaaatctgcgtatcctttgttggccgattcttgtctttgcgcagtcggtgctgtcagcttgactgtcagcgcgttatcagcatgagccgtagctgtgaccgtgcccaacatcagtaaaccaacaacaattcctaacagacgtcgcatcattattcaccctgtccaacgccttgctgtaattggtaacggattgtcgcttgataatggcctaatccagccgttgcgggtaccgttaagtacgcatccatcgccttagattgccacacatgaccagttggtgtcgtcggcgtcgtttgtgtcgtaatcgccttcatccctgataagtccggcgtcgccactaatttattttgcgcatcgcccaacgccaaactaccatcgaactgatttgtgccatctgagaacgttgtcaccccagccgccaatgaccaggtttgatccgctcccgttaaattattcaccacaaaactaccagctggcaacgtcacagttcgtgtcactggtccctgtgataagtcattcaatgtcactgtcttaaatgctaacgtctgagcccatttttcaagggttaaatcgccaccttgaatattgacgcttgaagtcgtttcgccaacggtttcagcgctagctaccgtaccgacgctactcattagcgcaattgatgccacaagcaacgtttttttcttgttcataaacatccccgtcaactcccttctaaacagacaccactgtgtacgcgttctgatcacggcggaggtaaacctcaacttcgctgactagcacaggttgcccctgcgcgtcgtgcaaatcttcaccgttactattttgatcaattgccaaatacccctcgggaaccacaacaccttgacgagccaataaacgactgaggtacacatcatgttgggccaccaacgtatagtcggcggtataaaaagcaaccgttcgcttctgacgcttaaacatcacaaaccagacaccaaagccacccaatgcagttccggccaacaaggcgagcttagcaaagattggattaatcgcagcacccgcgacattgcgatcagccgcatttagcttgcgcgcttcagccgtagaaattggcaccgtcatatcaacggataaacgcttcgttgcggcattatttgcaggcttggctttggccgccgttgactgactggttgccgattgcgctgtgtcagccggcaccgttaactcattatccggtgcaactgaactactatcttgttgttggctaaggcttgcggcctcgtgatcaccactggtaactggtcgctgctcatgcgacgccgaatcactagcatctgtactagatgaatttgtcacagcccccggtgtcaacgtggtcgaaccggccgctgaaccggtcatttcaaccttgtaagcccccgcttcaaccttgtcaccattcaaccaaaccatccaattcaattgcgaattcggcgcaaactgcatcatattttgggcacgacgatacgtttttccgctaggcgcagtcactttcacgtccatcttgacccggttaataaaggctgggtacggattttgaaaatggaagacaaacgcgcttttaccagccactgttttggcaccttcagacgtcacagtcggttgcttggcatattgattcggttcagcattctgggccaaaactgcaatatcgtacttaacagtggcgttcaatcggaaccctgcaccagaagtgcgctgctgattctcttctttaaacccaaccccaccagcaattgtgccatcaattggcgacgccggcattgttaaggttgcggtaacttgcttggactccttaggcgccaacgtaacaaccgggtcagaaaccgttaaatggttctccatgcgagttgacaaattaatgaagtccgtattgggccaattttcactcgtgtaaacaacatttccgttctcactcgtaccggccgtccccttcgtcacatcaaccttaattgtcttatcacttaagttggcaattttaaacgtcaacgtttgcgttgacccaggcgctgcgatgacatcagcataacccgtatcgcgcgctgttggtcgttgcgtgcctgactcttggtaggtcacactgtaatcatcatgctcaaccgtcgccgcctgaccgtccacttgtaataaggtgatacttgctaccgttgctataaacaaggtcattcgttgtttcataacaacactccctttccactttcttgatatatgtatccccgcaccttggcgggggaataactattgggcaaccccgttattaagggtatataagacatttgccgcatagtcatcatttgagttaactggcaccgtaatcatcgccgtcacggctggtgaccgccagtacccactggtcttactgcgaaacaatgtggctgagccgtgttgtgttggatcagcgcgcattgtcacatcattaatcgttaacgaaccgtcgaacgactggctaccattcgtaaatggttccaccgccatcgacaatgtccaacccgcagttgcaccagaatagtcgttaatcacaaaagccccagcaggcaaagtggctgacaaagtgaccggtagggtgacttggtgccaaggtaccttgccaaaattaattgacgtgacaccccgatccagcgtccgtgtacctggttcaaccgtcacacctgccttaccagtcgttgcggatgccgtcacgggcactgccaatgctagcaagcctattaaaattgttacgccaattcttttcatttgcctaaccttcttgcgttagtgtggtcacttcgatttcaatgtacgtttgcttagctgcaacttggagatgtgtctcatcgataaccgtcacggccgtattcggaataacccgcacagcctgtggcagtgtcagcgcaatcttactcatgcgtccggcacgagcccgttctttgaacataaccgtgttcgtcgtcatatcaatcacttgaattgtgacttgacgcttcttcaacaatacgaaccaaagaattgccgcggcaatcacaatcaaaatcccgataaagaccttgtaagccactggcattttcgacttcatttgcaaatcatagtcagacttgtttagcttatccgcctgctctgccgtgacatggacggtcttcacactgtggttgtggtaggtgtacttatcgccactaaaactatattgacgtttgccatcctttgaccaatacgtatcggtttcaacgcgataatcaccggtacgtagccgagcaccattcgtgtaaactccccaattaaactgggtatttggcgccatctgcatgttggcctgcgtacgggtaaacttcaagccgtcaggacctgtcaccgttgtcttcatccccaacgcattaataaagctaggggtttgatttttaacattaaccgcaaacaccgtgtgcttattaacttgggtcgccttcacaccacccagcgtcagcatcccctccggaatttcctggttgttagacaacaacaccgcgactgagtatttgaaagtggcattaactttcaagccatcgccagtttgttttgagcggttttggttgtcttcaatgaaactaacaccacccgccatgcggccggtaaatgcttgcgctggtacttgcaacgtcgccgtagccaccactgtttgaccagctttgagttgccattctgtctgatctggcttcaaatagcgttgcatttgattcgtcatgcccacaaagcgttgagctgaccagtccgtcgtcgtgtaatcaactgcaccattgtcagttgtaccagcggttccagcaaccatgcgaaccgtaatattcttttgtgatgtattccgcaacttaaattgcaaggtttggtggctacccggcgtcgccttcacatcaatataaccagcgtccgctgattcagtgcgctgattatctggttgcactggttgtaccgaatagtcatcagccgcaaacgctgacgttgttacgaacaacggtgccgcgaccgccgctgcgaaagcccattttgcccacttcgtcattactcaatctcttctcttatttactacttttttaaacacaaaaagtctggcgaaaaccagaccgtttgcgagtatgttgcgtgtgatagattacttgcctgctggcgtcgctgaagctgcgtccgctggtacacctgacgtcaagttgtacgtaatcgttgcttcatattgaccgaccttggcgttttgtggcacaaggattgatgcacccgtatccttgttgttccaagttgtgtgtgaaggatcccacgtaccatcagactctgcgtcaaacaacttggctccttgtgttgctgaagtatccgttgacaatggcacgctgttgattgttaacgtaccgtcaaacttcttgttcgttcctgctaccgtaaaatcagtcaccgcacctgtcaattgccacttagcagaatcttgcgtgtccgtcacttggaatgtcttagccgcaagcgttgctggcattggttgtgccttttctgccaattgcgtcaacgttaccgttccaaagttaattgaagtaccgttagcttttgtgttaccagctgcatccttttcatccgcaccaggtgccttatcgatttgcaaaacaccgccttgtccagacacttcaacactggccttaccagttgatgtatctgctgatgcaacaccagccgttgccaatacagaccctgctaccaatagggctgccgtcaatgtcattactttcatcattccgtccctcttcgtggacctctcaaatccacttcactctttcttcttaggtttgacccttgttaaaaataataagttaaagtaagtaattattttcgcgcaaattgtgaagaaattgtgaacacgtccgaaaaaaagccctggcacaccgtaatggcatgtcagggcataaattttaaagacaatgatagctaaatgaaatcgcttcaaacagccaaagcacgataagcaccacaatcagataatggcgtcgtgtggccaaacgaatcgaccggcagtgtacatactcagccatccaatcaacggcatcaagggcgaccgcaacggaaatcagtgcgactaataaaccatccactacaatactgtgttgcaatgaaacactctgcaaaaggctcaaaattgcaatggccagtaaactcattaataacaatgaattaacaatatcaatccgtcgcatcccgtcgctcctttctcaaataccatcatcctatcatactaaaaaaatcaccgttacaacggtaattcccagatagtgactttttgtcgtgccacgtgccaaatttatcagaaaaacgcatcaaaaaaggccatcgattcctcgacagccttaactaacttgtgattactttgcgcgaacaatcaatgtgtcgacatttgccgtacgcgtcacatactcagttactgacccgatcaacaaacgctcaattgcgttcaaaccagttgccccgatcataatcaaatcagcgttcaacttttcaggcgcttgatgagcaatgatgtccttaggtgatccgtactcaattgtgtagtccacgttttgaacaccggcatccttagcttgttgcaagtatgcatccaacgtcttctttgccgtttcagcaacttgttcaaccatcgtcgtcttaaagtcagtcacattttggaaagcacgtgtatcgataacgtgcaaaatgtgcaagttggcatcctccccattacggattgccacttgaattgccttgcccaaagcggcttccgcttcctttgagccatcgactggtaccaaaatgttcttgtagtttacgtttacatctgccatgataagtcctcctctaataggctctttccctatatgtttattatacgctatttgaaaacgatttcattaataaacgtcaaacaaaccatgcgagaggtatgaagatttcattattgggtaaattacttaaacaaacggcgcacgacagttagcgctagcgccgttgtcataattgtcgcgaggataacaaaaatgccggctggtagtggtgcgtcccgataaataaccacactaatgagtagcaaagccgcatcaaccgtgaaaaaccagccgaaaatcgtcgctggcattttggcttgggcggcagcgatgcccataaagccagttcggtgtcgcaataagtatatccccatcgccccaattagcaaggcaaagacaacaaaggtgatcataatcatcatggtaaaaatttctctctttttcgtttcaaataaaaagcactaccagggcaaaccgtagtagtgcacgaacacttgattggcgccgttaatgattcacaatgagttggctccagattataggtaagtgggtgaataagtcagcgttcgcggctactgagtgaaacagcttgcctcgccggcttcccgacatccccgagcaatatggttgtaaagcaactacatatagtaggaatcacgcgtacgtccaaggaattcgcataaccatattatacgcctgccacataaaataaacagtcttgacaggctacttttttaatcccttacgttgggcgtcagacaatttttgatattgatctttatacgccacttcgacctttgagttgcccgctggatcaaagtagtgtttgccaactaatttatcaggtaagtattgttgcggtacccaatcgccaggatacccgtgtggataaacgtaatccaccccgtgacccaacttttcagcgcctttataatgtgcatcttttaagtgatctggcacatcgcccgtaccacccttgcgcacatccgccaatgctgcatcaactgctgtatacgccgaattcgactttggcgataaggccaattcaatcactgcattcgccagcggtatccgtgcttccggaaagcccaacttctcagcggtatcaattgccgtaatcgcccgcgctgctactgctggatttgccaagccaatatcttcatacgcgattacccgcaggcgccgtgaaataattggcaaatcacctgcttcaattaaacgtgccaaataatgcaacgctgcatcggtatcgctaccacgaatcgacttttggagcgccgagatgacatcatagtggccatccccatccttgtccgccgttaacgccttacgttgcacggtttcctcaataatgggcaaggtaatatgaatctgaccatcttcacttggcagcgtcgacttcaccgctaattcgaggccgttcaatgccgaccgtaaatcaccattcgtcgcgtaaaccaattgtcgttccgcatcttcttcaagtaccgcatcgaaattacccagcccgcggtccttatcggttaacgcacgttgaatggcaatcttcatgtcatcctctgacagaggttgcacttcaaaaatttgtgaccgtgatcgaatggctggcaaaattgaaaggtacggattttccgtcgtggccccaatcaaaacgatgcgaccactctccaaatgaggcaacaaaaaatcttgtttggttttgtctaaccgatgaatctcatcaagcaacaaaacaaccgtacctgacattttggcttcttcggccacaatttgtaaatcttttttactatctgtcgcggcgtttaaaatacggaacgcatatttcgtagaaccggcaatggcactcgcaatacttgtcttaccagtacccggcggtccatacaaaatcatcgacgacaacatttttgccgtgaccatgcgatgaataatttttccttcaccgactaagtgctgctgaccaacaacttcctcaatcgtccgagggcgcattctaaatgctaagggttgttgcatgtcaaccgccttctttcttactttatttttggctgcttaccaagtgcttgtaaaattgagcgataacgcatcatcatcgcaaaattgcctgttagcgtttgatagtcgacgacaaaattactcaacattgagaccaatgctgtcggatcatcaaagaaccattcatagtaatctaacattgcccagcgccactgcaaccacaaactgccatcacgaacttgttcccgacctaagtaacgtgccaggagtgtgtaataggcaaccaactcacgattgcctagtaaggctgctctaaatgttgctaagtcaagcgcctccaaaatattttcaatcaaacgataaggttcataggattttgcatagacccgtcgcatctgtttggtccaaacatcaatcatatccagtgaatcgatggccaacaaaccaaacttcaccaaacgtacctcgtgatcatgccatacatcaacgctcatcaactcatccataatctcccgacctaactgattggccaccggacttgataaccagccaggataacgggccataccgtctagcgcgcgatattcaaaggaaacttctaaatcacgccgactacctagtcgttcataattcttcaaggcaacctcggccatcacatgatacatggcgggatcggtcaattctggcacatactgcacccaagttgtatgcgtggtatcaatgtattgactgtaaaccactgcatctaaatcagccggcaataaacgcaagacccgcatcaaaaccgtcatatcatcagaccgcaataagtccggatccttgtaggcacggtacaacttatacgtcgacacgccagcgcgatcaatcgtggccgtcgtaatgtgtttgccttgcactacccattgaaacaatttaccaaagtgttcaaagtatggcacttcggttccagctgcataaactggaaaatgatttgtcgtttcagccggttgccagaaactctcacgttcagcgcgataggtttgccagattaatgccagatttaaatcacttggtgcaataccaattacactggactgttcgcgttcagctgcatctaaaaacgctttaaccaagtcgtccaacgctggattttccaacatctcatcatcgcgtacaaacattgctaaccgacgtaaaattttcaattcaaccgtatcatccgtggccggttgattaataatcgcttctaaaataaaccgtgtattttcacgattacgattctttggatcaatcaaaaacttcttaatggcttgcacgtgcatctgcatggcaatcccccagacatcaattggcaagaacgtgttaaacatcgtgatggaacgggcaaagcgttggtacacaatcataaactcttcgggcgtcaagccatacgccaataaaccggcgacgttcagctcgaagatggtgtaactttcagtttccaacaataactcttttaacgacgcaaataacgtcggatcatacccaccattttcacgaatgtacagaaccatctgggcgacttgatagccataatcgtccggcccgtcctctgccacagtcttttccgtcccaatcacatcggttttcaactggtccagcgacatcgcaaacattgaaacggtactaaacggccgaaacaatggtactttgactgccatggccaattctgaaaaggtcatggttaacaaggtcaacacatcaattaattcttttaacgataactctgcctcaccggcaacaaagcgataccagcgcgacttactgatgccaaactgttcaatcgcactgatactcacgtttttatcagctcgaatatcattcagcacttcaccatatggtctcattttctctctccctttaagcgactacttaaccaaataatcgcttataccaaggcttttttgccgccggttggctctctccttccaccgttggcgccttggttaatttaacaatatcaatttgatcgatattgacagcctcttttgctgcgaagaccgcaacgatatctgaacgatcaaacacgtcgtctgacttcagcgtaaacccaatactatacttcgaggctaactgcatgtatggggacaaatcatctaattctaaatggccatttaagaacaacgtgccatcgggatgcgccttaaattgggcctcccaagttggcatgtaggccgcctgaccaaatgtgtcacgtgtttgcgccgcataaactcgttctctgaacgtgcccaaatagtggttacgctcatccgggttaatttgtggtgtgccgtaaacggctgcttgcatatgtggatccatatctgacataggcgggtcctcaactttcattttcatagtagtttcacccctaagtttaccataatgacggcacaaaaaaagagacggaaattccgtctcactcaatcttctatctaaagaagaatcattttgaagcctacctgatacgactcaggcttggtgtgaaatttgggaaaaacaccaaacgacttcatataggggttcaactagttttgacactagtagccgtgggaaattgggtaaaagccacgggctttaagaacaaaaattattatacccccgaaccttacaaaacacatgcattttacacatgttctatatcccgttttcggtacaccaaaacgcaaaaaaacggtcatcactgaccgttttttctttaactgaacatcaacgttgaaatccccgcaacgaagacgtatgtcatatatgcaccgaatacccagtgaagcgcattaaacagtactggaaatgcccgcaagatgcggtgcccaacgaagtacaaaactgttggcgccaccataatcaaggcaaaaatttccaaccccatcagccatgtatttggtgccattggcatcaaaagaatcatagcttttcctccaaatcaacatctggatacttatctttaaaccagcgttctgcgaattggttttcaaacaagaagactggttgctcagcccgatcacgtaccaacaagttacgtgatgaggccatgcgtggatccaattgttctgggtgaatccaacgggcaatctttgaacccattggctccaatgagacttccgtgttgtattcattttccatacggaattggaacacttcaaactgcaacgcacccacggcacccaaaatgtaatcgcctgagtcccaggccgtgtacatttgaatcgttccttcttgtaccaactgggtcacacccttgtggaatgacttttgcttcaagacattcttcgcatgtacccgcatgaacaactctggtgtaaatgttggtaactcttcaaattcaactgccttcttaccggcgtaaatcgtgtcaccaatttggaaattaccagtatcataaacaccgataatgtcacctggataggcgttttcaacattttcacgcgtgtctgccatgaattgggtcacgtttgacaaacgcaacttcttgttggtccgggccaaagtgacatccataccacgttcaaattcaccggatacgatacgcacaaaggcgatacggtcacggtgatttgggttcatgttagcttgaatcttaaagacaaaaccagagaattgggctgtcgctggttcaacttcatccccacttaccgtcttcttagcagaaggcgctggcgcaaattgcatgtacgtttgcaagaatgtctcaataccaaagccttgcaaggctgaaccgaagaagactggtgtcaattctccgttcatgacggcttgctcatcgaactggttaccagcatccttcaacatttcgatttcatcgcgtgtttccgcccacaatgaattctcttgcaacttgtttggttcagctaagtccgtgcctacagcgttcaagggcaagaaacgctctgcttcagactctggacggaagacctcgacattgttgtggtacaagtcaaacaagcccgccaaaatttgacctgatccaattggccagttcattgggtaagcgttgattcccaacgttgattccaattcatccaccaggtccaacgcatcacgaccatcacggtctaacttgttgaagaatgtgaaaattgggatgtgtcgttcactaacgatttcgaacagcttcttcgtttgtggctcgatacccttggctgagtcgaccaccatgataactgagtcaaccgccatcaacgtacggtacgtgtcttcagaaaagtcttcgtgtcctggcgtatccaaaatgttgatacgcttaccgtcaaaatcaaactgcaaaactgatgaggtaactgagataccacgtttttgctcaatttccatccagtcagattttgcgaaatttcccttacggcccttaacagttccagcttcacgcacaacaccaccgagcttcaacaattgctccgtgatggtcgttttaccggcgtcagggtgggaaatgatggcaaacgtgcggcgcgtttgcaattcctcttgtaatgatgccatttttatcgcccttaatttctttactttatttaccgattttttgaaaaatcttaacaattcagtataccgaaaaaacggccgtgattcaacaccacgaccgtttcgtttttgacgtatgtagttgtccgaaaagcgcttaccacttgtgttgcttggcaatatcttcaagcgtcatcccaccatgcgaatcaatcacttggttcatcgccgcttgcaattctgaggctggcaagtcctgcacattgtatcccttagcaattaactctgcccgcgccgctgcaacatcagctgaatccatttgacgttctgatgatgagctggccggaattgaactagcatctgaagacgacgtgtctgacgaatcactaacggagctgtcagttgtactatcgctagcagccttacttgacttgaatgcctcactaattgattgtgcagccgatgaacgactaacagatgctgcaacggatgatgataactccgctgcttttcgtgatgaggctgctgcttcgctcaccgccttgctctgtgaggcagcaatacttgcggaagccgccttagaagacgcaactgatgccgccttgcttgaagacaccttggcttcagaagacgcccggctcgtcttgaccttgcgaacggccacatcaatattctcgttcactaggtccaccgcaccgtcaacgactttcgctgtgtggtaccaatccaaagcgtcttgccaatcgcccttattggcacttttatcagctcgaatggcatacaccagctgatccaacgctgttcgcgcttcaactgacttcttttccttttgtgcttcttggtagtagaacttggcatctgaccaattctgcttgtttaatgcgttgtgcgcatttgtcatcgtcgcctcatacccttgattgctggtgacatgacggtaaccgataatcccaccaacaaacgcgataatcagcaataagactaacccaaactttttcatattgtttatccccttaaaacatttccgtttttgattataaagtaaaagcagccaaaatgcgctaacattctggttgcctttacaaaatcatattgcgactaacgattattacgacgcttgatttccaagtagcgtcggtaccacaagtcgatgtactcatcagagaatgggccctggtgcttattgatccaatccacgagaattttcacgtgctcctttacgataaaatcaatatccgccgggtattgccactgcgctttgtgtagctcgtactcatccgtatccaacaaacgcttctcgccgtctgggaaaacctttacgtctaagtcgtagtctacgtattttagggcttctttatccaaaacaaatggtgaagcgaggttgcagtaatatgacaccccattatctcgtatcatcgcgacgatgttaaaccaatacttacggtgaaaatacacaatagcaggctcacgtgtcacccaccggcgaccgtcatcttcggtcaccaaggtgtgatcattcaacccaataattgcattttcactggttttaaggaccatcgtatcacgccaagttcggtgtaaactgccgtcgtgcttgtagctcttaatcgtaataaagtcgccttcccgaggtagtcgactatctttcatctctgagcccttttacggcctttcaccaaatttattcttttttattgtatcacgtgacacgccccgacgcactgttgtcttgggattcatctcttaataacgcttgtggagtccccgaattttaataatcaccgtgacgatggccacaaccaacacgaacaatatcagcaccatcaccgtatctaaccacgaccaagtattaacgtggcgcgttgtgaattcatcagccgtgacgtcgaccttggtttcccaatgcttcacgaattcttttttatcactaatattgtccacgtaatcgccggtcacactatcgcgcacccaccgggccgctaaacgaacggtatagtcacccgatggcaaacccgtcttttttaaattaatcggccaggtcatttttgaatagggcgccattgtcatgcctgcctgttctcgttgcaagacaatcttgccatgcttatccaccacctgcgcggtaacccggaagttatttacgaaattaccgtgcgggttgcggactaaaatgcccagtgctggtttgcctttaatgcgcttaatcgctgctgaatcaaatgccggtttcgccacgggcaagccgtctttgttacggacaaagacgccaatcgtttttggaatcgtcgtgatgccttgatcgtcactgtcactaccctccgtttttttagtggccacctcaccgcgcggggtaattttaataccgccagctagcaaccctcgccaagcggttttaggtgttttgagtgtgacattaaaccctgtattcgtagctgccttagcagtcacagtggccggaatctgcatatcttccccgattggttcgggcatcgacgtatcaaacgtcgtgtcgtcggctgtatagttgacgtttccattaacggttgttttagctgttcctttggcaatatcaaacacgatatctttgtccgtgtgatttgtaatcacaaatgacatgttctgggtttgatttggcgccagcaccatatcaaacgcttccgtgtgatttcctttaatctgcgttgccggaattaatgcatggacttcatagtccgcgacatccgcgtgcacctgactttgtacgccaagcagcgccacaacgaatgccaatgctaacccaatttttttcataactattcctcttcttaaaacgaaaaaccccttcacccccttaagccactaacgcaatgcgtcagtggctcttgggagcgaagaggtttcttcgttattttttaattctggtcaccatcatctcggcgtgcagctagcttacgctcagtcgcttcgcgtcgacgatagaaggccatgagaacgccgaacataccggcggcaactaatgttgcaaacaatagcgccacaaagtatgggtcgttcgtcataacgttggtatcatggaggttttgcaaatcactgacatcgccatccttatcgtctgggatttcgtgaatccacaagccttcatcaccatcaacaaccgtatcgtgaataaccgcaacatctggttctgtaatcggtgctagtggtgctgctgacgtcgttggtgtcacattcaccgcgctcgccgacgtgataaccgcctgactcacaggtgcctgactaaccagcgccggtgcagccgatgttaccaccggtacacttggcgttggctgcaaaacagtcacgacagttggtgtttgttcagtcgtcattggtgctttcacagactcatgtggtgttactggggccgtggccgtcgcaacaaaggttaccacctgatcaccgtttggttcgttcgtccgaactaacttgtaacctggcatattggcaacctgcacatcaccaaagtccgtctcacccgtttgcccattaatcttgatctcactaacaaccgtacgtgccgtccgatcgtgcgtttcaagccaaggcatttcagcatgagcatacttggtcttgtctgttaccgcagcatccggcacgcgctcacccgttacccgatcaacgctaaagtgcggtgtcaccgtgacaacttgttcaaccgttacaaccttaccatccggcgttttaatcgtcgtatggcggacgattgtttgcgtcttgcccgtgccatcaaccgtatcgtgcttcaagtgaatctcaaagatttgcgaatcacgtgttgcatcagcaatcgcatcataatgggcaccagcaataaagccgtctgataccagcacataacccatcgcttcgtaacgcttaatggttgctggactgttgtaaacaacctcaccgtccgtcacgccttgcacatcatcaacacgcaaagttgcaccagtcgtatcatcaattaccacaatttgagccttcgcagcatttgcgacaaatgttacttggtgtccttgaggcgcattatcaacagtcgccaaaccatttggtgtggtatccgttgcttccggtgcaatgcttgtcgctggtcggccgtcgactaacatcgtgtaaccaggcaccgcatacttcgtcaaatcaaccgttgcaaaatcaacacctgttgttgacgtttgggtcacctgaccaacaatatttggtcggccagctgccttagggaacgtgaccgtcaccgtttgttgttgcacggctggcgtgtaagtcactgtatagtcctgtgaatcagcttcctttgcggtgtaaacaaactcgtcaatcgacgtgtatgttttaccagcagcgtcagtaatcacataactatagcctggcacagccaaatccgcagtcttcataccaaagctgattgttgtatctgacgttcctgtcgtctcaacaactggttgacgatgcttaggatcgttcacaaatgttagcgtcgccttctgatccgtgttagccacaaatgtcacgttatgaacttgtggtgcactgtcagttgctgacgtgccattggccgtggtatccgttgcctcagggttaatcatcgttgtcttcacaccatcaaccaacattgtgtaaccgtcaacgttgtaattcgataagtcagtcgccgtgaaatcttgaccagtaacagtcgtgttcaccactgtgccagtctcgttagattggtttgctgacgtagggaacgtcacgttaaccgtttgttgttgtccttcaggcgtgtaaaccactgtgtaacttgggttctgcagcgtaccgtcagggttaaccgcgaattgtccagggacagtcgtcaaatcaaagtttgcctctgaatgttcaactatcttatgaccagtcgcatccgtcaccgtgaacgtgtaacctgctactaccttcactgtcgtcgcacccgtagcggttgtatttaacgcatccgtcttgcccgtgattgtcgccgttgctggtacattcacttgcgccttttgcgtcgcattcaaccctgtcgtgtcggtgttaaccgtcacaacctgttcaactggtgtgtaaacaactgtgaagtggtcattctttggtgtgccatctgggttgaccgtaaatgcgcctgacacagtcgtcaaatcaaagtctgacgttgcattttgcgccacagccttcccagctgcattcgtcaccgtgaacgtgtagcccggttcagctggcaccgtcgtctgtccttgcgccgtcgtgtaatctgcatccgtcttaccactaatttcaccatccgtggcattaaccgttgcttgttgttccttcgtcaacattgtcgtatcaaagtgaaccgcaaccgtcaccggctcagcagtatacgtgacggtgtaatcttgcaaatcagcttccttcgctgtgtaaacgaagtcatcaattgacttgtacgtgttaccagccgcgtccgtaatgacgtagctgtaacctggcactgccaaatcagccgtcgtcgtcccaaagttaatcgtcgtatctgactcaccatcattcttggtaatttgatcgcgctgcttaggatcattaacaaacgtcagacgtgccttctgatcagtgttcgcgacaaacgtcaccgtgtgcaattgtggcttgctatcagtcttattcaaaccgttagcagttgtgtcagtcgcttctgctgcaatgctagttgctggcgtaccatcaactaacatcgtgtatccatcgacgttgtaacttgataggtcagtgaccgtgaagtcctgtcccgtcacagacttattaacaacagtgcccgtctcgttgtcgcggtttgctgacgcagggaacgtcacgtttaccgtttgttgttgcaattcaggcgtgtaaaccacgttgtaacctgggttctttaacgatccatttgcattaaccgcaaattgacctggcaccttggtcaaatcaaagttcttctctgatttttcaacaaccggcttacctgacgcattcgttaccgtaaatgtgtagcccggcacagctttaaccgttgtatcgccggtagccgttgcattcaacgcatccgtcttaccggtgattgtcgccgtggttggtgccttcacttgtgacgtttgtgtctcgttcaagttcgacgtgtcgtaatccaccgctactgtttgcttaactggcgtgtaaaccaccgtaaagcgatcgttaaccagcttgccggtaggattcaatgcaaaggccccatctactgtcgtcaaatcaaatgacttcgtcgcatcactgacaactgacttacctgacgcatccttaatggtaaatgtgtaccctggcacagctttaacaatcttgtcgccggttgccgtgtcgtaggtcgcatccgttacgccatcaagttggccatcctgcacatcaaccgttgcctgttgtgcaggtgttaggttagacgtgtcgtaatccaccgctaccttttgggcaactggtgtgtaaacgactgtgaagtgatcattaattggctgaccagcttcattaactgcaaacgtacctgtcactgttgtcaaatcaaatggcttcgtcgcatcactgacaactgacttgcctgacgcattggtcaccgtaaacgtgtaacctgacacagctggtaccgttgtcgcaccattcgccgttgcatactttgcgtccgttacaccagtaatcttgccatcagttgtcttaacggtcgccttttgaccatcagttaagttgtttgtggcatagtgcacagcaacttccactggcaatgccgtgtacgtaactgtgtagtcctgtgaatcagcctccttggccgtgtagacaaagtcgtcaattgactcatatgtcttgccgtccacatcggtaatcacataactgtaacctggcacgtgcaacttagccgtcgtcgtcccaaagtcaatcgttgtatctgacacaccattatccttagaaatcatatcgcggtgctttggatcgttcttaaacgtcaacgtcgccttttgatccgccttcgcctcgaatgtgacttcgtgaagctgtggcttgctatcagtcttgttcaaaccgttagccgttgtgtcagtcgcttctgccgcaatgctggttgctggcttaccatcaactaacatcgtgtaaccatcaacgttataacttgataggtcagtgaccgtaaagttatcgccagtcacagacttgttcacgacctcgccagttacgtttggcttacccgctgatgcagggaatgtcacattaactgtctgctgttgcaattcaggcgtgtaaacaaccgtgtaacttgggttctttaacgtaccatctgagttaaccgcaaattgaccaggaaccttctttaagtcaaagtccttttcagaatcctttacaacgtcaccagcattattcgtcactgtaaacgtgtagcccggtacggacttaacagttgtcgcaccatcagccgtcccattcaacgcatctgtcttacccgtgattgctgccgtggttggtgccttcacttgtgacttctgtgtgtcattcagatcggttgtgttgtagtttacagccaccgtttgtccaactggcgtgtaaacaaccttaaagtggtcgttgaccaacttaccatcagtattcaaggcaaacgcaccggccaccgtcgtcaaatcaaacggcttcgttgcatcactcacaactggcttgtctgatgcatcagtgattgtaaatgtgtagcctggcactgccttgacaatcttatcgccagtcgctgtactgtacttcgcatccgttacgccatcaagcttgccatccgtcgccgcaacagttttctgttgttctggcgttaggttagccgtgtcgtaatctacggccactgattgggcaaccggtgtataaacgactgtgaactcgccgttaattggcttaccagccgcattaacagcaaacgtccctgttgcttccttcaagtcataatccgaagtactgtttgcaacaactgtatttttagccgcatcggttactgtgaatgtgtagcctggcactgcctttacagttgtcgcaccatcggctgtcgcataaccagcatccgtcttacccgtgatgacaccatcagttgcattgactgtcgtcttttgaccagcagtcaaattctcagtgtcataatgtacggcaacttccactggcttagctgtataggtgacagtgtagtcttgtgaatcagcttccttcgccgtgtaaacaaagtcgtcaattgacgtgtacttgttaccggcagcatcctcaatgacataatcgtaacctggcaccgtcaaatcagccgtcgtcgtaccgaagttaatcgtctcgtctgacgttccttctgattcaacgattgtcgtccggtgctttggatcgttcttaaacgtcaacgtcgccttttgatccgtgttagccacatacgtcaccttgtggttctgtggtgtctcatcagtttcactcaagccgttagccgttgtgtcggttggctccgacgcaatcgtggtcgttttcacaccgtcaacatacatcgtataaccatcgacactgtacttcgctgctaggtcagtatccgtaaagtcgacaccagttactgattccttcacgacatcgccagttacgtttggctttcccactgatgcagggaacgtcacgttgactgtttgctgttgcaattcaggtgtgtaaacaaccgtgtaacttgggttctttaattcgcctgattcatcaaccgcaaattggcccgaaaccttcttcaagtcaaagtccttttcggcatccttaacaaggacatcgccagccttattcgttactgtaaacgtgtaacctggcacggccttaactgtggtgtcaccatcggctgtctcgttcaacgcatcagtcttacctgtgattgctgccgttgccggcgccttcacttgtgacttctgcgtgtcattcaactcggtcgtgttgtagttcaccgtaaccgtttgatcaactggcgtgtaaacaaccgtaaattcgttgtttattggctgaccatcgccatcaaccgcaaatgtacccgttgcgttcttcaagtcgtacgcgtccttgctatctgaaacaaccttatttccggccgcgtcagttaccgtaaacgtataacccggcacggctggtaccgttgtcgccccattagccgttgcatacttggcgtcagttacaccagtaatcttgccatcctttacgttaactgttgtcttctgctcagctgttaactcagttgtgtcgtagtgcaccgcaacttcgactggcaatgccgtgtacgttaccgtgtagtcctgtgaatcagtttccgtggccgtgtaaacaaagtcgtcaattgactcgtatgtcttgccgtccgcatccgtaatcacataactataacctggcacatgcaaatcagccgtcgtcgtaccaaagtcaatcgtttcatatgccttaccgtccgaaatcaccttgtcagcacgattacttggatcatttacaaaatgcaatgatgctttttgcacagcatcaattgtgtaaacaaccttcgttgcaactggtccatagctgtactcgccagtctcagtattcaatactacttccgctgtgtttgatactgacgtcttatccggtgtgtaaccagcgacggttggcgtctttaccgtcgtatacgtcaacgcacccgtcgtttcatccaccgttacctttgccgcatcagctgtcgcgaccgtgtacgtatctggctggtaatccgtaacatacgcatccttcgccgttgcttgaattcgcgtgttagttaccttatccatctgatacgtgtggttcactgttaccgtgaccacgttcgttgcgggcgctgggttagccccttcgtatgtcaccgttgacgttgccgttaaatcttcactttgtggggtaacaccgtgacgcagtgttacttcataagtttgattctttgcatcatcgttgtcatatggcacatcagtctttggcaatccagccacaacataataaccagcttcttccaaagccttcacaacatcttgcgctgtcgtaaagtcaatcgtaccatcagtcacaccggtaatcgtcaccggttcttgacctgaaactgctttaccagtcgtcaaatccttaaatgtcacaacaaccttttgcacatctgcggtatacatcaccgttgacgcaactggtgcataacttaccgcaccagtctctgcatcgacaatcgcagcgctgacattttgcttcgtttccgcatctggcgtgtatccggccacagctggggtatctaccgttgcgaacgtaatatctcccgtcgtgccatcaaccgttgccttattcgcatcactttcagcaattacatacgtatccgccttatagtacgtaccataattagccttatcgccagcttggatacgattgccagtcacgtcatccgtttggtatgtgtgcgtcacagccaccgaaacaacgtttgtttctggcgctgggttggcaccctcgtacgccaccgtcgatgttgctgtaagtgtttcgtgttcatctgacacaccatgacgaactgtcaccgtaaatgtttggtcatttgcatcgtcgttgtcgtacaaagttgcatccgttggcaatccagtcacaacttggtatcccttagcaataagggcatcaacgaccgtttgggcagcagtaaagtcaatcgtaccgtctgacaatccagaaattgtcaccatatcttggtcagcaactgccatcttcgtcgttgcgtcttcaaagttgacatgaaccgtctgcttgtccgccgtataaacaacgtcgtaacccggcatgaccaagttaccgtcggcatcaactgcaaataattgatccttcgtcaacgcattcttcgtcaaatcgaagtccgttgtctgtgggtcggttgtcaccaaatcgccacgagaaccgtcggccttcttcttgtaaatcatgaatgtgtagccatcaactgaatgaataatcattgttgtggcagctgtcgcaactgacaataatgcatcagttgttgccgtgaccgtcgttggattatccttcgcccccgcatctacgcgggtttgttgggccgtcgttggcgtaccggcaactgcgtacgtcacctgcatgtgttgtggcaacgccgtgtaagcaacatcgatttcaggcgtctttaattgttctgacccagcaacagcaagtcctgattcattaccagttccgctcactgcgaacgtatagccgtttgctgcgtcagccaaatcgaatgtcgcctgactacccaagttagttgctgccgaaatagctgatgatgttgcatctgatccttgaccgtgcacttcgctgaccgtgaatgtgtaaccaggtcgacctgaaatcacagcatttgatgcaccactcactgtagctgatgcatagttcgtatccgtattaccagtcaacgtaaagtcagcagccgaaccaggcacattggcttgttgggccgtcgtcaaaccatctgtcttgtagttaacgttcaccgtttgtgaaattggcgtgtacgtcacttcgtatgcttggtcatctgtttcatcacgcgtaaagcgcaaatcatcgatattaaccggcgtcttcgtgtcatccccaaccaaagtcacgacaaatgtataacctggtacataaagttgactttgcgtaatgccaaaatcaaccttggcatcggtcgtgccatctttaatcggtgcaacgattggcaaatcaccagcagaaaccggcttattcacaatcgtcaagcttgccttttgatcggtgttcgcaacataagtcacgacgtgcttttgcacagtgccatcagttgcagccacagattgggcaagtgcctcatccgttgcatcattatcaaacgtgtaagcgacgtccgtgttgtccgccttttgtgacgccaacactgtgccagcctcaccatcgatgtgcatcgtataacccggaatgttgtaatccttacccaaatcaacttcagcaaacgtttggtttgaatcagccgtttgcgtaattggatctgtcactggtgccttaccggttgctggatcagttgggttttcaaaggtaatttgttgttgttgcttatctgcttgatacgtaattgtgtattgattttgaatcaacgcaccagtcgttgcatcaactgcaaacgtacctggcaatgtgctcaaatcaaagtccgcttcacgcatgaacaacaacttacccgttgcatccttaaccacatgtccagctgcatctgtgatggtatacgtataacctggcacagccttcacgatcttgtagttaaaggcgcctgacgtttcatccgtgtacgccatgtcagtctgaccttcgagtgaaccagttacaatgcctgattcatccgttggcaaacctgtgactgctagcacatctgtcataccagtatcagcgacatggtaaaccacatcgatgtgttgcttattcgctgagtaaacaaccttgtaactcgtgttaaccgcgtgcatattggctgtgacgttacccttaccatcatcgtcgaaggcaccggctaaatcactgtccgtcttatcatccacgtgcgcaacaccagatacagtcgccgtgtagcctggtaccacaacatagttaaagccgtacttgtggtccgtataaatgccagtcttagcaaccggtgaggcaacttgcgcgtcgatcttagccttagccgtcgcattcgctgcatcctgagtggctgcatcagcccattcgtacgtcacatcaaagtcttgcttcgttggcaacaacgtaatgtcgtaatgtgatgtttgcaattcaccagtcgcgtcaaccgcagctgtgttggtaaatgtcacattcaacttgtctgaactaatcaacgtgtgatcatccagcttgtaatacgtgataatcgtgccatcttctgccgtctcagtaaccttagccaacttgtcccagtcgatcagcttgccatcgatcttctcaatcgcataaccaggggttgcgacagatgtaatctggtaacccttatcggtcttgattgaaatcttcgtatcagctggcaacgtaaacgttcctgatggttcagtcgcatcagatggttcatcaacaactgcatagtgcaccttgatatcgtgatctgttggcacatacgtcacgacgtaaactgacttgtcacctgacatatcatccgccgtgaacgtaccgttaatttggttcgtcgcagcatcatattgaccagttacctgagcactttgggcaactaccaccgtcgtataacctggcaacgtttgaatagtcgtcgctgggtacgcaccgtcagtaacacctgtaatgaccgttgttgctggcaacgttggtgcattcgccaaggtagcacttgaatcgtattggtaaatgaccttagcagatgttggttcagcggtatacgtcaccgtatagtctgtcaccgccaactgttcaccgttcatttggaacgtggctgtcttcaattgatcaagcgttacgatcttgtcgttcgaatccgtaatgacataggcataacctggcaccttaagttgggcatccgttggcacgttgttatacgtactgtccgtcacacccgtcaagttggccaaattaggcaccttggcagctggcaaaccaactaccgtgaccggaattgattggttgttagctgtgtaaacaacattgaatagttgtggcgtaccatcgacggtcgcatccgcagcgttatccgtgttgtcatacgttgccatcgctgcaaccgcatccgtcaatgaactaaagccattaaccgtgtaggtgtaaccggcctttgccaaagcagcatccgtcgtctgcaacacaatcttcgctcccgtttgaccagtcgccgtctcaaagttatgtgtggcatcctgcacaatggcttgttgcaacgttggcgtgtaatccacttcaacctgcgtcacagccaaaccgttatcgtcaatcgtacctggcaacaagttaaagacttgatcaccaagtgccgtcaaatcgactgccgtcttcgtgccatcggcatgtaccagataagcttggaatgcatatccaggcacgtgcaattgcgtagccgttggcaacgtgttgtttgacgtaccatccaactcttgaccatagtgaccattcgtataaccagcaatcttagccaagttattcgccgtcattaagctcgttggcaaaccgctttgcacaatcccgatttgttgcttcttagccgtgtatgtcacgtcataagtttgcgtgtcatcatcagcatccgtgtactttggcaagttaaccaatgacgcataggcgttgctggtaccggccaaaacatacgtataaccagtacgcagcaaatcttgatcagtcaacgtttgcttggttgctgggtttacaaacgtaatttgtgtgttcgttgtaccgtttgtcgtatcgatatcagcttgttgctttggatcattcacaaagaccaacttagccttttgatcagacttggctgtgtagataatgtagaccgtttgatcttgattatcatcactgtcaaacgttgcgacggtgttttgccattggtaggcataacctggcacgtccaagtcagtaatcttatcgtagctaactgtaccgttagaaataccatcgatacgctctgccacacgaccattcatgtccaccccgtccgtcgtattcaacttaaacaccacgttgacacgttgtgcattaggtgtgtacgtgaccgtgtaggttgcaccaccggctggcatgcctggcaaattagccaattgtgccagcgtgtaggtattaccatttgcatcaaccactgatgcggtataacccgcaacgtctggcactgcaacggcatacttggcgtctgtcaaaacggcctcgtctgcaatgttagttggcaatcccgtcgttggtgccgtccagcctttaatcgtgtcatattggtagttcacgttcaaaggattatcagttgcaaccaacgtataaatcacggtgtcgccaccaactgatgtcacaaagtcaccggcctggacatccttgtcgttcaaggtaaccttttcaaccttatatcccgctggaacatccgttgccggaccattcgcactgaccgtgaagctagcatccgtcgccgtttggttgacgaacgttgtcttgctcatgcgatcaagggcaacttctggaccttggtacaacgtcgtttgcgtctgtgcttcaggcgtgtaaaccacggtgtacgttgccccgccagccaccatttgaataggtgccgtggggtcaatcgttgattgattatccttatcgcccgttgtcaccgtggcaacataacccgcaatcttagggacaaccactgtgtagttgtcacccgttgcgtaagataccttatcgatatcttgcgtcgcgttcgtacctgttgacttacctggcaataacgcaactgccgccgcatttggcgtcttattagcgaaaccgtagttaaccgtcaatggttggatggatgccttcaagttgtagaccactgtgttatcaccagcgatgacttgcaagttttgggcatcagcatcatcaactgatagttcctgaccattgattgtgattgttgccacttggtatccacgtggaatcaatgtcttcaatgggccatcagccgttatatcatacgttgaatccgtggcggcttgtaccgtatcggccgtcatttgggtcatttgcaccttggcattcttaggcaaggtgtatgacgtcttgatattttgcactgctggcgtgtaaatcacgtcgtagtatgcaccatcagccgtcatggccaaaccagccgccgcaatcgccttaaattgggttgctgtgtacgtgttcaaaacagttccgtcagcagccttcgccacaatttgggcggtgtaaccagcaactgttggtaccgctacattataggcgtcgtcggtcgcaaccgtgtcgttaacattagccgcaatcgttgtctttggggccgtccagtttgccacctttgctgtggtgtagctgtacgtcacttgcaatggctctggtgctgccgtcagtgtgtattcgatttggttcgcagtcgtgccaagctctgagacagccttcaccacttcatcaactgatgtaaaggctgcatccccctggtgcaacccactcgtggctgaatcagccgtcgcaacaacagtcttgttatacgtgatttggctgacgtagtaaccagcggggatggtagccccaccagttgtatcaaccgtgtacgtcgcgttcgtatcacgaaccgtcgtcgtcgtggctggcatcttatcagttgctgctgccgcattcttcgtatcagatacatagctcgttgtaatcttttgtggcactgccgtgaagaccacatcatagttcgtgcttggtagcacgccactagccacgtaggcatttccgttaaacgtcaatgcacccgcgtctgaacgtgagaagcctgcaatatcagctgcggtatccgtcaccgtataggcaccaccaccatcagctggcatatcagccgttacgtgaataaccgctggcgtacggtcactgtagtatgagttgccatcggcatcaactactggttcacccttattaatcaccttaccggctgaatccttgtaagtgtatgtgatggttgggtcaaccttgtattgataggttacgtagttcaccgctggctggaacttgtggatgattggtgtcgcctcggcatccacaaggttacgagccaccagtgttcctgcatcaatttgtgctttattttcacccgtattgtaagcttccgcatccttgttgtattgggcagcatcatactcatttgatgctgtccaaccaaggttaacccatgtctgctgaatattttgcagattccaagcttccaagtcagatttactcgttaatgtacccgccgcaatttcagcagcatgttctttgttatatgcttgattctttgcattttgtgcagtgcgatacgcatcatacacattattcgcataatcaacatatgcttgccaagtagctggcacggcgtctaacttgccatcaggtgttcccgacacgtattgaactgacttatccttgtccaaaatagggtttccatccgcgtcgaccaaaatcgtacccgcgtcaaagtcaaacgttagggcgctagacgtccaagtgccattggcattttgcaagacatagcctttaatctgcttatccaactgtgtcactggtgctgtcttatcgacgttaccagccgttgtaatgccgtaccatcctttgtcagtaaccgcattacccatggcacccgtcgtcaccgcattaccagacacaaagactgggtttcctgacgcgtccgtaacacgctcacccttgctgttaacaaggacgtagttagctgtgaccgtcatcgtctttggcgtatacgtgatacgaaggtgaggctttggaataagcttaccagttactggatccttaaatgtatccaggttatccaaagcttcccatgtattattttcataattcgccttcaacccgaaaccgttaacttgcggaccataaggaccattcaagtttccttggtcggcaccggccgtgatgtaggctggcaatggtagcgttggtgagtcatatgaatagaatccaccggcaaaaccagtttcacgaaccagcacaccgtgtgggttatctgccccaggatccaatacatagtagacgatgtcgaatgtgtattgctcaggcttatacgtcacgtaaaccgtgcgaccagctgctggatcatcagcatctgagaacgtgtacgtcattgacgttgtcccctccgccgtctcaccatttggataagtcgttaccataccacgattttcaatcgcctcatctggcacaccatctgagaacgagactgattggaatgtgtaaccttgcttcaacataccttcattcgctgtatcaaccgtgtacttgtcaccgtaaacaccagttgctgaggtacttaccatgcccgcgccgactgttggcgtcacaatcttataaaccggctgccccgctgcatcaagcagtggaatggcattaccggcaccatcagtcgtcatttgttggacacgatagacaaccgtcaccttcgttgcattagccgtgtacaccaagttaacctcttgtggtgtcccatcaaccgttgccgtgccgttgttcgtcttatcgaatgtcgttgtgttcgtcgtttcgtcagttacgagggtataacccttaaccactttgtcgacagatttgtaatcaactgtatcgcccgtcaacccattgattggaatgacatccttaccaggcatcttcgtcaatgaaccatctgtgttttgcaccatgtagttcacgtgaaccgtttgagcgtccttggcatagacaattgtaaacacttgtggctctgcatcagcaccattcacgttatcagaatcatcgaatgtggcagttgctggtaaatcagtcacaatgtgatagccaggtattgccttcaaggctgccgtaatcgctgaaaagtctacagtgccggccgtcacaccatctggcaaattaacattgttcttcaatgccttgccatctggtccaacaaacgcaactgatgctgactgcacgtttgctttgtagaccaagttaactgtttgacgctgtatatcaataacattaccgtttgcatcggttgttaacttaacagtaccgtcagtgttgtacacaacattgttattgctatctgtcaccggcgtcacaccaaccgtatcgaacgttgtcgtggcatcacgaccgtcggaaacaagctgatatcccttaattgcatttgcaacctttgttgaattcgtataggcaatcttagtatttgattttccagtttcagtaacagccgcatgaatgaccttacctgattgatccaagaagttaacatctacactttggataccatcttttaggtagtagtaaaccgcatagactggtgccgttgaactaatagcttgttgcaccgttgatgccgtatttaagtcagttccagcaacattttcaggcaacgtagtgtacgagaatacccatgggcccgcgtcactggtgtagttgtaaccttcagcagtagcaattggatacgataagtcgtttgaatcacgaataccagcaatataaccatccgcataaagttcccaacccacttctgttcgcgtcaaagtagtcccttttgaaactaccttaccagttactggatcggtgccatctgcattcaaagttacatagaaattggtaattgacgcgttgttaggcgttgacacaatcttcactgacccatccgcattttttactaccccagtaccatatgactgtgaaattgacgtaccatcccccaaagggatttgtacttgtgcagcccccgtagcttgaccatagacaccaacttgagcgatttttaccgtccgaccgtcttttgtcgtaccagaaaaaatactctgcacaacacctgacacagtcatcttagatgcccaagggttaattccaccggccagtgactgcacaaagaccaacttttgagaatcagttccttggatgaaatcacccatgtttttaataactgtcgagtagttcttacttgatcccattccaaccgggatcacaatgccactcgcatccttgtaaccttgttgcaccccaataaacttaccattcgcatcaaatgcactggtgtcattagtcgtcaaaacagcaaacgtataactaatcgttttaccggtgtagtacaacgttaccttttggttaacggcatcatcagcatcgaaagcagcagcttgatcaactggcttaggattgttttgtgcatcgtagacatacatcttcataccagctggtaacgttgctgtcgtcaggtactttgcaatctgtgtatagtcaatcgtctgacctgtcgtccccgtcaaagtaatcgacatttgatcagactctggcatggcgtactggctaactaacttggcaggattagtaatgtcatactggttaaccatgaagttaaccacaaccttctgcaaattagccttataattcatcacaatcgcattatctgcactaacagcactcaacttatccaacgctgccaaggctgctgctgaagaagtatacgtttgaccattaacaacaacactttgtagcgtatatcccttaggcacataactcacgacagccttgtaatcatcaatcgtcttataactttcgtcagtcacaccgtcgacttcagtgattgccgtaccgtctgcgcgagaagctgccttaacagttgtcccgttatcggtcttataggtcacttttgccacttgcgcatcggctgtaaaccagtacgtaatcgtgttgtcacccatcagcgcagtgtatgaaccgtctgctagtttgttaacacctaacaaatctgaatcatccgtgaccaacgtataacctgctggcgccgttggatccgtaatcgtcaccgcagcgtcagtcgtcaaattcgtgttcacgaccgtcttaagacctggtactgccgcagcaccagtcttttgaccagcttcaccttcaaggtagtaatgcgtcgtcaacgtcgctgggtttgccttatacgtaatgatatgcacttgttgatcaccgtcgacatcagatgcatatgtcttaccatctgggctgctcaacggtgcaattggcgtcccaccaactgggttgttcgtggcgtcggctgtttccgctgcaatttcagtggctgccttaccatcaaccagcatggtgtatcctggaatctcatagcccgtcaacttgaagaccgggaaagtttcacccgtcttaccagtttgcgtgacaaccggctttgtaatatcagtcttgcccactgcctttggatacgtcaccaaaatcgcttgttcttgcgcatcttgggcataacggatgttaatcacttgatcaaccgtatcgtcatcatcaaagtagtttgcatcggtatcaatcttcgtccaaccaggaatctcattttcaacctgaattggtgagttagatggtcccgtcacttgtcgtgaagcttgtcctggaatttgcttgccatcttcatccacaaaattaaccgtggccttttgcgtggttgctaagaagtagtatgaaatcgaattcgtaccggccttcaccgtgtactgtccgttcgcaccacctgctagacctgacaaatctgtatcagccttttgcaacacatatcccttaaacattggatccgtcaacgtaatcacgtcgtcggtgtgcaaattagccaacttatcagcagttaatgctggcacatcgggtgtcatcaatgcaccattacgcgttgacatttgatatgaattatccttgttatccgtatccaaaaggtagtaaatcacttgcaaggttgcttcatcagcgacgtagccaaccgtaattgtgttcgtaccatcaacaaacttaccagtgcccaagtcaattcctaaccgggtataacctggaatcgccttgttcgtgactgcgctcgtgtacaaaccatttgaggcatagtccgcccctgtcgttcccgacaaactaactggtgtcgtacctgggacagcggtcttcgtgtaagtcaccttgccgtccgcatcaaccgttgccaaaacataacgcactgttgctgattggttcgccgcaataaagtgcaccgtaaccgtctgatccaatgtcgtatccgcatcaaacgttgtggcagcatctgtgctgtcatacgtatagccagctggcgccgtcttcattgccgccgttaccaagtttgccaatggtgaatttgacgtaccagtcaacgttgtgggcaaatcagctgacatccccacaactgggtcgccattctgatctacgtaacgcacattagccacttgcgcagcagcttggtaagtcaccgtaatcaccgtactgtcgtttgaaccaaatacaccactattggcaaccgttaccgcttgcggtgtccagattgtttgaccagctccgtcagtcttaccactatcaaccttaccagcgacctgcgccgtatcggtgatgacaggattactgtaaccaggtacagctggtgttaacttagtcgtgtcataagcttcgccagttacgccagttaatgaatttggcgttccagctggcacagccactggtgcaccagtttggtcaacatacttaatgactgctttttgggtctgtgcaacataaatcacaaagacattgttctggcgtgaatcagctgacaaaatcttcgttgaagctgtgttttcttccaacgtatagtccgtcttagcatcgtccaaaggcgtatccgtttgcacgtccatgggattatttgacgtcacattcccagtttcaacccgcacaaactcataaccagatacttctggatacaattgcgctgatgttgctgggtcagttggcatctttgtattggcatatcccttatagataaaggtattagccgttccactaccaagtggtgcaaattgcgtgtacttaccatcgcgcaacgcgaagtagtaaattgtggcaataactggttgttgcgtgaagttaattgtcaccacgtcatcgacatcagcattcattacagcggtcgttgatgtagccgccttgccattaacaaccggcgccttaccatcccacgagtaaccacccgttagattttctaacttggtcaaatcaaccttgtcatccgtaacacctgtcaattcgatgtatggtgcacccttcgcatcatatttaatttcatgaccattaatgttgagcagcccaattagtttggtatcaacaggctttaccaacccggtattcggatccgtgtatgtgtagtaaaccttgatactatctggcaacgctgtataggcatacgtgtaattaatcacgtcacccgcattaccagctggcgtcatgatatcagtgtaatttttgacaacattaccagctgcatccgtgaccactagcttataaccaggtacttcgattgcagctggcaagctatacttgcggtcagttgcggtctcaatcgtcttagtttctgatgcaatctgtgttgcatatgaagcaggcaatcctgtgaccgttgttttaacagtctgcttattggccgtgatataaatccaaattgtttggtcagtcgcatcgttcgaatcaaacgtgccgttcaaataaccagcgttaattgagtaacccgcttttgcccagatcaagtcactatacccatcggcagttgaataagcctctgtagcccaacccgaaagcttctgtgttggcaaagcgtctgcaacgtcgttcaccatgtagtgtaccgttgccgtctgacgtgtcgcatagaccaatgtcatgacattagcctttgaccctgaaaccgtcacgtcgttcgctgaaattaacttatactttgtgctatcaattgcgctgcttgatggcgcctggtaggcgtaatcatcaatttggtagtttggtgatacataagcaataccgattttgtcaccaacgttcgccttcatactcgtatcaggtaatagcgtcttccctgatgcatcttggtacttaaccgtcactgagtttggcaccaaggttcctgagaagtgcatgtctttaccagtaagcgggttccgttgggtaacatcaatcgacgcttccattacggctccgttaccacctgtaacacccaacaaaccaagtgacaaaacgccctttttcaacaattcttgcggcaatgtataagtccaagtcaaatattggcttttatcattagggtttgttgatcctggcttaggcattgatgcggtcaaaacgtgtgaggttgcatcatagctcaagaaataaggcattccagttgttagaataccagcgggtacagaattttgcgtcgttgatgagtaactagttcccttactcgtgttttgcgtgtactgtaccccacccgttccgtttgtcaaattaccatcggcgtcagttgtacggaaaccagcaactgggtaaccgttcttttggtacgtttcgtttgtgttcgttccgaaggtttggtcacccttgtttgagttatagaaaaaatcgataccaaaggcgatggcatccggtaaaccaccgattcccaagtcaccgttcgtcccaccaatcgtacccgggtcggttggtgacaagaagagtcccaaaaagtctcccgatggataagttgatccaccttggaaggcattttgcttaccattcacggttggcaatttagccacacgtgagtccgagtgatttgacataaagaacttaccagtaatggtaaagtttcctgacaaatccaattggtacttatacgtcacgtttccagcaaccggcttaacggctgcttgcttcgtaccatcggcactcgtcacaccagtcaagttgtagtattgcgtgtcgccatcgaccgtcgttgttgacgtcaaagaactcgcatcgccgcttggcaccgccgctgtgtttttaggcgtatcagttggatcagagtcagcgctcgccgtccagctggtcaacccagttccttctttaatcgttgaagtcgtcgtcttcgaaacggttccaccagtcacgaaagcgttgtaaatttggtcatcgttgtgcgccaaaatgagggcatcacgaaccttacctgcgtcaacttccgcgtcagtaacggtgttaaccgcactggtcataattgggtccacaacaaaacggaagtcgtcgtataaccccgtttggtgaagggcagcgaccactttagcaaattgatttgttggtgcactcacaatcaaatcaccataagctgacaacttagccgtggcgttaaaccgtgaaacatcaagattgacatacgcggattgcgcccgcgccaaaacatcatcctgcacaccacgcttgtcggctgcagccatttgaatggcttgttgcagttcaaaagtcatgttgttcacgacgttatacaccgtcatcatcaagacatcggcatttttaacttgcatgtgcgtggcttggtattgcgctgatgtcaaagattgtgcgaccccattcgcttcttcgacaatgtgatcgaccaatgcttccatcgctgtgttacgaacgactttatcagtttttgaagccgcaatcgctgctgagtctgcggcagcgacgctatgcattgcagccacaattgacgtcacggctgttgcagctgacttggctgaatcaactgaataagagacgcctgacattgtgtgacttgctgatgacgaaacagctgctgccgttgacttcttactagtagcagaggcactactcgtcgtgactttagcaggttgcttagcgctagaagaggcgacactctttttcacacttgttgatgcacttgaagaagcgttacttgaaaccatcacactagctgaggttgtaacacttgatgctgatgaagcaaccgcactaacagacgcacttaaaacagttgctgctacatcactagcatcaacttgtgcagaatttgatagttgatcactaaccgttgacacctcagttgctgttgacaagacaaccgtgctgtccgagttaggtgcgttggcttgttctgccgaatcagtcgtttgtgactgatcaatatctttgtcatcggcatgggcgctaccaccgcccaaaaaagccccaatcaaagacaaagtcgccatgctggcaaacacccactttttaccatctttgtacatcttgtatcgcaatttgcgatcaaacatgtccttttgcaggttcattttcatattaagttccccaattctcttatgactctctttttcataatcgatagtggcctatattccatctagttagaaataattataaatgacatgtcggacgaatagttacttttggttagcttttttgttgcacaatcgggacatttgtacagaatttcacatttttcacaaagtccaccaaaaaacgctctgacaacaaatcagagcgttagtttcatattcatcaatttgtatattattgcatttccgactcgttttgctttatccacttatccacaagggacaggtcgtagccttttcgaaacatcgcggcttttactcgtttcttaaattcccagccctcatactggcggtagcgattggcagctgacgaggcatcccggtctaggttctcccactcctggtccacgtcggtttcattctcagcttcataacgcttcagtgccgccacaaccagtttactatcataacccagctgggccagtttttgtttcgttttctgttccgccataaagtgcgcctgtcgagcatacttctgcatgagcttttcgaccttttcatcaagttgggcgacttggtcttcttcgtcatattcaaccaaagcatcttcaattagatacttatcgaccccaagttgttgtagcttcgtccggacaccacgtggtcccaacttgcccgagtgaatcgcactgcgaacatactcttcagcaaagcgcgcatcatcaatcacgttcgctgcctctagccggtcaatcacatgcgcaatcacgatgcctggaaactcgttttcctttagcttgataatgacttgcatttttgaacgcattcgaccggtcgcatagactagcgccttcgtataggctttttgctcaaactccgcatcttcaattttcttgaggtcttcatcagacagttcagtatctttaaacaagttatatttgatcaggattttttcatcaaccgccaacgcaaattcatcatccaaatagacgttatagcggcctggtttccgttgccgggtgaccttcgtgacttttttcatgccttcctcctgttaaactaagttttgccaacattaagtttaacctaaaaatacaaaaagagccaatgcacaaagcatcggctcttttgatttatcacttaaataaatgatgacattcctgggttcaattcaacaatcttacccgtgcgcttgtagataatccactccgcaatgtcagtcacgtagtctgatgtacgcttcaagtaaccagcaacaaccaagtaatccgttgaagcagtcaccaattctgggtctgacttcatggcttcaatcgccatttcacgaatctcaccagtgacatctgataccgacgttgccacttcagcaatcgcttcagcagataccgcatcgtcattcacgtagtaatccaacacatctgacaccatcttggcaactgttgaaccggtcataccgaccttttcttcaattgccgccacacgcttgttacccttcacgtgaattgttgaaagggcaatgttacgtgcgttgtcaccaattcgctccaaaactgaaacagccttcaagaccgtcacgatttcacgcaaatcagtcgtcactggttggtacaaggcgatcatttcgaaagtcttcttttccaatgcgatttcgcgttggttgattgccttgtcaccatcgataatttcttgcgccgtggcacggtcgtggtccaagaaagcttgtaccgcgcgacccaacgtctcagaaaccagcagccccatttccttaaaagacgtatccaaatcagctagttcttcatcaaaatattgacgcatctgataattccccgtttctgttaattgtttgtttagtatagcacagactatccgaagcgacctgagatgtaatcttgagtctccttcttgtctggatccaagaacattttcttcgtatcattcgcttcaatcaagtcaccgttcataaagaaggccgttcgatcagaaatacgtgatgcttgcgccattgagtgcgttacgataatcattgttaacttatcacgcaattgcatcaacgtgttttcaactgcgtgggctgacactgggtccagcgcagccgttggttcatctagcaacaagatttctggtgatgtggccaaagcacgtgcgattgacacacgttgttgttgtccacctgacaacgacaaagctgacttgtgtaagtcatccttcacttcgttccagatagctgcttgcttcaatgatgtctccaccatctcatccaaaactgccttatttttctcacctgaaatgcgcatcccaaatgccacgttgtcatagattgagaatgggaatgggttcggttgctggaacaccataccaatatccttacgtagctcaaccgtgtcggtagatggtgcatagatatcttgccccttgaacaggaatgtgccgttcaccgtcacgttgtctgtcaaatcgtgcatacggttcaaagcacgtaggtacgttgacttacctgaaccagatggcccaatcaacgctgtaatgccgaacttatcatagtctaaattgatgccgtgcaacgcttctttttcaccgtagtagagacgcacgttttcagttgtcaaaattttttctgccatttgataatgcctctcttaaccaaagtttccgttcacgtaatcaatcgtcaattgtacctttggacgcgtgaaaatcttacgtgtcaaatcgtattcaaccaacttaccgctattaaagaacgctgtgtagtcagaaatacgcgctgcttgttgcatattgtgcgtcacgataataatcgtgtacttttccttcaattgcatcaatgtatcttcaatcttcgctgatgaaatcggatccaatgcagatgatggttcgtccatcaacaaaatatcagggttcatggcaatcgcccgggcgatgaccaagcgttgttgttgtccacctgacaatgacaaggccgacttacccaagtcatccttcacttcatcccacaaagcagcttggcgcaatgacgtttcaacaatttcgtccaattgttgcttgtcacgcatgccgtgttgcttcaacgcgaatgtgatgttatctgagattgactttgcgaatggatttggtcgttggaaaaccatgccgatgtgcttacgcatctcgtaaacatcgatatcctgtgagttgatatccaagccacggtacatgatgtttccattaaccgttgccactgagtcgttcatgcggttcaacgaacgcaggaatgttgacttacctgaaccagacgccccaatcaatgaggtaatcttgtagcgttcaaacttcaaatcggcatcttgcaaggccaacttgtcgccgtagaacacttgcaagtcctttgttgacaaggcaacctcgtgcttcgtttcgtccatatcatagacgtagcactctggttgttcttcgtcaaaaattaaatgttgctcttcagccatgacaaatgtcctctttcttacttcgttgccgtcaaacgcttgaacaaaactccactcaagtaacgagcaaagaagttgaacaacaagacagcgatgatcaaaacagcagatgatccagcggatacggcagccgcatcaggcatgataccttctgaattaaccttccaaatgtgcaccgccaacgtttcggcaggacgcataatgttcaatggagatgaaacgttaaatgggttccagtccgtaaaatccagagctggtgctgattgtccagctgtataaatcaatgcggcagcttcaccgaacacacgacctgctgacaaaaccacaccagtcacgattgatggcaaggctgctggcaaaataatgtgcccaaccgtctcccaacgagacaagccgagggctgcaccagcttcacgttgcaagtcaggaatcgttcgcaatgactcttcaacagaacgcgttagcaatggtaggttaaagaacgttagtgaaatcgcacctgacaaaattgagaagccaagtttgaattggacaacgaacaacaagaacccaaacaacccaaccaccacagaaggtagtgatgacaaaatttcaatggccgtgcgaatcaaagcagttgcacgactcttcttgttagcatactcattcaagtaaattccagcgcccaacgcgattgggaatgaaatcaacatcgtgataaccaacaagtatagcgaattaaatagttggataccgataccaccaccggcagtaaaggctgtcgcaggcgccgtcaaaaagtgccatgacaaatgtggtacaccttggtacaaaatataaccaagtagtgctgccaaaatcaaaattacaaagcctgcaatcgcataaagaatggcgcttgcaatcttatcggcttgctttggattcaacatcttacatggctcccttcttagcaattgcacggataactgaattgaagaccaatgacatcaacaacaagatcaatgccaagctccacaacgcattattttcgagtgatcccataaccgtgtttccaataccctgtgtcaagactgacgtcaatgtggcggctggtgatgtcaagttctgtggcatcaacgccgcattaccaacaaccatttgaaccgccaaggcttcgccaaaggcgcgggccataccaaagaccacggccgtcaaaattccaggcgttgctgcgcgcaagatgaccttgtaaatcatttgccagcgggttgcacccaaggccaatgatgactcgcggtagtgacgcggtactgacttcaatgtatcaaccgtcattgatgtaaccgttggcaaaatcatgacgaacaataccatggcaccagccaaaattccgaacccagaaccgccaaacaaatgacgcatcacgggtacgatgactgacaaaccaataaatccataaacaacggatggaataccaaccaacaattctgttacgggtcccaaaatctttgcaccacgcttaggtgagatttcagtcataaagacagctgttccgatggcaaatggtgtggcaatcaaagccgaaatcaaagttaccaaaaatgaacccacaatcattggtgcagcaccaacgaatgggtgtccattcgcatccttttgaccaggtgcccacttagtgcctgttagaaaatcccataggttaactttatttgcaaagaacgttgccaaaccttttgatgcaacgaaccagaaaattgataacacaaccacaacaatcaatagcaaagctgctagtgaaatataacgtccaaagcgatccttgcgggttgcggctgattgtttcaatagtgattcacggatgttatccatgtgcccacactccttaattttcagatgtaatctttccgttcacgtcacgtgaaatttccatatcgtgaatggcaatgtagcccaattgtgggactagtgtcgtttgaatgtgctttgaatcgatgaaatccaagaacgcttggacatccttagttggcttgccctttgtgtagacgtgctcgtatgaccagattggccacttgccgtccttcacgttgtcgtcatcggccttcacaccattcaaggttggcactgagactgtcttgtccaagtaggcgaatgccgcgtatgaaacggcccccggcgtcgtcgagacaatcgaacgcaccattcctgatgaatcttgttcttgcgcgtccgctgactcagcccttttcaagccccacttttcaaatgttgcacgggttcctgaacctgagacacgatttaccaacacgattggcaaatcagccccaccaacttgtttccaatttgtgaccttcttcgtgaaaatcgcaattaattggtcttgcgttaagtttttgatattggcttgcttgttaagcatcggcgcgattccaacgaccgccaccttgtggtcaaccaactgattggctttaataccgtctttttcttcggcaaacatatctgagttacccaagtcgacggcaccttgctgaacctgcgccaaaccggtacctgttccaccaccttgcacgttaacaaacacgcccatgttcttcgcagcgtaatcttctccagctgcttcaactagcggttgcaacgcggttgaaccaacggcggtgatattcacgctaccgtttttctctcgcgttgtgtatcccaaagctaataggccgcctacaaccacgacgattgcggcacttatcaaccaactgcgcttcataatgaacgcctcctaatattcttctgctactgtagactattatctctaacttttgtaaatgtcacactgcagttttgtaaaggtttttgttacatatcgtatatagttattattctactctactgttaactggatttcgcggtttcgactactatttttggtatttttgtcgtgcttgcgcacgaggcgtggtgggtggggtgtgcctccgacaaagattggccggggtgaactccgccggcgcgagcaccggctagtgcccaaataattgggcgaagggtcaaggtccgttcgccttagctaaccggcggtcggccgaacttgtgagttcaccccggccaatcgctacgtcacaccccacccaccacgccggcagccgagatattctctgttggtttggtaagcatagatacaccaaaagccaggcgcgttttttgcacctggcttttatttatcgcgtgacgattgttgttaggcgctgtcttggacacttgatacattcactgccggtttggacgcagagtggtgcgtctgggcggatgcggagtcgcgtgttatcagccaaacaccggatgtttaaatgctcgttttgcagggtccaggcaattgtaccgactgctggtagtttcggttggcacgttaagcagagttcattattaatgacgcagccacccgttaaccaacttaagaagccagttagacgttcttctaaatctgtttcgttagttaaattatgcaaacttcctgttaagtctgttgctggttgtaacaacaactcataaagtttttgttcccctaattgcaaccgggtgcggtacagcgcccagcgaatgtttcgttgccaattatgatccgcactaatttgcacatctgtgcgtgcccaaaaggtttgccagcgagcgcgcttttgaagcgcaacttgttcaaacgatagccctgttcgcccatctaggtagtaactaattttcagtgggcgttctggcgttacttgttgcgaaacgaccaatcgtccatgcgctcgtgacaagcgtcccgtcgtcacaatgtcgtcgattaacgccaatggtagcgtcacaacaacgtgatggttaccagcaatcgtcagacgtttcgcgacatcactattatcttcaaactcgcggactgtgctaatttgtacatccaaataatcgcgatgccgcatttcgtaggcaaaatttgttagctgacatccccaccgcatatcctcgaccgtcaaccacggattattatcctgtggcacaatcggcaaccgttccccatcaatcatcaacgaccaatctggtaaaacgttcggcgcaacggctggtgcaattgcattactagtccgcctggtccacagcacggtctcatggagttgtccattatctagaccgcgcaccgcgatatttaaattacaacggacaatccaagcgtgtacccaaatctccgtgacgattttccaccgcattggacacgtttgttgcaggccatcgtttaccaaattaatccgatcgacacctgtgatttcttgcagcgtcgccgtcaccgcatggtacatccccaacacgctttgattgtcccagcccaatttttcgtggcgcccaatcagcacttcatcggccgtgaaccgaactgtcatacttttcattactcaatcacccaaatttacgcttcccaattaaaattcccatacaaaaaatcccccacaaccgcaaattatacggaagtggaggattttgtctaggcaaggtgttaactgttaacacctgcaatagttaactacttatcaccattaatgcgggcttggaattccttttcgctttccttttgacgacgccagaacgctgccaaaagtccaaacataccagcaaccatcaagctagcaatgataataccaatgtagttctctgatgcattttcagtcatgttgattgacgccttgttaaccttagcatcatctaacatatcgtgaatacgatcagcatcagtctttggtgtgttggtagttgttgcaacaacttgcttgtcagcctttgcaacacttgcaccgttcttcaacgcaacaactgtcttattaccacgcgttgctgcttgcttagcagtcgttgttgtcgcaacagcttgtaccggctttgccataacagctcccttagcgaccgatgtcttgtttgccttcacaacagtagcagccgcacgagactcgtgacgttcagccattgctaccccaggttccttaggagtagctacgttcgtgttcacaattgactcaccttggcgaccgtcaatgacaccaccttggttcattgcattcaactctgccaaacggttttgcaccgccgtcaaagccgtacgcaacgctgaaacagttgtatcagctcggttagccatgccctgcaagtccgttaccatttggatcaaatcacccgcattgttttgcaagttcgcaggtaccttaatggcgttggcttggtcaattaccgtacgcaacgttgcttgcgcatccgcgactgcttggtcataagcttgcttagccttagcgacatcaccaggcacatacgtcttagcattcaatgcgtcatcaaccgcacgcttagctgcaatcaccgccgcatcatctgacacattcgttggtacaacggttgcatctgctgtttgcaacttagcaactgcttcatcaatcactgacttcgtaccagtttcctcagctgccttaacggctgcaatgcggttcttaacatcatcatttgtgccattctttactgttgcaacggcgccatcggccgtcttaactgaagcttggcgcacatcatcaaccttcttgatatcatcttgcaattgcttacgcgcttgctcaatatcagtcttggttgctgtcgtgttgtcagctgacgtcaagtcatgcaacttcttcaaatcattttgaatagctgacgtattttgatcagcatacttcggtgaaaccgtttgccaattcttgccatcagcatcggcacttgccttcgtatcggccaaagcttgctttgcttgtgcaaccgccgttgccaagttgctaatcgcttgctttagctttcccgtatcaacattatcgccattcaaaatatcattaattacttgcttggccttttgcacatcgcctgaatcagcaacgttaatggcaactgattgatttacagccgtcttaaccttgttaatcgcgttggccacaccagactttgcaccgttctccaacatgttgtgcaagttattaaccgtgttatcaacgtcgttatctgacatttccttgttcgacgtgttgttgtagtagtggttaccatcaactgaaacagccgtatcgtcgattgctggcgtatatgacaccacaaagtcctggatgttcatatcgttcaatgacgctgcttcagcaaggaccgcataatatccggtcacattgccttgatcatcaaggattggcatcatttgcgcattctcagcatcgaagcttgaggcaccgttctgcaatccaacgtggtcgaagtaaccagttgctgccaacgcagctgacaatgaatcatacgtcgtaccatctggggccgtcaccgtaatcttcaagttatccttcttagcggtttgctttagcacggcatcgattggcgcaaagtcatttacgttaatttcagcgtcagacttaccagttaccgtaccaagtaccttaccggatacgtccttaacttgaatcttttgaccatccaatggggcataaatgaccttcatttgcgtcgtaccagctgcaaaggttgggttcgccttcacggcatcttcaagtgaggcatattccttaccatctggggcaacaactcggtgcgcgtatccatcaatgtccaagttttcatcaaccttgttcatttcagtcaaagcgttcgtcacgttcacttttgtgtccgtgtaaccggttgagacaattgctgccgcagccttttcgtcttgttgcaacttagccaaagcatccgcaaccgtcgtcaacttttgcgcattcttgttaccagcagctggggcttcaccttgcttaaagccagattccgttcccaacttcaccacaaccttggcaggatctggcgtgtacgttaccaagtaattcgtaccggctggcacaccttcaacgttaatcgttgaaccgtccgccatctgcacaacattaccattcgcatccgttaccgtcgctgtgtaaccggtcttaactggcacatcaatgttcttagcacctgcttgaactgaaatatcagccgttggcaagtagatgactgaaacgtcactgcctgctggcacatcaatcgttgaccccgtagacgtttccgtcttcgacccatccggcgtaatcgtcgtcttggcaccatctggcgtcaattcagtgtattgggctgttccagaaccatccgtcacaaagataaatggcttatcaccgtgcttaggcaccgtcacaacttgggcgttcttagcacctgaaacattggctgaagccttaccatcagctgtgtccaattgcacaaccttttgcttaccattcgcatccgtcacaatcacaaaggcaccatcaccatttgcaaccggtacagacacttgaccatttgtcacaggcacttcttgcttctcaactggcttgttgttagctggggctgacgtggccttcaaaacgttcatcgcattttgaatatccgtcatcgtggcatcgtcgcttgccaacagtgtcgacaactgcttacgggccttaacaacgttatcgtcagttgcattcgcaaattgatcaaccagcttggcaccatcggcttgcatatcatgcaacttcttcgtcatgtcagccaagcggttctgcatgtcagtcaagttggcctgaagtgcagatgccgtcgtatcagcttgcgttgccaagttttgcaagtcgctcacttgttgtgtcaaatcacccaacttgttcttcttgtccatggcaacttgatcttgcaagttggctggtaccttgatagctgccacagcgtcggtcacctgctttaaggcatccttcgccgttgcaacagccttcttgtaatctgcgaccttttgtgctgccgtcgctgggtcgtatgacgttgcattcaaagcatcatcaactgcttgcttagcagtcgtcacaccgtcaacatcagcaacgttagctggtacaacggtgtcattggcgttttgcaactttgaaacagcttcatcgatagcagctgttcccttagctgactcagcatccttcaccgcttggatgcgattcttcacgtcttggttggcggcgttaccaccgttattcacagtcgcaacgaccttatcagccgcattaataaccgtttgacgtgcttgcgtaaccgtcttgatatctgattccaattgcttgcgtgcatcatcaatggccgtctgtgttgtctcatcagatgacgtcaactcttgcaagcgcttgatatcagcatcgaccgttgtcgtatcttgatcaacatacttggcaacattcgcgtcgtcagaccaagtcgttactaccttgttaccagcattcttagcatccgtgacattctttgtcatcgccgtaatgtcatcagtaaccttctgttgggccttcttgatatcagccaacgtcttagaatcgtcagcggctgccgtctgcaatgccgccttatcatccttcaacgttgcaccagctgcatctgcttggtcagtgatgttcgttggcacatccgccgttgcaataccatttgcctcagtaaccgcttcttcacggttcttctgcaatggcttcaagataccatcaacgatatcttgttgtgccttgatgtctgaggccttcgttgtgccgtcattcttagggtcagtcaagttcttcaagttagcaacagctgttgccaacttgtcttggtcggctggtgacaacttcttgatttgatcatctaagtttgctggctcagcaacagttgccttgcccttggccgttgccaacgcatccttagcaccagacacagccttgtccaaatcaccaagcgccttgttcaacgtatctgtattcaagtccgttgcgttcaaggcgtcgttcacagcctgcttggcagtattaacggcatccgaatcggaaacattcgtggcgaccatcgtatcaacagccgtttgaaccttcttgattgcttcttcaatcttcatctgggtaccgtcagcaatcgcttgcttcaagccgtcaaccgtcaacttaacttcgtcatcaagattaacgtttggttgggccttgtcgatttccttatttccgtcgtcaactgcagcttggcgcttttgctcaacaatcgcaatatcatccgccaacttttgacgagcatcagtaatggccttttgcgttgcggctgtgttatcagctgctgtcaaatcgttcaatgccgcaatgtcgtcttcaatggcctttgtatcttgatcagtatacttggcaacattcttagggtccgtccaggtagcaacatcttgcttaccagcagtctttgcttctgtgaccttcttggtcatgtccgcaatgtcgtcttcaaccttttgttgcgccttttggatgtcatctaacgttgacttgtcatcagctgcaaccttctgcaagttatccttgtcagcttgcaacgttgacttatcagcttggtcagcaatgttggttggaaccgtagccgtcacagttgtattagccgtgtcgatagcgttttgacgggtttcttgcaaggccttcaaaataccgttaacgatatcttgttgcgccttgatgtctgaaacctttgtcgtggcgttattcttaggatccgtcaggttcttcaagttagcaacagccgtcgccaacttatcttggtcatcctttggcaacttaccaatttggtcaagcaagtttgctggctcttcaacagtggcttgcttcttggcagcatctagcttgctttcggcttgcttgatcgcgtcatcgtaattattctttgccgtatcaaccttggcttgatcatatggatttgcgtccaatgcagcatcaaccgcctgcttggcaccagcaacatccttgtcatcagcaatattctttgccaccacagtttcgtcagccacttgtagctttgcaactgcttcgtcaattgccgtcttcgtgccagtttcctcggctgacttcacagcgtcgatgcgcgccttaacgtcatcatccgtcgcatgggttactgctgttacagctgcgtcagccgtacttacagaagcttgacgctttccctcggcaacttcaatgtcgtgttgcaacttctgacgggcaccatcaatatctgattgggtagccgtcttgttgtcagctgacgtcaaaccagtcaacgtcgcaatatcatccttgattgtttcatcttgatccgtgtacttggcaacattatcggcaacgttccacttgttgataacgctatttccggctgactttgcatcattaacgttgtccgtcatcgccttgatatcatcggcaaccttttgttgcgccttttgaatatcagccaatgttgacttatcatcggctgcaatcttctgcaaatcatccttgtcagcttgcagcgttgaattcttagcttgatcagtaatgttagcaggtacatcagccgttgccacggtcgttgcatcttgcacagctgtcttacgcgcctcttgcaatggtgccaaaataccgtcaacgatatcttgttgtgccttaatatctgaggccttcgttgtgccattgttcttaggatcagtcaaatccttcaagttagcaacagccgttgccaacttgtcttggtcggctggtgacaacttcttgatttgatcatctaagtttgctggttcttcgacagttgcgttggccttagccgtttgcaattccttatcagcttgcgcaacagcgccttgcaaatcagtcatcgcatcagcaattgccttgtcatccaattggctcttgttcaacaaatcaacaatcttttgctttgcagtcacaacggctggcacatcgttaatatcggaatcaacaattgtgttaactgccgtcttaaccttctctgccgccgtattaatttgtgccgccgtgccaccgttaatcgcagtcgttaactcaccaagtgaatctgatactaatttatcatttgcttggtccttagtaacgttgccggcaacctcattaccattcttaacagcatcgttacgaaccttttcaaccgcctgcttggccgtatcaagcgccgtctttacgcgagtgtaatcagcttgtgtggcatcagctggcagttccgccaaatcagtcaacgcctgcttaacagctgatgtatcttggtctgtgaacttatcagcttccttagcccaatcgttggcgacatccgtcacttgttgcttagccgttgtcacattgtcttgcatatcttgcaaagccttggttacagcagcttgtgcagcagctaagtctgacgccgttgcattgtcattctttaacgtattctccaatgccgtcttggcagtgtcatacgctgaacctgcaattgcttgatcagccacgttcgttggtgttgcggtatctgccacagcttgtgcagcattcttagccgtttgcaagttcttttgcatatctgccaaatcatgttgcaattggtccaatttaggttgcaactcagataccttcacgccgtccttagccgcagccgtcgtcaaatcagcaacttcgtcagtcagttgcttttgtgtatccgcgtccaacttgccgaattgatcctgcaaatttgcaggaatttcagcctttgccgcagcttgcttctttgccgccaaatcagcagtagcttgttgcgtcacttgcttcaacgcgctcgttgccttagcaacctcgtccatatcaaccgtgttgccttgtagcaaatcagcaatcttttgcttagccgtcacaacagctggcacatcgttaatgtccgcatcaatcattgtgtcgacagccgtcttcaccttatcaatcgccgtatcaatcgctgactttgtaccgccagcaattgcggtatgcaattcatcaagtgagtccgcaaccaatgcatccttcttttgttggtccgtcaatcctgtaaccacattattaccattagcaactgaaccattacgggcgtcagtcaccttcttgatgtcattttgcagttgcgtttgtgcgtcggtaatgtcgctagctgtttctttatcattcttcatcaccgaattcaagtgatcgatatcaccttgaatcgttgccaaagcatcagtctggtcagtataaagcttagaattgtcattccagtcagtcacgaccttattcgcatcagtcttagcctttgtaacaacatccgccatttcgcccaaatcagtcgctaccttttgctcagctgcttgaatgtccttcaacgtgctatcaacattattcatgatggtcgtcaaagcatcttgatccttttgcaattgcgtaatggcgtcagtttgatcagttgcgttgtcaggtaccgttgttgcagcaaccgtctttcccttaacgatttcagcatcacgcgcatccgttaacttcttcaactcatcagccactgcttgttgcgcagtggcaatgtcgtcagtcgttgaatcagcatcatcaacaactgcctgcaaatgttgcttagcttgattcaaagccgtttggtcctgatcgctaacattaaccggtgtcttcgcatttgcaacagctgatgcagctgaaccagcgctggcgacagcttgcttggcttgagtaatcttatccttcaacccttgcaatgcttggtcaattgcagccgtgttagtaggatccttcgtcaacaggtcagttaccttggcaatcgcatcaatcacgtcttgcacgttcatcacactcttaggcacatcaacttctgataccttggccaagttttttacacctgcatcaatgtccgttttcgtgtgtgaatcgtccttcgaatctgactcgcctgtcaaaactgacaaagctgacttggcgccatcaaccaaagcattattaatcgtgttcgaagcaaccgcctcatcagccttagaaatagcttccttacgattctgggtggcaatccccaccttgttttccaaatcaaccttatcattggcaatatcttcagccgtttgaccacttgcaatatcttcattgatcttgcccttagcagtcataacgtcattgtcatcagaaatgttcttgttgattgaaacagagttctttgtaatttccttcgccaaatcgatttggtttgatgcgtcagtagccaatgctgacacgtcattagcaccttgcataatcttttgcaaagcatcttgcacatcagcaaccgtcgtcaaatctactgaaccatcggcaattgtttgcaaggcagcaatcttatcaaccgcttgcttgcgaatatcttgcatcttcgtcaaaacagattgcacgtcgattgatgatggatccttatcaatcatcgcttgcaagtcagcgatagaatcgtcgatagcctgcaacgctgtcttagcattcgtcacttgatcagtaaagtcatcttggttaacaacatacttaattgccaagtcgcctgaaccagcagtagcgctcatcacgcttgatgggtcaatcttgaaaccgggcacgtcaggggcaacgtaggtaacgttcattcctgcatccgcgtttgtatctgttttcttgtccgtaacaatgattgtttcaccaacaacagcattaacctttgtgtcatcctgcaacttgctgttattcttgccaaacgtgtaactaacattcacattagtcgttgcgtttgttccttgaaagtatgaaataccaccaaagaatgattgaccattaccaccgttagatgcatacagtccaacagccatgtagcgttgcgctgtaacctttgttgatacttcactgagcagtttggtcattgccgaatccgaaaattcacgataagttaaagttcctgttacagtaccatcgtgattgtcaattgggttagcccaaacataatcaaaataaacaccgttatacagaattttttgaatagctgtcgttgtatccttgctaagagcccctgaccaacttgaaggagtagtttttagaacattcccttgggtaacaggataaccatcagaggcagtcccccaagcatagccatcttcaggcgtggtcactgccgtcgctgttccattgacattagtcgttccaattagatttccgtttgcatctgttttccggacgtgaaccaataatgaacttacatcgcccgcatttcgaacatacaagtcgcgccctgcaatcacagcattgtcaattccgtcaattccatcattggcattaaccttatcctgcgcatgagtaatttcaggtgttcccatttgaactggttgaacaggtgccattacaattccaattgcttgaccacctgtatacgctgtactcattgaacctgtagatccccaagaagatgaaggcaggatattccctttaccatcaatcggcaatacacgataaccacccttcagctggaagcccttaaggatatccagttgagacttataagacacacttccagcttcatttttcacttgtggaacaatggctttccaaaaaatgtcatcttttttagaatctgtcattaattggttgtcagccgcattattcgcaacgacaaccgccgaagaaacagatgcacttgcgtatgatgagtttgtgattgatcctgtgatatcacctgtctgcttgaaataatcagacacttgtgatgatcctttatatgaaaatgacgtgtggttttgtgcagaatccgtcttaatgtacgaagaagctgcaatcgtacccgacgttgaaacggctggtacagatgcggacttggcctttgttgaagacgtgtaagctgcattcattggtacagcggtcaccgctgaatctggtgccgctgtatctgcgtctggcgtcgttcccaacgcatacgccttttcgctctccgtatccttaaccgtcaccgcatcagctggcacaaccacgctacttgccaatgattgtgacacaactgaagaagcgtccgatgacactgcaacagacactgatgacgttgatgaaactgactcagtcacaactgagcttgctactgaagatgaaacaacgacgctacttacgactgatgattctgacgtagcagaaacttcagcgctcactgaagaagcaggtgctggcgttgcacttgcacttaacacaactgaattcgttgtggcgttattagttgtctcagctggtgcttggctgtcagctactggtgcaacagacgaatctaccccatccgctgatgcatccccagaaaccatcattaagccacccaacaatgacaacgtggccataccagcgactacccagcgctttccggccttgtacattttgtagtgagacttcacttcaaagttacctttgttcatattaaattgtcgcattattctcgaaccctctataaatatctcttactctttgtaaaaaacattttaagtccgaattgtgaacagagtatgaatttagggaatttcacttacaaaaaatacgataatatgtaccatgagcgcaacaaaaaacgccatcctagtttggatagcgttttcagcttaataagctgttaatgaacttaagatcaagtcgacaaatttatcgttatctagcgtggtcatcaacgtcgcattcgattgcttgcccgtcatatgatgttggtcaacaaccaagtggccacgtgtcaactgcccctgcgtttcaacgtccacatagtaatctaccccgctaaacattgtgggatcaatcaagtacgcaatcacttctgggtcgtttaacaccaccggtgccgtcccactgtaatcaccgtaatgggccatcaaatctgctgcgacttgtgcgactgggttatcaaccgctcgcatcttcgcaaccgtttcagccgtgatgactccttgttcagtcaaatcacgggtaatcatcacaactggtacaccgctgttcacaacaatttttgcggcttccggatcaattgaaaagttgtactccacacctgggtaacggttacctgtgttaattgccccgcccatcaacacgattttttcaatcttgtcgtgtaattctgggtgtgctgccagcaataacgcaacattcgttaccggaccactaatcgcaatcaccattggtgcatcagcttcacgcaacgtcttggccatcaattcaatccctgacagttctgatggcgcaaaccctggttctgggaagtctgccccgtccagacctgtaaactcacgccagttatcagccaagccaaacggttcaaccaatggtttagccgcgccatgtgcgaccggaatatccgtgcgtcccaatagcgtcaacgccttcatcgcattgcgttgcacattttcaactgtctgataagcaaccgtcgttgaaattgctttgatgtttaccttatccgtgttcgccaacgccaacatcaacccaaagaaatcttcatggcctggatcgcagtccaaaataatatctgtcatatcgtcatccccaaattagttaaagtattgcatgtgtggcccttcagccttgaagccagcgtccaaaatttccaactgtgtcaagatttgctcgtccgttacttccttctcagccccatgcaaaatgacgtcgacacagttttggtacatcaagccgtagttaccacgtggcgtctccatcttgtgttcaactggatcaccatacgcattgatatacgttaacttaccgtagttatctggattatcggccccaaaattagactctgatggtgaaataccagccaagatatcattttcttgtgcatccataccatacttaatgaatgagccattcgtaccatgcaaaatgtactttggatattggtcagccaccaagaaactcgtcttaatcttggcgcgcaacttgccgtagtgcaatgtcacatcaaagttatcgtcaaccccttctggattcgtgactgacttgatgtcgtacgccacagcttctggcttaccccagagcttaatgatttggtccaacgggtgcacaccataaccgtagaaggcaccgtcaatttgcgtgcctgggtttgaagctgcccccggacggaagtaatcaaagtgtgactcaaattcgattggttccccaataaagccgtgatccaacacatattgcagctccatgaattcaccatcgaagcgacgattttggaatggtgtaatcaacaatcccttctcgtttgccaattcaatcaatgccttcccctcggccactgacgtcacgaatggcttttcaaccatcacgttcttacccgcttccaacaaacgcttagcaagctcaaagtgagatggcgccggcgtgataactgacacaaattgaatttctgggtcattcacaaccgcatccaaatcatccgtaaattgaatgccgcgcgcaaccaacgcgtcctgatctgctggtcgtttgttcaatgatggcgtgtaaatcgtcttaatttccacattttcattttctaacaaatatggcaagtgataacgatttgcactgtttccgaagcctaccaaggccattactaatttatctgacatgtttattactccccgaatcaatgaatttgttcatttattaacaaggttaattgtaagcggttgcattaagataagcaatcaaattcacagaatgttcaaaaaaacggccaacccacatcactgtggactagccgtttcaaaatattttttaactaataagcctacttcttgtaagcccacttccagtcgaatggtgcaccagttgggtttgagacaacacccttaactgattgacggtacaacgttgcgtatgattggtagtaaagtggtgccacaccgacttccttttcaatcgtttgttcagccgtcttgtagtcgtcgtaacgcttgttctcatcgtttacatcagtcgtcttagcggccttttcagctgcatcgtagtcagcgtttgaccagctaccgttgttgaatgatgaatcagacgtgtacaagtccaagaatgttgatggatcaccgtagtcagctccccatgctgagattacaagctcaaacttcttgtcttgtgagaaggccaaacgttgcttaaatggcacttgcttgatatcaacgttcaatcctgacaagttctccaattgtgattgcaagaattgcgccgtgttcttagccttatccgtatcgtcagtcaacaattgcaagctaagcttcttcttgccaacttccttcaatccttcagcaaacaacttcttagcctttgacttgttgtagctaatggcacccttcacagcagctgattccgcaaagtccttacctgtgtttggatccttagccaagttcttggccgtcaacgtcgtggctggagttgcgttacccttcaacaccttgttagacaaagtcttacggtcaattgcgtatgacaaagcttgacgaatcttaacgttcttaagggctggtaccttcttctcattaaactccaagtagaacgttgaagccattggaataaccttgtagtccttacgcttttgtgaggcacgcacttggtctgatgacaagtaagccaaatcaagcttgttacccttgtacaagttgtaacccgtattttggtccttgatggtttgaatctcaaccttcggcgtcttcactgcgtcagcatcccagtagttcttgttcttaaccaatgagtacttgttgtttgaaccagtccagcccttcaatacaaacggacctgaagccaacgtgtacttggctgccgtaccatacttactaccaaccttatccacgaaggccttgctttgtgggtagaatggcgccatcgtcaaaactgactcaagttgtggcattggcttttcaagggtcacttcaagcgtttgatcatcaagcgcctttacgcccaagtcatccaagttcttatccttacctgattggattgcatccgcattcttaatacctgagaacaagtaggcatattgtgatgccgtcttaggatcattcgtacgttgccaaccatagacgaaatcttgcgccgtaattggatcaccattcgcccacttcaagcctgaacgcaacttaaacgtgtacgtcaaaccgtcatcagacttttgcacagactcagccaaggccaattcaggcttgttatccttaccgttacggtacaaaccatcacctgtggcttgcaacgcatcgaagtcaaccgatgctgttgcctttgatggatcagcagttcccaagtcagccgtttccatccagttaattgtcttatacgttgctgctcctgcagacaatggtgccaaggctgatcccaaaatcaatgccgttgacaacaaggctgaagtctttactaccttattcataattcgttccccgtttcacttgcacttatattatgttcattagaatactatgagaaatagtaagtgtcaacaacgttattctttaatttctcattttatccaatctaaaccccataaaatgcccgtataaaggcttttatcaaaatgagaaaccttttaatttgtcagaaaacctgacattggaagtctgaattacgcaaaaaaagtacggctgtgcaatcgcatcagccgtactttttaatctattatttgatttcccaatcgtccaatgaatcgacttcatgggttggctgtttgtcagccgcggcaacttgctctttcgttgaaacacctgtatagaccagcaatgtatcaatgtcagcattaattcccgccaagatatccgtattgtaattgtcaccaaccataaccacttggtcagctgtcaaaccagtgcgacgtaatgctccggccatgataatggtttctggcttaccaatgacaaccggcttttgttgtaccgctgtttgcaaagcagccaccaacgtaccggcaccaggtaacatcccgcgttcattgggcaagtttgtatcaacgttggttgcaacgaacttcgcaccatgctgaatagcaagggtggcttgtactaacttctcatagttaatatcacgatccaaaccaatagcaaccgcatcagctggtccttcgctcactaactcaaagccctttgcttccaaagccacctgtaagccgatttcaccgatcatcaagacacgcttaacgtctcctaactcagccaaataatcggccaaagccattgcactcgtgtagacttgctctgccgtcgtgggaatatcgtgattatccgttaaattggcagccacttcatcaggtgtcttcgttgaattgttcgtcacaaacagatattgcgatgacgattcagccaagcgttcaatgaaccgtttcccagctggaaagcgcttcgtcccttggtaaatcgtcccgtccaagtcaataaaatatccatcgtagtgttgtgccatgttaactgattatcccttcgtttctgtggtttgtcgttcgcgaatctggaaacgacggcgctttttatgtcccttcgtttcaacagtattcgcccgttccttcacatgcttggccttattaccagccggcttcgtcttctcagccactgccggtccctttggcttactcttgtgatgctggttattaccgccatccttgttatttgaatggttcgtgttggtatttgaacggcgttgacgacgacgcttacgatgaaccggttgttgttcatcttcgccttcatcaacatcatgtggttcaaggttttccaacacaaaatatggtgccccaaaattaacttcttcatataagtagtcttgtagggcagaaatttgttggctacgggcgacaccagtagcgccatccttataaaagccatgtagccgcaattgatcagctgcaatgtcaccaactagaaaatcatatttttcgaggaagtcactaaatcgggccgccattttttgttgatcataagcttcccggtagttatggactaaccggtaactccgttcattgataaaaatgacatcagatgtttcaccagttgtgatagttgttgcttcttggcgcttaataaattgctcctcagcaagttctttcatccgttcgcgatccatgttgtgggcctcctttctgctgtattttatttaaggtgtaaacgtgtcagccaaataggccgcaaagtcctcacgaattactgtatcatatgacatcacgttctgtcccgcaatttccaaagttgggaaatacggaataaacatgtaatggtctaagccaccaattgtatacgtggccgccatatcgagtggctggcctttcacgagaacatccccattcgccaagacggttagtcccgcccatacaacttcaccccaggcctcgccacggaaacccatgccttttagtcgattaggccgtaagaagttacggttcttttcaatttcatgagccagacgccacaaatcacgccctgccaacgttgaacgcatcgggtgcaccgcatgtggtaacaaagcgtgcaaatcctttgcagtgactaaaccagcaggtaaatcatgcagaaacaagcccgtcgataacatcgccacaccagtgtgtgtgcgttgcatcagggccgctagtcccaaatcaatcaagcgatgttcaccacgaatatccgttgtgtacgccgttggtaggtctgcaatcacccgcttcgctagttgttgctcaccactagtttgatacccggcaatctcaatctcatcttcatgcacggctggcaaatcatccgtgactactgtacgggcctgcatgtggaccaacttgccgtcttcaatttctaattcaattctgccgatatgatccccgtaacgcccggccgccgcgattaatgaattaccgcgtttctcaccatgttccaacaaatggtgcgtgtgggcaccgataatcacgtgcaattctgggtaatgctcggccaagtaccggtcagttggtaggcctaagtgtgacagcaagatattgatatccgttttaccagccaattccggcaaaatgcgctgtaacgcactgtcaatttcttccggcatccaatttaacaacggtagtgtcaaaataaacggcgccgtgaacccaagtacgccaatccgagtaccctgtggcgtcgtaataatgcggtaagctaccgcccaatccggaatattaccggtcgttttatccgtgatgttacctaaaacaaccggaaaattggcctggtcatacaagtgatttaaatcatcatgcgctaaacctaagccctcgttattaccaattgtcacggcatcatagccaacttcattcatcaaggccacgttggcttgccccatcgtggcttcagttagggggtgttggcgatccaaaaaatcaccaatatcaaacgtcaagacgctaaagccatcgcgtcgtaactgacgtttacgcgttaataaatagcgccggattttaggccaacgctctaaatgcgagtgtaagtcattcgtatgtaaaatcgaaattttatctcgcatctagttacctccgcttggcgaaatcatcatgctttcgttgaataattaattcaatttcattcattgttaatggtgtgctccaggctggccgttcgtcagccatcaagtaatccaaatcggcactatccacaccgacattaatattttcttggactggcacgctgtaatggtgaatgtgcccgtgcaaattaatgctacttggtgtttgaccaaacatcattggatagtgtgtcaaaaagaattggtggtgattggccttaataatgcgaccaacatcttcgaattcatacttcggcttaccgtctgatagcaccggattgtgagcggccaaatacttaaacaatgcccgcgaatcatggtttcccttgataatcacaatgtgtccgtttaattgttccaagataccagcaatcatttcatggcctaacttggctggccgaatgtggttcaccatggcaatatcgcccaaatggtaaaccgtgtccgtttcaccaactcggtcgttccaggccttaatcattgcagggtgctcatcttctaagaagttaaatgggcgaggtgcaaaattattactttgcaaaagttcttcatggaagaaatgcgtatcagaagtaaaatattccatttttctctaaccctcttttagcggagtcgtccgccatcataactattaatccacttttcaaacgcagcaaaatcctcaggaaaagcatttacgccaccaaagcgtaagacatctggttgatcatcgaactgaacaatcaagccccattcatcggttgcccctggttgcacttgccgataatccgcctgccaatttggcaaagttgccattaatttcctttcgatgtttggccattgaaaggaaacgtcttgccacattgtcgcaaattggcgccacttggcatctgtgggttgctcacgcataaagacaaatgttggatccgtgacatccataatcggcgcattcattgtcgcaggtacgcgcaaataaaaagcgtgctgatcggtctgcttcgcgtaaatataatcaaatcccgtcgctaaattaccacgataaaattcaaaatattgtagtgccatcttatttatcaatcacaatcaagtcagttgggatacctgccgtcaagttttcaaacccgtcggccgtcacgacaacatcatcttcaatccgcacgccacccttgccagcaacataaatacctggctctattgttaatagcatgccttcacggacaacgtcttcagctggtgaactagctgacaagattggaccttcgtgaatatccaaaccaatgccgtgacctgtggcgtggttgtattccttgccataaccagcttccgtgataatatcacgggcaaccgcatccaatgtcgcattcgcaacacctggctttacagcgtcaatcgtggcgcgttgcgcagccaacgtcacgtcataaatgcgctttgattcttcatcaagctcaccaaacgctaacgtacgtgtgatgtctgacgtgtatccatcgacaaagtaaccaaagtcaatcgtcactaactcacccgccgcaattggcttatctgagtatgtgccgtgtggcaaagcaccacggtaccccgaggccacaatcgtatcaaatgaggctttgtcagcccccttttccttgataatgcgatctaacaagttcgccacttcgcgttctgtcatgccaacgtgcaactgcggtaccatctcattaaaagctgccactgcgacgtcagctgaacggcgcaacttagctaactcgtcagcatcttttacttctcgaatggcttcaagtagcgcaggtaccggtgcgatatcgacaccaacaaagttttcatcaaggtaatcaaagtcgcggaatggtagcgtgtcttcgaagcccaagttttcaatcttaaagcgctttgcagcagccattgccacaccccagtaatcacgggtaaccaacagttgcgtgccttcatcgaggcgctcacgatattcttcttcgtagcgggcatccgtaatcaaggcggcattttcacgaccgattagaaccaagccgtcacccgtgccaccttcaaaaccagtcaagtaacgcatgtttgtcccatcagcaataatcatcccgtcgattcccagcggttcgaataggcgacggacattttcaattcgtgtgttcatcagcattttcctcgttttcttaatgtttccattatagcaaattgtcataggctccgaccggatatggtcagaatgacacgcaatattgatctcgtcccggaaatttcaacctttcgactatttgggaacttttacaaatttagatgcgatacgtcttatactaaataacgttgagatatgggataccatatccaaacgtatcgagaactctctaactctttcttctcatttgatacgattcggccagcaactactacccctagatgttggccacgaaaacaatacataaaaaggccagagcacgataacccgctctggccttttgtgtgtctatttaattgtcatcgtgtcacttgcctgcaaatcagcgactgccgaccagtcgatcgttacccctaaccccggggcactcggtaccggtaattggccggccataatttcaggttgtgctaacacaatgtctcgttcgaagtaccgtgatgcacttgaactatccgctggcacttggcgtgtcgctggcaatgaagccaacgctaggtcgactgcccgtccgacaccggaactcagcatgccaccaatccacggaattttatccaccactgaaatctgatggattgcctgtaacgtcggccaaatcccaccaagcttagcttgtttgagcgtaaatgcatcagcaattgctaatcctcgcgtaatatccgccaaatcatttaaggattcatccaaactaatatgcaactgcgttaactgttgttgtgcaatctggtgtgcctgccaagcgtcggtcgcaaacggttgctcaatcatgaaaacccctgcttgttcaagcgcccatagtcgatccatcatcgccggttgccagccggcattcgcatcaacagaaaatagttggtccgaaaaagctgctaaaacggtctgaagttgttgtaagtccgtagcgacagccagtttcaacttaattctttgatacccttgggcaactgccgctgcaatggcccgttgggtagcttgggcatcagtctgaataccaatcgcaattcctaccggcacagttgcaccgaccccgccaatcatttgctgtaatgattggccctgttgtttaccctgaatatcccatgccgccatttcaagtgcggccttggcaaaggagaattggctttgcgtttgtagccaattactgagtgtcgttgcggaatcaaatgtctgtcccaacatcaagtgacttagtcgttgcacctcagctagcgattcagcctgagattctggcgcataagcatgatcaataaacgactggatatcaccaaagccagttataccatcggttgtggtgaccgccaccaaaattaatggccgctcataggtcacatcatgcgccgttttgaatggcgatttcaagcgtaactgtaatgggtacaaggtgatggctgcaatttgcatcgttacacctcagcttgcaaggcagcaacgacggcagcaccgttttcgaaatgcacgttatgccccgcaccaggcacaattacccggcggacatttggtaaccgagtcgccatgtcggcgttcagacggtcaaacttttgatcattttcaccggtaatcaatgtcacgggtactagcaaggttgccaaaccatcccaataatttggcattgctcccgtgccgaaataacgtagtgaattggcaacattagccgccgtttgattaacccgttgctcatgcataaattgctgttgcgttagtgacaactgttgttgactcgcaaacaacggtaactgttcccaatctgccacaaattttgccatgccagctgtttcaatccgctgggctttttcagcatctgccgccacccgtgcctgccgcgcgtcaatatcggccaacccggccgtgccactttctaggtacaaatgagacacataagctggctgcatcatcgcaaaagctagcgctagccgtgcgcccattgagtaaccaactaaccgaatatcgtgtaagtcaaataaatcgaacaaggcaactaggtctttgacttgattttcagctgaaaaacgtggcgcgtccgcaacaactggggcctgattcccaaatcctaacaagtcaatgtaaattcgcgtgccttgcggagcaatttgctcgaattccgcataactacccatgaaaccatgaaagaacacccaggttggctttccttcacctacaatccgaacgtgataaggataatcattaataatagctgtcttatccatggaaagcctcacgtagttttgccaacaatgcgtcgtgttctgcgacgttagcttcgcgattactcttaatttcaagcaaacgcaatccctgagcgggttgggctaacaattcacgtaatcgtgcctggtcggcaaccaattcataatccgcgtgataaagtttagccacatccgcaatctcaaatggtaatggcgtcccaaacattggttcgaaaaaggccttcgctgctgcttgtggcaagaatgagaagattccgccaccctggttgttaaccaccacaatggtcaaatctaattgtgcctgatgtgccatcatcaacccattcatatcatggaataacgtcaaatcaccagtcaagaacgttgttggcttaccggtcatggccatcccaaaagctgttgagactgtcccatcaattccgttcgccccacggttcgccatcacccgaattgcttgcgttggcataaagtaattatccatatcccgaattggcattgaattggccacgaacaattggctatcagccggcaaactcgtcatcgctaatggcaaggccacttctgtcatgtcagttgatgcaatcgtctttgtcaacgtggtcttcaccgtttgccaacgcgctaaaaaggcaacgctatcgctgcctggctcagccagcaaatcagcaatcaagcccatctcatcaacggcgaccgtaatttcggcttgtcgtgagtggtcatggccggccacattttgaccaacttgaataacttgcacgtcattggcccgcaaccaagcgacaactcgtgcagaaaccggtgtgccaccaaatcggataaccacttctggcaccaaatcatcagccaacacatcagcctcaagcaaagcatcaatcccattaatcgcatgatcacttggacgaaccccactcaacacatccgccaaaatgggtaacttaaagtgatccgcgaatcgttcaaattgggtggcatcccaagtcatttcatcaggtccggctaacaccattgcccgcttatcacggagtaaggccgcaatgccttgcaccgtttgccagtcggcccgcgtttgaccagtaatgatatgctgggccaccactgctggccacgttgcacctaagtcaggcatcaagggcttgcgcaacggcaagttaatctgcaccggccctgctggtgcagtcactgctgtcaccaccatctgttgcacacgatagtcaatataacgtgtcacatcagcatgcgcatcttgcatctcaacagccacaaaatccttgatattatccccatataggttcgtttggttgaccgtttgtggtgcaccaatcgcttgtaactcggctgggcgatcggttgttaacgcaatcaatgggacgtgtgacacgtgggcttccatcatggctggtaaataattagccgttgccgttcctgatgtcgctaataatgcaacgggttggtgcatcgtctttgccattcctaacgcgaagaaggctgctgaccgttcatcaacgtctaccgtgacacgcacatcatcgcggacgtgttgcatctcagctaacaacaaggcaaatggcgtcgttcgtgatcctggtgataccacaaactcatgaacaccttgtgcaaccaaactacctaacaggtgtttaatattcgtcgtcaaaacttcatttgccatctacttatcttgctccttcaataaattcatcattggggtcatcttcagccccgtttcttcaaattcagcttgtacatctgagtccgctaaaataccggcaccggcaaataacgtcgctgtctgttgcttcagccacatcgaccgaataccaacaatcatttcgccatcgccatccggcttcaccacgccaattggacctgcaaacagaccacgggggtgctgctcaatcgtccgaatcgttgccattgcccagtcaacaggcttaccaccaagcgctggcgttgggtgcaaacgttcagcaagggccaataccgtgttgtcaccattcaattgccccgcaatcggcgtgtacaagtgttgtacctgtgggttcttcatgatttgtggcccatccggtaacgtcaaagtggccacatcttgcaagcgcgacacaatcgtttcaactacatacgcatgctcttgcaagttcttggggtcttgtaagagctcagttgccaaacgcgcatcttccgcttcatcagcgcctcgacgaatcgttccggcaacaccagccgtttcaaattgaccccggttaacttttgccaggcgttcaggggttgctgacacaaacacctcatccccccgcttcaacacaaagtggtaactattgggttgttgcgtcgcaaggtcggctagcaacgtcgctaaattcaactcacccgttaacctaacttgtcgttgccggcctagcaccactttttggtggttgggattttgctgcatgtcatcaactgccgtttggacccgatctggccaatcgcgttcatccgtttggcttgtaatcgctggcccagccatgggtgttggtgccccgaacggatccgtttcacgtccccataaatgttgatctgtaatgtcgtatagcacttccggcaacacgaaataaccattcattagtgcgctatctgtaacggattgttcatcgaatgaaaagccaccaaagactgggtaacgttgttcacgtgcccatgctgccacgtcttgaaaatccgctccaaacttctcttcacggacaccaaaaccatagtagcgtgttcgcttatcagccgtcgcaaaatagacggcatgttcagaccgatcaaaccgatcgcgtaactgtttttcagttggaaagctcatctcaaacacctcactgtttttcgcttattccagtatatcctacctagcaagggtgcaacacccaaaataaaaagaccaactgcaactgcaattgatctgattaattattttgttgcgaatcccttatcatgcaaatgttgcgttgccaggctgttgtccttcgcagttgtcgcaaccattttcatattatgctctgtccagtcttcgtcgatgccccgaccggcaaaatactcacgcatggtgtcgttgtacgtggccacagcaccttccaatgctgcttgatcatacttgtccgtcatccagaaaccacctttaacgggtaacttaggcttcaccccaggttcctgatcaggataccccaacgacaagcccatcactggcttcacaaactttggcaattgtaacgtgtcctgtagaaaatcaagcggacgtaccgccccagccatcgtcactgcgccaaggcccaccgcattagctgccaaaacagcattctctaaggcaatccccgctgaaatcaaagcaccctcggtcatgttataccacgccaagttttcggccattacagcagcttgttctggcgttgcaccaacaaacagcttgttgtaatcaatcgccaagacgaagaaccgtggtgcgccagcaatataccgcatccccacccgttccgtaatttcatccttcacagcttgatcagtaatctcaatgaacgtcactggttgaaagttattcatattcggacctgatgcagcggctgacaagaccgtcatcaccagctcatctgaaacgggttcatctttaaaagcccgaattgatgcgcgattcgacaaaattttaaatacatcgttttccatggttgacctcaatatctcaaattattatcttaatagcctaccataatttgaaaacgatttcataattacttactcaaactgcgcatcatacaacgtcttataaacaccattttgggcaagcaactcatcgtgtgaaccgcgttctacaatttcgccctcgttcaacacaacaatttgatcagcattatgcactgtactcaagcggtgcgcaatcacaattgtcgtcttgtgtgtcattaaattatccaaggcgtgctgaataattttttctgactcgttatccaaagcagccgttgcttcatcaagaataacgatttcagcatccttaaccaaagcacgcgcaattgacaagcgctgcttttgcccaccagacaacttcacgccacgctcaccgacagtcgttaccatgccatctggtaagccacgaataaagtccgcaatcgcggctcgttcagcggcatcccacaacttgtcatcagacacctcacccgagccataacggatattgtccgcaatcgtcccatcgacaatcgtcacgtcctggctgacgattgaaatatgttgccgcaaatcacgaatatcaattgcttcaattttcgtatcatcaaataagatgtcaccacccgttcgttcataaaagcgggtcaaaagtcgaattagcgttgacttaccagcaccagaacggccaaccaaagccgttgtcttgcccgcaggaattaacaagttaatgccattgagcgatgcgactcgttcttgatcataactaaatgatacgttttgcaaatcaataccggtttgcaagggacttgggaacgcgactggttcagacgcgttcttaattttctcctcagcacccataatatctttgatacggtcatatgagacttgtgccgtttggagcatatttaatagccgtgagaatgaccgaattggatcttgcaataatgatagataactcaagtaggccactaattgaccaaccgtcatgtgccctttaataactaaccaaccaccaaatgccaacacaatcgctgttccaactgtattaataaagttaactaagggttggaaaatcgcctgccaccgggtcgcttccaattgataaccattttgtgcttcaacgacgtctcggaaacgagcggtttcttcatcttccgttgtatagctcttaatcagttcaatctctgtgatggtgccttgcaactgattcgaaatttgcgaactcgtagcgcgtaccttggtgtaggcttcacgaatcttactacggaagtaacgaatcgtcacaaagagcactggaaaggttactgtcaccatcaaggctagttgccagtcctgcaaaaacaaaaacgttaagacagcgacgaatgtaaaaatattaccaataatgccaaaactgtctgaactaatcaggttttgcaagttactaatatcgctggttaaccgaaccatcaaatcacccgtcttggcgttttgaaaatagtcataatcctgcttcaagatacggttataagtctgcaaccgtaaatccgtaattgaacgttgcgacagcatctgcatcaaataggtcgacacgaacgtcacgacacccaacgctagcgttgtcaaaatcagtagcccaacctggaccgccaacgagtggatgttcttaagcgccacggcgtgatcaatcacatgttgtgtaaactgaggcaccacaaaattaagcccggcaataattaccagcaaggccacgttcaaaacaagcaatgatttgcgcttcaatacactgccaaaaacaaactttaacatctcaccaagggtagtatccgactccttcagatacgctttaacctcagctggactcatgcgtccacgattcatcatatctctcacctcacttattccagcaactatcttaccacttacaaaaagtgtgagcgcaaaaaagaacttatttaagttacgctgaaggtaaagcgcttacaatttaactatacaaaaagtgaacaacaaccttggaggtacgattatgattcgaactattggtaaccgtgtaatggcatctttcatggctgtaaaggccagcttgctgacatttgttcttttcgcaatttaactaatcttagcccgtcctgacgcacagcgttggggcggttttttatttatcaggttgttgggtttgtgcgcgtcgtgctagcgcacgaggcatgggtgtgggggattggcttcgacaaagatgccagctgggaaactccgccggcgcgagcaccggctagcacccaactaattgtgttaagagtctgggtccgttcgccttatctaaccggcggtcggccgaacttgtgagttccccacctgtcatcgctacgccaatcccccacacccacgccagcacccgagatattctcggtttgtttgatggccatcattaggtcggccgggtcaacttatgattcacatcaatattttagtagccatttgacaactttagacatcagagaacgtcttgactgtcgcaaccaaattcaacgacaataccaatacaaaaaaccgccggctcgttggcccgcggtaactttcacaatgctttgcgacacatcgtgagggaagcgctaattcgccaccctttattcaattgtcatggaccaccctagaggtctaatctgcagttttagacgtctgtcgccagggtttggtcgcaaccaaatctgtcttctccatctctaccgcatccacagctatctgtttaaaaagcaaaccgtgtcgggagcagccttcgaactctgtacaggcttacatccaaattggattatcgtacgtcctcgaagtaaccgatgctaatgaccgcaagagatgtcaaatcatgactaaagtgtttatctcttaaattgatacgtcttgttatcttgcgtcattactatgacacgcccgcatggatgtcggtaggtagagagatgatagaggttgaaatgaattcttcctgcaattcaattacctgcctttcctttggtacatgattataataacacccgctgtaagcgcttgcaagaaatgactctcgttaattactggtcatcactgaaccgtactctgcctgaacatcttgtaagttatgcgtacgcaaccagtcgttcacatcaattgtaaacggatgatcactatcaccattcccaccggtatacgaccccgtcatcacacctacgccaccatcaccagacaacgtatacgttgctccaataccattcacaccaatgccaacaaccactcgacctttacctgagccaacgccgtcgaccacaccagttgtaatgctgtgaacatccgctggcgtgtaaccagcttcagttgtaatgacttgggccaaaattgatgcccgatcattttgggtcaagtctgttgccacaacccccggtgtcccagtcaactcacttgatgatgactcagacgttgccaccgatgacgatgtcgccgaacttgctgaggacgcggttgtcgagctagctgttaccgaactggtttgtgacgaaacgttacttgtaacggatgatgacgatgtcgctgccttgtcattatgagcattgtcaatcactgcggcaacaccaacacccaataacaacgccacaaccagcaatgccgtaatcagcagagctttgaacggacttttcttaggagattggtgtgcatgcctggctgttctaccagctggatccttttcagtcattttattcacctcgtttgttattcatctgttattgttactattattttatcgactttagtctgatttttgttgtaataaatacctcaataaaagcacgcgtaaaccattttctgattcacgcgtgcttttattggatattagtcccttgttatttatcaatgtgttgtctgactacctgccagattcaactcagtttgcaaaggttgcacacctgtcagcgcaatcgatcgcgcatctggttggctaacaccaactgaaatctcaaaacgattactatcaataaagttatgtccttgctcatcaaacacttcgaagtcctgtggacgtaaatcaaacgtaatcgtttgcttagatcccttacccaaaaagacgcgtttgaatcccttcaactgggcatttggcacagcaaattctgattctaagtccttcacatagacttgaacaacttcatccgtatcaaaattacccgtattttgaattgtcaccgttgccgttgccgtctcttcataagacttcacctgcaaatctgacaattcaactgacgagtacgtcaaaccataaccaaatggatacaaggcctcctctgtcatataacggtatgtgcgtcctgccatattgtaatcttcaaaggctggcaaattatctgtgttcttgtagaacgtcaccggcaactttcctgatggacttactgtaccaaacaaaacatccgcaactgccaaaccacctcgagcacctgggtaccaaatttgcataatcgctcgtaggttggggtggttctccaagccatctaattgcaatgatgaacctgaagctaacaaaactactacaggcttaccaacagctaacaaacgttccaacaattgtcgctggcgccctggcaatgacaagttcggcttatctccagccccttgtgagttaccagcatccccttcttcgccttcaatcgttgaatcaagccccaagactgcaacaatgacgtctgagtgttcagcagcaataatcgcttctgattcacgttcatctgtcttagccaacggttcagctgcatggtcttggaacacccctgagccaatactatagtggacccgaacgtcatcgccaagtcgttcctgaataccttccaagatggtatatgaacgtgatggtgtcccaaagtagttacctagcaatgcgatttctgaatgcgcgtttggcccgacaactgcaattgcttccatcgtttccttgcgtagtggcaaaacgccatcattcttcaacaacacaaatgacttctcagccgcaatttctgacagattattgtgcgccttcgtgtcattcgcctcatacgggatggcatcgtactcattatcagttgcaaacatgcctagacggacacgggttgcgtaaagtgaaataaccgcattggtaatttcttcctcagtcaccaaaccacgattcaacgcctcatgcaaagattgttcgatatgaccggcaaccaagttcaaacctgctttgatggctaatcccatcgtttcagcggcatcctttgtgtacttgtggttctcatgcacatcttctggggccatgtaatctgagacaacgtgaccttcaaatgaccacttatcatgcaaaatgtcccgcaacaacatttcactaactgacgccggcacgccgtcaactgcgttatatgccgtcataatactttcgacatcggcctcttcaaccgctgccttgaaagctggcaagtacgtctcatacaagtccttgtctgacacaactgcatcaaagccgtgacgcaaaccttccggacctgagtggaccgcaaagtgctttgccgtcgcagccagcttcaagtacttagcttgcccttgcaaccctttgataaaagccacaccaaacttcgacgttaagaacggatcttcaccatatgtttcatgtccacgaccccaacgtggatcacggaaaatattgacgttaggcgaccaaaaagtcagtcccttgtagatgtcacgatcctcgtgcttcgtaaattcgttatactttgcacgtccttctgtcccaatcacatcggcaatatcattaattagctggtcatcaaaagttgccgcaagtccaattgcttgtggaaaaaccgtcgcaacgcccgctcgcgccacaccgtgcaatgcttcgttccagtagttatattccggaatattcaatcgttcaattgctggtgcttcatacttaatttggccaattttctcatcaatcgtcatttggtcgacaatcacctcggcttggcgacgagcttcttcgtgagtgagttgctgggtcatatcattctcctaaacataaatcatttcaaataaattagtagataatcttatttgttgactgcctttcgtttttgaaagcgttttcttttcaacaccattatttatatcatgggttatttttttagacaaacccactaaatgcttaccaaatatgaagagaataacaaacgatatgcagatatcatattcaacgtatacgttaattgatttgactctattcgtcttgtgctgtgtttcacatattgtgaatggactatgcccgaaaaatgattaacataatcgtaataatcaaccacaaaaaaagacagcatcacgaacttaatcgtaatgctgtctttttacagtctattaaactgatttcaaatcttagttaagtaataaattacttagcgatgatttgcttgtactcttcacgagtaacaactgatacttggcgacggtcacggcccaaacgaccgaactttacgacaccatcagtcaaagcgtacaacgtgtcatcgtttccacgaccaacgtttacacctgggtagatgtgcgtaccgcgttgacggtaaatgattgatccagccttgatgtcttgaccatcagcgcgcttcgttcctagacgacgacctgctgagtcacgaccgttggcagaagatccgcctcccttgtggtgggcaagcatcgtcaagttgttcaaattcaattgcatgatttaaatcctcttctttccgatgtcttaggcaatagagtcaatgacaaccttagtgtatggttgacggtgaccttgcttcttgtgtgagtgcttctttggcttgtacttgaaagtaacaaccttcttttccttaccttgcttctcaacagtacctgatacagtaacaccatcaacgtatggtgcaccgatcttgccgtcagcgaagacaaccttgtcaaagacaaccttgtcaccctctgcggcgtccatcttctcgacgtaaattacgtcaccggcagaaaccttgtattgctttccaccgttctcaatgattgcatatgctgccatgagtctgtagacctccatatatattatttctaaaaaaacttagactcaccgagtccgcgtgttccgaggaacaacttaatacagaccacgagtggttgcagtttgtgggatccacaaacacaacgtaagttattataaaccaatgggaaaacaaaaacaataaaatcccccacaattggtgagggattttaacgaaaacataagtgcagctggtgggactcgaacccacaaccgctcgggtagaaaccgagtgcactatccagttgtgctacagctgcatataaaatagatgaggcaacatttcactatcgcctcatctattgtacggttaaaacgctggtgaatcaaggtcagaagcatccaaaacatgagaaattgcgattgcgagctcttcctcagttaaatgcaattcaaataatcccaatttcataaatgaccgccaagcatgggcgaaatcactttggcgcttctgatgataactgtttaacaacattgtcttaatgcccataaattgatgggctagccgcatttgtggaaaacgggcaaacttctcaatatcagcatcttccaacaccatcaaatgcgtccactgttgctttaaactaatcaacaaaaattgactcaaagccgtggcatacaaatcaacaatcgttgcttcactggtcacaacagcatcgtggggtacatccccattcaccgcatcaacccggcgcatcagcgtacctagcgtaatatccaaatttaaataatcatttaataggacatcttttgggctaattggattttcccaatcataagccacaacccgataagcgtcacgcgcttgccgtaaatataatgcaatatccagtgccattatgcttccggctcctcatcagtcgtgtttggttgcaacacttccacttgtggtgcctcagacttaactggtgcagatgccccgtaattcttcaacgcacgattgccttgtaaaccgaaaactaattcatcgctttcgacagccaagtaatgacgttccttcaagtaccaagcaccaatgaagtcgtaatccaacaaaatatcaagccatgaaacagcatcgtgaccatcgatcacttggaagtgccagcgctgtgcccctatagccgtggcatcatttgcatagaaaatccgtacttcaacgccctgttcaagcactaaaccggccccatttggaatgttttgcaagaagtagtttgaatctgctgacaacacaaacaaacgatccaacataccagctggcatttcagtttgaaccaatggatacaagaaatcatccttggtctccaaaatgttgtaatcgaccttgtaaccaaattcgcgttccatgtaacggccgaattcagttaataatgtcgtcaccgtgcgaatgcgtggtgcggtcgtcttcttacgatagttttcaaccaacaagtttgtaatggcatcggcgttaaacaaaatttgcttgcgctctaatgaccaatagaacaaacgttcattcgtcccaagttcaacgaaaaaggcgccaccatttggatcgtcgttcacaacgaactcaaatgttgctggcacttccaattcagttggtaccaacgttagttcttcacgttcggctggcgtcaaaatatcgtacgctggaatcccggcaaaactcataaaccgatccatcgccaacatgtaccaatctgctggactatattgacgtggcacaaggacccagtccgtatcaagatgcgctgccgttaaacgctcggccagcatgtgcacacgcgctggttcttgtgattcggccaattcacgtacttgcgccaacaattgttgaatttgaccaatgtcatctgtcaacaagtcagcatatgcgactacgcgttcacgaaggtgttctgtcataattacttacctccttgtgcatcagccaaatacgtcacatacgtttcgtacaatgatgcaaccgcttcttggaagttcgcgaatgaaccaaacgtatctgagatggcacgttgttcataaatcaaaatcgtatcttccttcgatagattcaaaatttgggcattgtttgctgcaattaactcaggcacttctttagccttgtcgtccgcagcatctaattgtgccaaacgttccttcaacacttcacgttgttcattttgtgaacgattaccaaaaataccaccacggtcttcgctcgatgccagctgagccatcaattgggcacgttcggcatcacgttgattttgatcagccacaatttgttgcaacgcctcattagctcgtgtagtatcttcaattacttgtgcgttataacgttggccggcctctgataattcaacagcgcgtgccaacttttcatactcttgatcattgaaaataaagttcacagctaatggatcaagaataccgaaatgacggcgatcccaccaatttccaaagaacaattggaatacacccaattgcgtttcttcgtaataaaagaatgggaatttttctgacaaatactgaatcaattgttgtcccaagtgatggctcaattcatcctgcatgtcatccaccaagactgacaaggcacgatttgaggccgcattttgcgtctgtcgaatcttcgtgttgtacttttggctatctaataattcatatacccggcgatcatcattcgtcgcaacagcgttctgaatatccccgatgtagtctaattttgcttgtagttttccatttaatacggattgatttgacggcaagtccgtcttcaagtatggcgtgttctccatctcaacccctcctcgtgtgtggttgtcctaaaactcatgtcataacactaacatcttaatagttctatcatacaacctaaccttaaagaaaaacgccaacctttccccggtcggcgttgttttttagaacatttaacgaaaattttagtattgctcgagatatgtgtccaattcccattgcgatacttcttgtcggtaagcttgatactcaagacgctttgcatccacaaacgtccgtgacatgtgtgaacccaaggctgccttgatcgtttcatcctcatccaagtcgttcacagctgctagcaaggtatcaggcaaatcagtaatacctgcacgcttgcgctcaccttcatccatcaagtagatgttacggtcaacagcgtgtgttggctccaattcacgttcaataccatccaagccagctgccaaaatagcagcaaaggccaagtatggattagcagttggatcaacggaacgcaattccaaacgtgttgagttaccacgtgaagctgggacacgaaccattggtgaacggtttgaacctgaccaagccacgtaaactggtgcttcaaagcctggcgtcaaacgcttaaatgagttaaccgttggatttgtaatggccgtaaagttggccgcgtgatccaaaataccacccaagaagttataggccgtcttagacaattgcaactcacccgcttcatcaaagaaggcgttgccatcctcggtaaacaaagacatgttcgtgtgcataccattaccattaatacctgaaattggcttaggcataaaggttgcatacataccgtgcttacgcgcaatcgtcttcacaatcaacttaaacgtttgaatgttgtcagccgcatcaagcgcatcagcatacttaaagtcgacttcgtgttgtcctggcgcaacttcgtggtgggctgcttcaacttcaaagcccatcttctccatctccaacacgatttcacgacgtgtgttttctccaagatcaagtggtgctaggtcaaagtaaccacccttgtcattcaaattcatcgttgggttaccatgttcatccagcttgaacaagaagaactctggttccgttccaatattaaatgacttaaagccatcttccgtcatctgctgcaagacacgcttcaaattgctacgtggatcacctgcaaatggctcgcgatctgccgtgtaaatatcagcaatcaagcgagcaaccttaccaccgtgcaagtcagtcgcccatgggaaaatcatgaacgttgacaagtctgggtataggtacatatctgactcttcaatacggacaaacccttcaattgaagaaccatcaaacatcaaattattgtcgagcaccttctcaagttgtgaaactggtacttcaacattcttgattgtaccgaacacgtctgagaattgtagtcgcaagaattctacgttttcttctgcaatcatgcgacgaatatcatccttggtatatgctttgcgaaccatctagatctccttttgataacttagcaattaaaacgaaatgtcaaaacttacgctgaccattaaaccgtccaattttcagcagctcatccgccaacatgtgtcgtagattttcttcatttggttcaggcttttcagctgacttgcgttgcttcttcgcatcaacctcatgaatttcagacaccgaatacccagcatccaaataatctgcgatttcaattaaccggtctacatcatttaatgaaaaacgacgttgtttaccagccccccgttgtggcgtaattaaaccttgctgatcataataacgaatttgtcgatcagataagtcagtcagttcacgtacgacgctcattggcaataccgccaaatcgcgacgaagttctcgtccacccatacgttctgaccccctatgcttagcatgttaccaccgattatatgtgaagtttttaatcatgtcagctattctgacatgaaccgttttaccgcttctttgatgtcagttatttcagacggttgctgtactaaatcaaaccaatgaatgtctgtaaactgattattgaaccacgtcatctgccgttttgcgtaccgtcgtgatgcctgttttaaggtttctgtcgcttgttctaatgattcatcaccagttaaatagccaaacagttccttgtagccaatcgcctttcgagctgtgctatctgctggtaaagccatcgcaatttctgcttctgccaaaataccttgcgtcatcatggcgtcgacacgttgattaatgcgttcatataacacttgccgatcagttgttaggccgataataaaggcatcatacagtcgtcgcggttctggcttttgttcagagaaaggcttgccggtatgatcacttaccagtaaagcacgaactaatcggcgaatttgaccaggcaaaatccgagcctcactcaccgcgtccaccttgcgcaaagcatcacgcaataccccttccccctcgtcgtgggcaatttgcgtccatttctccgtaaacgcatcatcttgaatatcatcaaccgcagctaacggcttatcgcccaacaaggcttgcacataaaagccggtgccaccaaccaaaatcggcaccttgccacgggccgaaatctcagcaatcgcttgctgggcttcctgcacaaaacgggccgccgaatacgtttcagttggatcagcgatgtcgatcatatgatgcggtgcttgcgcctgttccgccggcgtggccttcgccgtcccgatgtttagctgtcgataaatttgcatcgagtcacccgatacaatttcaccatcaatagcctgggccaatgccaaagataatgtggttttaccaaccgcggtcggcccaacaatgacaattaatttatccatttttactcattcacctataaaatttttgatgcaatatctgtaatgataccgcgtacgcttaacatccggagtaatgttgtccacccccgcgtatttggggtccaccaataggtcttcacaccgaatggccttaaccaggcgaggtaccaataacgataatccaggttaacttgctgaatgattccatcacgccacaaacgccagctcaccatattcggcacatgccgcaaataaccaatcggtacgttcgcatctaagcggcgccactttcgcaagggcaactcttgaaatgactgcaacatcacggcattcggtaattgttttgcctgcaactcgcgatacagctgttccgcgccgacccggccctttaactcaattagtaataacccttgatactgcgttgttgcaatcaacgccaaaaaatcgtcaaatgttgcaacatccgccggcaccacgccatcctgatcatgttttaaaattaaccgattaccatacaattggacatcaacttcaaggccgtcaacgcccgctgcaatcgcccgttgaaaggcaattagcgtattttcgtcacctcggtcgcgatgtgtgccacggtgtgcaataattaatgttttgtttacagacatttcacgaacctcagtagtttaattcttgttaaatatgttaaacttatcttaacaaataaatggaggaaccacatcatgaagaagtttggtttggggattttgactggtgttgccggtacgttagctactgctgcagccgctgctttgactttccacaaggttgctgtaaagcctttggaagaagaggaagctaagttcgaagagacagaacgaaaggctgctcgtaaggctgctcactcacatggcgctcgtttttaatcaagcacataaagaaaaggtttgggatatacatcccaaaccttttttcattagttagactttgtcttaccgttatattcggcaaacccattcttgagaacgaaaatttcgttataaccgtccttcttcaacttacgtgccaaacgggctgcaaattgcatgttctcgtcgtacaagaacacaggcttgtccttacgcaaagcagtgtggttttcattcaacatggcatattgaatgttacgcgcacctaggacgtgcttcgccttaaactttgccggttcgcggatatcgatcaattgttgaccgcgactttgcttttcaaattcttctgactttaataccgttgccgcgcgcttcaacgtggtacgtgtccagatgattgtaccaactgtccaaataacccaaattaaaatcaagacaaacaatgcttgcaacatactgctcaaatccccgtttcgttaatcatgttaattaccattttaacaaaacctaaagaaaaagtctgccaacctttggcagactttgttttttcttcaattattcagcgtgaccgacaatccagccattaacgtagccaaatccgacacgcgtgaatgacccattcatttcccaatcatggtgaccgtttggtacacccgtcatattggtttcgttaaaccaagccgagataacgtcttgtccggcaccaaagccagccgccacaacttcattggccactgcccctgaatagtgcgcttgatcaacaccggtttgtgacattgatgcggcacgtgccgtcgctgacgcagccaggccatcatcccaaaccagttgtggcaatcccgctgaagcgcgcaatgcgttcaatgcattcaacgttgcgtctgcgctggctggtgaaactgtcgcaaccggcgcagtagatgtagctgcactcgttgcgactggcgcttctgaactagctgatgatgcttgtgaagcaactgagctggctggcgcaacagatgacgcagctggggctaatgacgcttcgcttggcgctactgacgccgcaacactcgttgcgactggcgcttctgacaccaaatcaagcttctggccaacttcaatcatgttggcattcgtaatgtcattttgcttcgcaatatcgtccacactgcgatccgtcgctgctgcaatcgttgacaacgtgtcaccagattgcacaacatatacacgtccagcatccttaaccgttgtccgcacttcgtcaaccgtcttactgcgccaacccttagctgaatcgtcagctgatgcggcatttgtgtgcataaatggcaagacagctgctgcaaccgcagccgtcgtcaaggccatccctttaattgatttatttactgatactttttccataagaatcgtttttctccctatagcgtttcttatctattttcttctcttttaatctacttacaaaagtatagtaaataattattgccagttgtttacatctgcgcttcaaagcagttaacagagtgctcggaaaattgcaagaacaaatccttcatttcaaattaaaaaaccaagtccaaaaatggacttggttttttcgtcgttattattagtggacaaattggatgccagcagctgaaatcgtacgaacgtggtatgccaatccagcatagttaccctctgagattgtaatcgtaccatctgagttaacagaatcaacaaccgcaacgtgacccaattcaccagcgccatcaaggccaggtgcaaagacagcaaccgcaccagcagctggcgttgcgtcaactacacgacctgctgccgcagctgaggcgccccaaccagaagcgttaccccagttgttaccaacccatgacaaagcgttcttaacgaaccacgtgcattgtccagctgggtaagtgttaccagtcgtatcatacgttggcgcagcaacagcgggttgtgacgctgcatcgtatgcaaccgcacccgtatttgtgtattgcgtgttgtcggctgcagaagtcgttgcaacttgtgcagctgcacttgcagccttgtctgctgaggcagctgcttgcttaagcgcatctgatgcagagttgttatcttgcttatctgctggcgtcaacttcaacgtctcaccaaccgtgataaagtgaacatctgacaagccgttagccttcgcgatgtcatcaacgctttctcccgttgcttgggcgatcgttgacaatgtgtcacccgtttgcaccttgtattcagtgccagctgacaagacaactgccttcacgtcgtcaactgtcttagcacgccatgaggcagccttgtttgtgtttgcatcagccttatttgcagttgaatcttcagcagaagcggccgttgtgtgtgtcattggtaaaattgcagcggcggccgttgcagcagcaacaaaccatcccttagtcatgttttgagttgtcatattctttattatccccttgatgcgatttaaggcgcgtcgctacggcaacgtctttcctctatccataaaaaagtctatcaacctgatttaacggcctagttacactggtataacagttactaaaaaaatgaaagcaggcacaaatgctgttatatcaagggatttccttgttttacattaccttcgtgatacacatgtcacggcgaaaacgtgaaaaccggctacaatattacgttttattacaaaatgtaatatttaatgtaataaaaaatgcctgaaccaatagggttcagacacctttatttcaatttacaagtatgtgaaatttgctattagtgcacaaacatcatgccggcctttgaaagggtacgtgagttatatgacaaaccagcatagttaccttcttcaatcgtaatttggtcaccatttacggcaacaacgacagccacgtgaccgtatccgcctgatccaccaacgcctggtgccatcaccgcaactgatccaactgtagggttcgtatcaactaaacgaccagcgtaagttgctgagttagcccagtccgctgcgttaccccagtagtttcctacccaaggcaaagcattcttaacgaaccacgtgcattgtccagcaggatacgtgttagcaccatttactgacatatctgcattatatgatggcgctacttctgcaactggtgcctcttgagctggcacttcttgaacggccgtttcttcgacaggtgccaccgtctcagcaactggcgctacttcttcagttgctactggtgcaaccgcttccgttgccactggtgcagcttcaaccggtgcctcaacaggggctacttccacggctggcgtctcaacttgagcaaccgtttctgcaacttgagccgcctctgttcccacttcaactggcgcaccagtcaattcgattgtttgaccaaccacaatgaagtgaatgtcatcaatcttgttagcagccgcaatttcttcagccgtcaaatccgttgctgatgcaattgatgacaacgtgtcaccttcttgaaccaagtacgtttgacccgccgtttgaacggctgagacaacctgatcaaccgtcttagcaagccatgatgacgtcgtttgtgttggtgctacttcttcattagcatatgttgcatccatgtggaacattggcataaccaaagccgctaccgccaataccgtacctgctacccagttcttacctgacttgtacaacttcttacgtgatgttacgttttgcatgattaactcccttttcgtcgctcgtgtaaagcgtgtcttacttttttaagtttatgatttttgttttcgtcgttgccttaacaacataatctatcttatcgaggacgcgtaacaggcgtataacaggcgccaaacaacctgtgacgcacaaattcttcataaatcacacacgtgtaaatcagcgctacatcaacgtcttgtttcagtcgttcataccatgttcataattcgtgcatatttcattttgtgaattagcttactatttcaccataaacgggtgcaatgttacattttattacaaatatctcagcgattttcagtaaacaccgtcatatttgcccacaaaaaaacgagtatcgtcacgatactcgtttttaatgacttctatttataattaggcaatcgtacgatctgagttacgggccaatgaagcagcaccgtatgcaccagcgtcgttacccaactctgccaacttcacttcagttacgtcgcgcgtagctttgaaagcaaattggctaaagttcttggcaacacggtccaacaagaacttaccagcggctgaaacaccaccaccgataacaactgaagatgggttcaagatgtttgagatgttagctgaagccaatccaaggtagtaagccaccttgtcgacaacttcatttgccaagtaatccccatcctttgccaagtcaaagacaatctttgacgtcacttcttcaccattgtcgaccatagccttcaattgtgagttaccagcgtaagcttcggcaaaatcttgtgccaagtggacaacacctgttgctgaagcatattgctccaagcaaccgtagttaccacatgtgcacaaatatccaccaggttcgacgatcatgtgaccgacctcaccaccagcaccggcaacaccgtggatcaacttaccatcgttaatcaatccaccaccaacaccagttcccaacgtaatgaaggcaacatctggttgattgtttccagcaccacgccattgctcacccaaagcggcagcgttagcgtcgttgtccatcgtcaatggcaagccagtaccagcttcaatttgttcgcggacgttttgcgtttccttccagttcaagttgaacgctgcacgaacggttccgttctcagtgtcaaccgttcccggcgtacccattccgataccaatgatacggtccttatccaattggtacaagtccaagtggtggttaatagaatcaatgatgtcgggtacaatgtgtgaaccttcgtccaagatgtttgtcttgattgaccacttttgttgaatctcaccttcagcagtcaaaatggcaaacttgatggttgttccaccaaggtcaacaccgattagcttgtctttagccatctgttctttcctcgttatttctcaaaaaatatatttgtaatcgctttcttgctttcaacattattaattataacgcattttccaattaaaacaagcattttagtgaaaacggttacaaagttgatttataaggcttggcgtcgctcttcatcttcatgttcatgtcgtaataccagcttgatttgcgcgtattcctttgcttctaacaagccagccttatacatgttgtcgatttcaattgccgccaactcaatatcccacaagcggttacccacgtgaatataaatatcgtatttcttcaataaatttaaaacatccaaaaacgtccgcatttcatcacgctccttagatacgatttatcgcaatgccaaataccactgctaataatgcgagatacacaatcactgctaataagcggtgccacacgcgtaccttaaacaagccggtgtagtgaaagcccgaaataaaggctggtaccagaatgaatccccctagtaagcccccaatgtgggcgcttaaatcaatatccggcgttgcaaacgacgatacaattgataacaagataaaaatccccatcaattttgcctgactacgccagtatgcgcggcgcttgtccaacagccctaacataccaatggcaccgaacaggccaaagattccgcctgaagccccagctgaaataacattcactccaccaaaggctaggctcatcaaattaccactaatcaccgtcaggaaaaatagtgctaggaaacgccatggtcccagttcaatctcaagtaaccgaccgataaagtataacgtaatcatattaaaagccaggtgtgaaaacgtcacgtgcaagaagcccgccgttatcagacgccaccactggtgtaattggtaaacagccggtgaaaattgcgcaccagaatgaaataacacttgtgagttaatggtaaagctatgcgcctgtaagacttcccataagtagacaagcaccatcacggtcactaagccggcggtggctggcgtcgctttaaacgcccgcttgaaatcattagtcatgaacattattcctcatttttaaaaattaaaacttgatcaacttgttggtcagttggctcaagcggccaactaggttggggataaacattctccgccagcgccaatgcgactgtccgagctgtggtctgtggtaaccaccgatcataatacccgccaccaaaaccaatgcggtcaccggcttcgctaaaggccagtcccggaacgaccacaaagtcaatctcagttggcaccacaatctcatcccccacgggctctaacatgccgaagcggtgccgctcataggttgtggctggcgtcaccacaataaaggtcatctgccgaccaggttggacgcggggcaaaaccacacgtttcccctgtaacatcgccgtttgaatgagtaattgggtcggtatttcatcatcttgagacaacgttagtgcgaccgttttcgctgattgccacgctggcagtgcagtcacttgcgccacaacagcttgcatcagccagccccgttgcgcatcagaaagcgccgctaaattggctagcgcctgttgtctaactgctgctttttccatcaaaccgattcccccttaccaaaaaactggtacttacaatcataagtaccagtttatcacaatagttcttagtctaagaaccgttaattatcagggcattaccccttatttgttagctgacccagcgtcctggacatccttccaaaaggcagcgtagatttgtgaaccaattgcttggttaacgttttcatcagcatcgtccgttcctggaataacaaccgccaaggccacgtctgaatctggcacgaatgaaatcaatgaactcgtaaccgtcgttgccccattcgtcgtcgtttcagcagttcccgtcttggcgctaacttcaggcttaacatccttcaagtgcgttccagtggcatagcctgagctactgtgcacaacttcattcatacccttccaaattaagtcacgctcgtccttcgtccaaccaacagtcccaaggacttcggttggaatcgtcgtagtcgtcgttaccttattggctgtatcacgggattgaattgattgcacaatgtgtggacggacacggtaaccaccatttgcaattgttgcaacgtactgtgcaagttgcatcgtcgtgtacgtatcatactgtccgaatgattcgtctaaggcattaccgatgtgctcacgagttgttgatcccttgatacccgtgatttcaccaggcaaatcaatgccggtcttcacacccaatccgaaacgggcgaatccgtcacgcatcgtctggtaaacagacgttggcaaggcacccaatgacatacctgggaagtagttcaaaccacccaagcgcagcataacttgcataacgtacgtgttagaagacatcatcaaggcagtgtcggccgtcaatggcatgtttccactaccattacggttccaccatgatgactttgttggtgttccagcaaccgaaattggttgatcagtaatcgtattattttctggtgtaatcgcaccattcataaatccggttgtgatcatcgctggcttaacaacagatccgacaacgttagcttggttaactgtcgacaaggcgtcagccgttaactttcctgtttcataatcacggttaacgccagctgtggcataaataccacctgtcttcgggttaatcacgaccgcatacgcacccgttgtattaccaccaggaatattcttctccaaaatgtcttgcacatcattctggaactttgcattaatcgttaacgtcaagttgtcaccagctagacccttatactgggtcgtttccttcgtgttgccatctttatcagttgtgacttcaacacgggccttcgtcccctttaacgttgactcatactgcttttccaagtatgacgttccgacgacatcatcacgtgagtagccttgggttagcaaagaattaacactgtcttcaggcagccctgactttgaagttgacgtaccaccaactagtgacttaatcgcatcaccttgtggataatcacgtgtgtagtagatgccgaccttaacgcctggcatctttgattgacgctcaccgatatccgcaatttcttgttgcgtcacatcagtttctttcaagtaaaccgttgacaaggcatatgaatttgccatcttctggtaaatcattgctttattcttttgcaaatccgttagtgggaaacgctttttatgtttttcaacgtagccacgtagcgcattcacgtatgcatccgtaccgggagcagctgttgtgccacttgcttcaaccacgcgctttgcacgcttagggtcttgaatataatacgttgcatagttaggtgttgataactgcttagtatcgacagttaagtacttaccaacattattcgcaatggcgtacatttctgattcagtaatgctttttggcttggtataagtaatcgcctgcgatcccttattcgcaaccaaagcttggccggtactatcataaatcatgcctcgttggacattaacttgttcgacgctggattcggcactcgtcacggcagtcttatattttgcgctgtccgtaatctgtagcgttgccaatcgccagcccaatgcaccgagcatcagtacaacaatacccatcaaaacattcagccggacaggaatacgtgacaacgaaccgttagttgacacacgtcgcttgccacggcgcttaggtgattgcataactcgaccctttctttctattcaatctaattgtttaattgtagcatattttatgcccctaataccttaacctcttacaacgaattcgctgaattttcaggcctattatatggtttaatagtactaattgaaattattggagaaaacattatgttcgcacatttaaatcctttaaaatggcgcacatctactaaagccctatggattagttttttactacccgttattatcatgacggtctattttgggttccgtgggatggcaccatttgggtcaagttccattctaactgttgatttgggacaacaatacattgattttttcgaaagttatcgacatgcccttttttctgatccgctcagtattttttatagttttgcgaaagggttaggtggtgagacgtatggtgactgggcttactacttgctaagtccgacgaacctattattattaccattttccaacacctatctgcccatcggcattctgtttcttactatattaaagtacggtttagccggttggagtttcgcctacgccttaaaaagtatgcgctggcaaaacggctggcggctccccctctttagtgtgacttacgccatgatggggtggttcgtcgcgaatgacctcaacttactttggctagatgcggccatcttactgcctttaatcatcgccggcctagaacggtatattgaggggcggtctgcttggcgcttaattgcgccactgtttgcaatcttcgtgattaactactatatggcctacatgattgggttattccttgtgttatacattatctggcgtttattctggcaaccctaccgtttgttagaacgctggcatattttacggaaatttattttcggtagcattatcagcattgggttgtcgaccgtcatttggttacctactgcctacacgttattaaatagtaaagggcaacatatgctggataacttgagttggaagtttgaatatcaagcccccgacttactcggtaagttattcttagggactttcaactttgaccaaatgccaagtggcctaccaaatatttttgttggtagtctaccaattatcatgctctggttcttctttacctaccgcttgattcgctggcaaactcggctggtcgctttcttcattacggcattcctagttgtctcaatgatgtacgccccattgaacttgatgtggcatggcttccagttcccagtttggtacccttaccgattctcatacgtctttagcttttgggtcatctggctggctgcgtccgtgtggtcaccgacgctccggttctcgtggacccaactcggcagcctcttcattttggctgtcgccgcagtagtgtatctctactaccgcctggatagcctcaactttttgacccaaaaccaactcatcattggaggcagcttcttcctattgctccttggcttccatgcgttgccagtccgcagtggttggtggttgccaatggtgacgttgttggttgtcggtgagatgacaaccagcactatctggtctctcaataatttcagctacctgacaaacacagagtacacaacctacattaagagcctcaatcagattacggcagatttgcccaagtcagataaagacttctaccgggtggcgcaatcattccagcgaactaagggtgatccgctccaagcacactacaatggcgcgtcaacatttagctcggcccttgaacatcagcagagtgatttcatggcggccatcggtcaacccgagggtgataattacatcacctacaacggcggtactttggtttctgatgctttactggggatgcgctacttaatccagccaagtggtcaagaaccacacacgtctggtacgccaacgaatatgcgcacttactcgcggagtgataccaacggttattatcaaatgaccaagcacacccagatggcggtgctgtcaaagaacccttatgcgttgccactcgcatttgcagcgaacacaaatgccctcaacgttaagttcaaagataacgaccctttgcgtaatcaaagcgacctttggaatgccctacttggttatgacaacacaccgattttcgaaagtgccaattttgatagctcagcggcgacaaacatgacggcaccaacaaccatcacgggggcctttctgaagaaagaaaacgccaatgccgttggttcattaaccgtgacctatacgcctagcacggatgatccgtactatttgacgattggggatgcattgaataatgacaatgttgaaattcaattaaatggtaaggcactaccaaccatgccaagtcaccgtcacacgattatcgtgccactaccgtcataccaaaaaggtcaaacgcaaactattacgtttatcctgaaaaagaatgacttgtggctacaaaacgtttcactgtaccgggccaacacagattctatccgtgcacaagcccagacgctacaacataacgcgtttaagccaagccatgttagccaaacacgtatcagtggtaaaatcacgatcccggctggtaacggtcttatgatgactacgattccagccgccgatggttggactgcctacgttgatggcaaagcaaccgatactgtcaccgttggtaaattctttatcggtttggccttaaagcctggcgagcacagtgtcacctttaaattcacgccaccttacttaaagattagcgcgattgtttctcttggctttgccctctttatggctgggttgggctggtcagaaagcggaaaacgacgtcattcattgcaccaattttaaaagaagccgttgtgaacctttacacacgccagcccccgtggtatcgtattttttgaacctacgggattacaattattttttcaaataaaaaactgttagaaataggaggccacacacatggctgaagaaaagacattcccaatgacggtcgaaggtaaggccaagattgaggaagaattgaacacattgattacggagactcgtgctgaaatcactggtcgtatccaaattgcacgtagctttggtgacttgtcagaaaactctgaataccaatcagctaaggatgagcaagctttcgttgaaggtcgcatcaacacgttgcaaaacatgttggacaacgccgttatcatcgactcatcagaaatcgctgacgatgaagtatcagttggtaagaaggtaacctttaaggagttgccagacgaagagcctgaaacttacgccatcgttggtgccgttgaagcaaacccacttgagggtaagatttcaaacgaatcaccaatcgccgttgccttgatgggtaagaaggttggcgatcaagttgaagtcccattgccaaacggtgcctcaatggacgttgaaatcatggccgttgacttggcttaattaaatcaaataaataaaagaggctaggacaaatttgtcctagcctcttttttattattcagtttcagttgctttagcaatcacggccaacacttccttaccgtaacgttcagccttagcatccccaattcctggtacagccatcaactctgcgttattgcgcggttgctgcttggccaactcgaccaaagtacgatcattgaaaataatgaatggcggaatttccgtcacccgggccagctccaaacgccaagttcgcaacgcttcaaagaccgtccgttgcgcctcatccaaatcgtcacgcgtacttggtgagcctgcctttacacgatcatcaatcgaccgaacatcttgacgacgcttaacctgacgctctcccttcaacaccgacacgccctcgggtgagacagtcaaaccagcatactgccccgtcacacgtaggtagccctccgcaatcaggtagtcaatcaaactcatgatatgcacccgggcggtcccttggagtaacccaaacgttggcagttgatccaaattggtccattggaacttatctggcaatttaccacgcaatgtttcagctgtcagcgttttaccaaagccattctcgccaccacgtgactttgccatgcggaccacgtggctcaataccttttgggcatccgtcgtgatatcaaccgcatcacggttatccaagcaattggtgcaacggccacaatctggcgtatcttcaccaaagtaacgggtgatatagcgttgcaaacacatttgcgtcgcaccatagtttgccatttcctgtaacttcatcttctgcaagttttggtactctggcgtctgattatcactattatcaatgaagaagcgttgtgtttgtaaatcggccgccgcatacagcaagatggcttcggatggtaacccatcacgacccgcacgaccaatttcttgataataggcttccactgagcccggaatcccatagtgaatcacaaaccggacattcgacttgttaatccccattccaaaggcgtttgtcgccacaaccacgtcacgtcgatcgtaaataaaatcatcctgagcttgggcgcgcgcttggtcaggcataccagcatggtagccaactgcgttaatgcccgccgccgttagtgtctccgtcaacgcttcaacaatcttgcgggttggcgcataaacaatgcctgattcaccacgatgttcgcgaatatacttggtaataaaatcttccttactccgtttattcagccctttttcaatgcggatcgtcaaattatcacggacaacactcgtccgaaccgtatgttgaatgtgcaacattgcttccaagtcggcttgcacccgttccgtagccgttgcagtcaatgccatcactcggggcgcagactctagattattaattaacccaaccgcgttcaaataacttggcctgaaatcatgaccccattgcgaaagtacgtgaacctcatcaatcacgactaacgaaattggcaagcggttaagtaaggcatatgtcccctcactccctaaccgttcaggtgccaaatacagcagtttcgcctcttcgttcagcaggctgttcattgctgcccgatattcctcatcattttgggttgaattcaatgtcactgccggcacgcctgcctcatgcaattcatcaacctgatttttcatcaaagatagcaatggcgaaatgaccaccgtgatgccatccaacatcagcgctggaatttggtatgttaatgacttaccaccaccagttggcataatccccaacgtgcgctggccagccattacggcatcaataatttcagcttgtccctcgcgaaacgagctataaccaaatgtttgttgtagcgtctctaatgctgtcgccatgctctcctcctatttgtgtaaaatactctacgttccattatggactgctaccgaaagcgtgtaaagccaaacgaaaaagcgacccgaaagccgcttttcgcatgtgtttttagtttgatgatgttgcagatgaagtcgttgtgtttgatgacttcttagctgcatttgatgaatcagctgcattaccgactgattcattggttgattccaagtcacccgacttacccaagtgttcatcgtaatcctttgagtagaacaccttaccagtcttcaaattagccacgaagtagaggtaacccttgtcgcgatccttaggattcaaaacagcttgaattgattgcaatgatgggttgttaaatggtcctggcccgtaacctgagaacttgtacaagttatatgggttatctgacttaacatcttcattgctcaaattagtcttgtctgtatcaagcgcgtactttgtggcaatatctgattgcaatggcatcttaacgtccaaacggttttcgaagacacccgcaattgtgcgtcggctatcttcatcgattccttcacgttcaaccaaagatgcaagcgtcaaaacttggtgaaccgtcttgcctgacttcttaatcgcatcgaattggcccttcaattgggtatagtcttggtaaaccatttggttaatcaattcattaacgttcttggcatccttccagttataagtcgctgggtaaaggtacccttccaacttgtagcggatttgatccttttgatcacttgtggtctctgaatcaagcaagcctggataagcagcttgcaaacgcttaaagaacgcatcatcgttaacagccttcaagaattcatcacgggtgaagtgcgtcttagctgccacttcattcgcaatatttgaaattgtctcaccttcacgaaccgtaatcgtttccttgttgttcaacggataagctgaaccaccttggcgcaatgacttaaccatttcttgcaccgtatctgatgggctaaacaaatagtaaccagccttcatgtctgacacattgttcgtcaacacgtaattcataaaagcacgttcagagcgcaagaccttagctttgtccaaatccttcgcaatcgtagctgaatcagaaccagccttaatttgcacctgtacatccttcttactcttagcattcaaggctgagtaatccgtcttatctttttgaattgtgtagtattggtaaccaccgtaaccggcaccaccaagtagcaaaacggctaccacacccaaagtaatccaaagacccttgcgtgactttttaccgttcaatcgactcaaatcgtccattatgcaactcctagttctaattgggcttataaaaaagccgttgttactgtctagtataccagcaacaacgactttttgattacagtctttttaagattaacggatttccgcgttaaacttttctgcaagtgcagccgtaatacgttccacagctgcattgatatcttcatcaaccaacgtcttttcaacatcaacgaatgtcaaagcgtatgccaatgacttcttatcatcagccacgttttcacccgtgtacacgtcaaacaattcgacgtcgtgcaacaaagcaccaccagcagctacgatggcggcacgcaaatcagctgcgggcacatcacggtcaaccaagatggccaagtcgcgggcaacagctgggaagcgtgataccacttcataaccatccttaaccttaggcaaatcgaaaatggcgtctacgttcaactcaaaggcgtaagtctcgttaaccttgtaagtcttagcggtcactgggtgtacttgaccaacgaacccaattaacgtctcaccaacataaatgtcagccgttcggcctgggtgcatttcagcacgttcagtcgttggtacaaaacgaatgtcatcagcaaacgcatagttagccaacaaacgttcaacaatgcccttcaaggcgaagaaatcagccttttgtgcaccagcagcccaagtacgaggtaatacgttaccagtaatcacaccagccacatgctcaatttctgttggcaatacagaagcatccccatttgaaacaaagacacggccttgctcatacaaagccacatcagcttgcttacgagcaacgttataggcaacgtcatctagcaagcccgtcaacaagctaccgcgcgtttgttggcgatcttgtgacattgggtagtccaattgaattggttgcccatcatgcaacttgaagttatttgccttctctggcgtcgtcaatacgtatgaaatagcttggttcaagcccaagccttcaagatcatgacgcgtcgcacgaatcaatgcttgctttggcgtcaacttaccgggtgtcgtttcaccagttggcaacgttgctggcaagttatcgtaaccgtacaaacgggcgatttcttcgactaaatcagcggcaatcgtaatatcccaacgacgagctggcacagttacggtgaattcaccgtcattcaactcataatcgaagaacaaacggtcaaagatagctgagatttcagcctctgtgatctcagtccccaacacatggttcacatgggccgttgtcaccttcacaactggtgcttcgtagtcaaaatcttgtgcaaccacacgaccttcagttacttcaccaccagcaatttcagcaatcaaagcagccgcgtggtccaatgctgtgaacgtatcttctacattcacaccacgttcgaaacgtgttgaagcttctgagtgcaagttttgatcacgagcagcgtgacgaatggccttaggctcaaagatagccccttccaacacgatgttcgtcgtcttagccgttacttcagttgactcaccacccatgacaccggcaaacatcaaagcttcatcaccagctgcgatgacaatatcttcagctgatgcttcacgttcaacgccatccaatgtcttaatcttttcagctggcttagccgtacgaaccgtgatgtccttgcttggcaacgtatccaagtcaaaggcgtgcaatggttgaccgtacgtcaacaacatcaagtttgttacgtcgaccacgttagaaattggacgaatgcccatggtccacaaacgacgttgcaaccacaaaggtgagtctttcacttcaacattcttaacaacacgcaaaccatacttaggtgccaattcagctggggctgtggctgaaatcaaatcagctgttttctctgacgtttccgtcaattcaaacgttggcaacgttggttcttctgacaaaatagctgccacttcccaagctgtcccgttcattgagaacaagtcagcacggttaggcgtaatgcctgtttcaagcacatcatcatccatacccaaaacatgcaaagcattctcgcctggcgtcaaatcagcagcgtcaacatcgttaaacacccagataccgtcttcaaagtccttaggtgacaccttgtcatcaaaaccaagttcttgcaaggcagctaacataccgtttgaaacaacgccacgcaacttacccttcttaatcttttgaccaccaccaacgattgagttgtgcttggccaagataaccgtttgaccttcagctacgtttggtgcaccagtcacaatttggattggctcatcttcacccgcatccacttgggtaatcaccatgtggtctgaatctgggtgttcttcaactgacaataccttggcaatcacaatgttcttcatgtttgcttgtggttggtattgtccttcaatttcaactgtcgtacgtgaaatcttctctgccaactcatttgctggcaattcgattggcaaataatcacgcaaccaatttacagaaaccttcattttgtttgcttatcctttctggtcaaattgcgtcaagaaacgcacatcgttcaagtagaagttacggatatcttcaaccccatacttcaacatggcaaaacggtcaggtcccaagccgaaggcaaagccaccgtatacttcaggatcaaccccagccatacgcaaaacgttagggtgcaccataccggcaccaagcacttcaatccattcgatatcttcagggttcatgtcaggcgttaccgcgttccatgacacatcgacttcaacagaaggttccgtaaatgggaagtacgaaggacgcaaacgaatatcatggtcttcaccaaacaagttgcgcgcaactgccaaaagcgttcccttcaaatcacccatcgtgatgtgcttatcgatcacaagtccttccatttggtggaattggtgtgagtgcgttgcatcatccgtatcgcgacggtaaacacgaccaggtgataccatcttcaaaggtccagcattaaagtcgtgtgactccaacgtgcgggcttgaacgggtgacgtttgcgtacgcatcaagatttctggcgtgatatagaacgtgtcttgcatatcacgggctgggtgatccttaggcaagttcatcatctcaaagttgtacttgtcttgctccacttcaggtccttcaatgacttggtaacccatgccaaggaattgatcctcaagtgactcgatgatttgttgcaacacgtgtggttgtccttgtgccgttgcacggcctggtaacgtcacatccaatgtttcagctgccaacttttcattcaaagcagcggcttccaaattcgtttgacgggttgcaatggcctcagtcagtgcatcgcgcacttcgttagcaagcgccccaacaacaggtcgctcttcaggcgtcaaatccttcataccgcgtagcacttctgttagcggtcccttcttaccaagccaattaacacgtacttggttcaaagccttcaagtccgcagttgccgcgatttcgcccaatgcttgatcgcgcaattgtgtgagctcgtcttgtaaactcatgatctgtctccttaaaatttaaaatcaaaataaaaagtccctgcgacaaataaacattgtcgcagggacgctcattaacgtggtaccaccctacttttagtagtcaatgcgactaccctcggacattcgttaacggaaatgaaccgcaacggccttgcaaccgctgaactcctgactgaaattcagttatcatgctgatgggttttcaccgactcccactctctaacacagcccactaacttactaggtcattcaaagtttcttatattattgtacaacattctaggcactgtgcaaggggaagtcattctgtatatagttgtgtgtgtcgtcgcgttgcgacgaagcgtggaggtgcgggagtgccttcgacaaagatgacagctgggtaactccgccggcgcgagcaccggctagcacccaaataattgtgctaagagtctggttcctatcgccttatctaaccggcggtcggccgaacttgtgagttccccatctgtcatcgctacgccactcccgcacctccacgccagcagccaagaatttttctaatgatttgattttcatccaccaacattcaacgagttcacctattcatacgttcgtccgcaagtatatgactatctcacctaaataagaatatctcggctgctgacatggggctgggggatttcggagcgattttctgtgggacagagaagcccgacccgaccgctgcccgtctatgcaccaaaaacaccaggtttccagtttggtgtatgcgaccggcaagggagccacgggcagtgctcgcggttgggcgtgtcccgcagaaaatctttgccggagaaatcccccagccccatgtctcgacgcaacgcgtcgaccagaccacagacaaacagacaattaaaaaagccagcaaacacatcactgtgtctaccaactccatttgctatgcaattaggcgttccagttgtctgaccactcgtggatagcagccatcattggacgcattgattcaccgcgctccgtcaaagcgtattcaatcaatgatgaatcttcgtatgtacgacgctctacaatgccagctgcttccaattccttcaaacgctcaaccaaaacacggtctgagcacttcgttacagcttgcgccaagtccttgaaacgacgtggaccatcattcaacaaaacttcaatgatcaatccgttccacttacgtcccaaaatatcgaaagttgcgatgaacttgtcgcacaatgtgttagttaattcgtgtgatgctactgccataattatcttctcctaaatttgaacaatgtttttaaaatttgcgtttatatttacatttaataagtaatttaatcgtacacctcttcacaagattttgcacgtctaaacccttgaaaaatgtaagcagaatgcgttgctccccaacaactcattcctcacttttgatacttacattatacaactgaatatgtgaccattataagaccaaacctcggacgaaatgaacacaaactatggcgtgtttcttgcgatagtgaagaatttttggttattttctgtcaatgaaatgaaggccagttaatactaaaaataccctttgtgatacatttcgttcacaaagggtatttagattatcttgtattagtttgcatggaacagtcgttttacacgtgctgatgccggcgaaaagaattcggcaatggccatatagtcatctactaaatccaataaaagactttcacgataatgtggtaatgccgctgtagccccccacatatgttttagaatgatgtccttttccattggcgatagttgtgtaattttctccgcatttcgtaatgaaacgcgtggatgaatgaacgcatgcgttcccaattcaaatttggttgttcgccaatcataaaagaacaagtcgtgcagtataccagcacgcgccaaagccgttgcgttgagccctaaccgcagccccaattgataactgacgtatgacaccgcaattgagtgtgtcaaccgatcagagtggtggtgctgcgtgtaattagccaactcttgaacctgtgggtgtgccaataaatctttaacaatatttgaatacgctttatcacgttgccaatcctgcataaatgtcccccttttgcatgatcaacgaacaatcgttctaacttttaacttagcgcgccttcaaggcaaacatcgcaattccagctgcgacagcgacgttcaaagattctgcatccccagtcaatggaatgtacagattcttagtcgtcatcttagccaaatcagcagccatcccttggccttcgttacccatgattagcgcaaattgtgactgtgctggaatggtaaacaagtcagcagcttctggatccaattgtgtcccatacacattgatatcattttgagtgaaggctgcggtccaatcctgcaagtcacccgttgtgagtgtcatgtggaattgtgagccttgcatcgcacgcaatgcctttggtgaatatggatcaacagaaccatttccaaagacaaccccggcgaaacctgctgcatcagctgtacgaaccatcgtaccgatgttaccaggatcttgaatcgcatccaagaataaccatgcgccatcgtgaataaaacgtggctcacgggttgctgttggcaaagatacttccgcaaaaataccttgtggtgttaccaaatcagacaacttcttagcgatatccgtcgtaatttcaaaaacaggcacaccaagtggcaacgcctcttggtgctctgctaattgttcgggtgttgccataatcgcatgcaacttaccctcgtgttggatggcctcttggaccaagtgccagccgtccaataagtatgtcttacttgcttggcgacccttcttcgtttgcaacttttgccatgacttaacacggctgttttgtactgatgtaatagtttccatagttctattatacgctgaatttaagtaacttgcctatgttataatttttaaggtattttgtagcttagttgcactaagcaagctacaataattaattgacgaatttaaagcaaagagaaagaaggatatcatgccagttttggatatgagtgatgaaactgcggtcgcacgttacaacgattttgtccgcagttcaaagttcggtcaggtgacacaagaccttggttgggcccaagttaagaataactgggagcctcgatatgcatatgtagaaaacgaggctggcgaaattgtcgcagccatttcaatgttgttaactaacacgccaagtggtaaaaagtttgcttacgcttctaagggtcctgtcatggatatgactgacttagacttgtttgatcaactaattgctgaagcgaagacggctttggctgacgatgatgcctacctattgcgtatcgaccctgaaattgccttttcagaggaattggatgctgatttgcacgcacgcgggtatgaaacacgtaaccgaaacgtggctgatgaaggtatgcacgcaactatccaaccacggttgaacatggtcatcgatttgactgctaagccagaggcgaaggaaacccttgacttgtacccttcaaagacaaagtcaaagttgaagcgtccattccgtgatggcgtgacggtgcgttatgctaacgatcaagctgccctcgacgcattctttgagacgtacggcgatatggccgaccgtcacggtatttctcaccgtcctaaggaatactttgagcggatgcaggcagcgttccctggtgacgatattatgcgtatctacattgctgagcgcgaaggcgaattgctttcaactggggttggcttcaagttcggtgacaagatctggtacatgtatgctggttcaatggatggtaacatctactacgccccttatgcggttcagaccgaaatgattcaatgggctatggatagcaacgtctcattatatgatatgggtggtatcggcgaagcctcacctgaagatggcttgttcgtcttcaagcgcaccttcgttaaggatgacccacgcgaatacattggtgaaatcgacgttgtacttgatgatgcaacgtacgatgaactcgtgcgcaaataaacaatagctaataaataagcgctactaaattagtagcgcttatttattttgtcgttaaaagacgtttatgtaactgactattgcaacatgatatgcttatctcaaaagattgggggcattgtcgtgttactggatttattagggattaccttggaaataattatcgattttgtcgtcaccgctattacacccgacagacaaaaataacgcaaaataggcagccactatgcgggctgcctattttatatattgcatccttacctactaatcaaaacgttaattagttaacaacgtacgccaaatccatgacaaacgcggttgaggcgcctgaatgcatttttggaatggccaatgccatatttaatcgatattgctttgtcgcaccagatgcattaagctcatttgtccgaataccaggctgtaacaaagtcgtacgatgtccccatgcagagccaccgtcatcaaataacatgccataaataccgttataaattgagacctttaatcccgtcatcgtaaagaccgatgaccaatcttctggcgagttccgacttcccgaagcaagggtttgccattgataataacttgttgtaatctgcgtcggctcatagtcaacaaacttatcagccaacatgctatccgtatcgcttaacccattggctttgcgtattgcagctaacatatcgttaaagcttgtatgttgttgcacaccataaccttgttggtcacgatttgtaatatcagccaaggttcccttcaacataaaatcagatgtcttcaaggtatctaagcctacagtcttgcgatagccatttatcaattgaacagcgtaattcgtcaactcttgattttgcgctgtcgttaaccctttcgagatgtcaacggctcgatcaccatcagtcggtttaatgcgtaagtaacccaacaacttagtgtcactttgatcgcctaaattacccgccgaagttttaccaaaggctggaacagacaaactcgttggtaattctgctggattgcggactgtggcggacgacgttgctgacaacgcttcagaataaatactcatgtactgtgaatttaaattctttgcgacgtcagcccgcgtcaacaagttatacccactatacttcgttgccatgtcacgatttgtatatgagtccaccatcgtattcaaagctaatgaccccatcaccataccattgttttcttgtggtacagcagaacgtgttgtatagctaaaattagcacgactcgctgataaataacttgtcgccgatgagatggccttcaagttattccgaatagccgcaactgcgctattcgtactacgaccatcatctcgcacttcacttgtaacgtaacttaccatggttttatttgattttgctgcacttagttgctgatttgcatttgataccgccttgttccccgcggtcgcatacgattgcgttttccgtaaggcacttgtcgcagcagcagaattagccaccttagcagcagatgttgcgacagacttgtaaaccccttcttttttcacaaatgacttgagcattttttgccgattggatatgtcagccacttgtttagtcgccacagcactagctgacgttgcaactgttgtggcactcgtagcttggctgacaatttgtgccgtcttgccattcgtcgccgcagccgaaccagcactgtacgcttttacagcgtacatattattgctgatagcatacgcattacccgctactgatcgggctgctgaacttgcggcaattgcctgtttgccagcactagctaccaatgttgcatctcgcttaatcgccgctgactgcacgctcacagattttgcaattttcgctgccgaggtcgcggttgcaatcgcttttttcgtcgctgtctgccgtcttgttgcagctgaagccggttgcgcgacaaccaagccactgagcgcaacaccaaataaggttgccacaacccataacttgcctgccttatatagcttctttctcgtcccatctcgttgaatcattttacccactcctaatttactcaaaagctagttagcctttaacgtggccacaattaccaattgtcaccccagccagcttcgtaataaaacccactttaacttcattacttatcgatagtttactaaaagttccatgctgtactcattttgtcctaaaactgagttaattaaccttgtttttactttttgtgcataagcaaaagaaaaagcgactagaaccgaaattctagtcgcttatttttatcagtaattattacttgctaatctcaatgtcattgttcaagaatggcaactttgaacgcaagaatggcgttacccagtggtccaaaccgatacgtgctgagttgtaaccacccatcaagatgaacatttcgatgaagatgaacgttgggttaactgagacaacaccggcacccaagtatgagaagttcataatcataccgaagaaggcagctgccaaagtcaacgtaccgaagatcaatcccaaaccaacaaacaattcaccccaagcaaccgcaaatgagaagaagccagttgagtgaccgtggttcgtagccaagttcaagaaccagtcataccaagggaatgccttgtgaccttcagggttcgtaactggctttgcaagcgccatgttaatcatacctgcagcgttgaaaccacccttagcagtaaccttttcaacaccgtccattacccattgtgtacccaagtaaacacgtgcaatcgtcaaaatccacattgcaaccttgttgttacgcaaccatgaaatcataataatatctcctaaataatcctaaataaaatatgtgaatcaattaacatatataactataatgtacttacataaatttagcaatagagtattcacactttcttcacacatgatgtttcgttcatgaaacaaaaagcgacaaacacctttaaataggcgtttgtcgctactgaaaaattgtgaattaatgtacagaaatgtattatttaacactttcttacaaacattccgataaatcattcattgtgaaaagaacactttgttacttttagtcaggattttgctcagcaagcttccaacgtaggtaagcattaatgaacggatctagatcaccatccattacgccctgtggattaccagactcataattagttcggtgatcttttaccattcggtatggttggaagacatatgatcgaatttgagacccccaaccgttttctagttgctcaccggcaattgatgcacgttccttttccttcttatccatctcaagttggtaaagcttggcacgcagcatagcgtaggctgtatccttgttctgaaattgtgaacgttgctgctgtgaggcaacgacaattccagttgggatgtgtgtcaaacgaacggctgatgatgtcttgttaatgtgctgtccacccgctccagatgcacgataaacgtccatcttaacatcggctgggttaatatcgacgtccactgaatcatccaattctggcatcacgtcgattgaaacaaaggacgtgtgacgacgaccagctgagtcaaacggtgagatacgaacaaatcggtgcaccccacgctctgagcgcaagtaaccgtatgcattatgccccgtaatcatcaaggtcgcagaatcaatgccggccacatcgccggggtgataatccatgatttcaaccttgaaaccatggcgttccgcccaacgggtatacattcgttgcaggttagcaccccagtcagcggattccgttccacctgaacctgggtgaatttcaagaatcgcgttgttcttgtcataaggttcattaagcaactgagccaatcggtaagattccaagtcagcggctaacttttcaagatcggcttccatttcggtttgcatatcttcatccggcatctcagctaacagttccagggcggtttcaacattttctacaccggccgtcagattcaaataatcatctcggcgccccttcaaaaggttattcgcgtcgatcactttttgagcagcaacattatcattccaaaaatcaggttgcgccatgtcgtcttcgttcgcggcgatttcgtcattcaaagcatccaaatccaatgactcaccaaatcgcgtaatttcttcgcccatttcagctaatgaacgacgtgcttctgaaagctccattattttctcctctttgatatgaaaaaggaaagccagctacccgactttccccgttaaattcgtgtttaggcacgcaagttttgacggatttctgacttcatgaacaaacgcgtggcgtcatattcaatcctagcaatcatctcttcaaacatgcggaatccttcgttttgatattcaatcaatgggttcaactgaccgtaaccacgcaattgaatggcatcacgcaattggttcatggcatccatgtggtccgtccattgggcatccacgacacgcaagataacaacacgtgtgaattgcaataattgctcatcgtcaaccaaagcatcacgcttttgatcatagacttccttcgcacggttgtacaaatatgccttaatatcgtcttgtgacttgccttgcaaatctgacacgtcaattgaatcatccggcacaatgacagccccagcaaaatcaacaattgactgcaagtcccattcatcttccttacccaaggcatgacgctctacaacacggttaatcgttcgctcaaccattggcaaaataacattgcgcaatgattcttcttcatcgataacttggttacggttagcatagaacgtgttacgttgttgtgacataacatcgtcatactgcaagacgttcttacgtgagtcgtagttattaccttcgacacgcttttgggctgattcaactgaacgtgtaatcaaacgattcttgataacggcgtcttcttcagcaaggttcatgcgttccatcaaggtcttaatacgctcaccaccgaaacgaatcatcaaatcgtcttccaatgacaagaagaattgtgagtatcccttgtcaccttgacgaccagcacgtccacgtaattgattatcaatacgacgtgattcgtgtcgttcagttccgataacagcaagaccacccaaatcagacacaccagggccaagcttgatgtcagttccacgaccggccatgttggtggcaatcgtcacggcaccacgttgaccagcgttggcaacgatttcagcttccttggcgtggttcttcgcgttcaagacgttgtgtgggattccttcgcggtcaagcaattgagacaacaattctgacgtttcaaccgcaaccgtaccaatcaagattggttgccccttctcgtgcagttccttaaccaagccaacaaccgcgataaacttagaacgcaagttagggtacaacaagtctggttcgtcgatacgttgcacaggtcggttcgttgggatttcaacaatttccatgttgtaaatctcacggaattcttccgcttcagtcttcgccgtacccgtcataccagacaacttcttgtaacgacggaacaagttttggtacgtaattgatgccattgcacggttatcttcttgaatttgcacttgttccttggcttccaaagcttggtgcaaaccatcagagaaacgacgtccttcttgaatacgaccagagaacgcatcaaccagaacaacttcaccatcgcggacaacgtagtccttgttgttgaacatcgtgtagttggcacgcaatgattgatcgatgtggtgagtcaaagccgtgttaccagaatcgtacaagttgtccaagttaaagtaacgctcagccttcttgataccttcatcttgtagcaaaaccgtctttgattcttcgtcgaccgtaaagtcttcttccttcgtcaaagacttaacaaaacgatctgctcgaatgtacaattgcgtactctcttgggcaggcgcaccagagataatcaacggtgtacgcgcctcgtcaatcaagattgagtcagtttcatcgaccaacgcaaagttcaatggacgttgcacacggtcttccttacgggcaaccatgttgtcacgcaagtaatcaaacccaatttctgagttagtcgtatatgtaatatcagcgttgtaggcggcacgcttctcatcaggtgacatttctgacccgttgatcccaaccgtcaaaccaagccacttgtacaattcacccatttcctcaccgtcacgagcagacaagtactcgttaaccgtgacaacgtgaacaccttcttgtggcaacgcattcaaataaaccgccatcgtggccgtcaaagtcttaccttcaccggtacgcatttcggcaatgtttccaccatgcaaaacggcagaacccatgatttgcacacggaatgggtacaagcccaatacacggcgtgcaccttcgcggacaaccgcaaaggcttcaggcaaaatatcgtccaaagtcttgccgttttgcaatagctcacggaagtatggcgtctttgcttgtagttcttcatcagaaagggctgccatttcatcggcaaacgtctcaacttgatccgcagtgcggttcaagcgacgcattgttcccttatcactttcaattattttacgtaatggattagccatatttacctattccctcttggtcttcatcggctgatacagccaatggtgctaataattattttaacacactctaggcgctgattgtgtgcgttctttttgaatcctgtcgggcatgacattggtcgtcgcgttgcgacgaagcacgcgggtgggggattggcttcgacaaagatgacagctgggaaactccgccggcgcgagcaccggctagcacccaaataattgtgctaagggtctggttccgatcgccttatctaaccggcggtcggccgaacttgtgagttccccactgtcatcgctacaccaatcccccacccacatgccagcagccgagagctactctaatcatttgattaccatccatcaaaacacaaatggatgaactgttcacacatttgaccgatgatatatggctaactcacttaattcaaaatatctcatctgctacaccagccttgggttgaaataccagcaacataccacatggtcggcactattcagaaaagcacatacaagcatttttctgattgtttaattctcattcaccaccgtacaaaaggtcgagctgttcacacattttttctgtgtatgactatcttagctagattagaacatctcggccgctggcatgggactgggggatttcggcgcgatgacccacgggacaaagaagcccgacccgaccgctgcccgtctatgcgccaaaaccccaagtttccagtttggtgcatgcgaccggcaagggagccacgggcagtgctcgcggttgggcgtgtcccgtgggtcatctttgtcagagaaatcccccagtcccatgcctcgacgcaacgcgtcgaccctgaacgccgacaaaaaagcccagcaccgaattggtactgagctaattagttgttaaattttacaagaattcgcggatgtttgcgattgtttgctcgcgtcctagcaattctagcaattcaccaaggtttggaccttgctcctcacgcgtcgttgcaatacgcaatgggttccacaaagcacgggccttgacgtccatttcgttttgaatttcgcggattgccgtcaagatagcagctgccgtgaacaatggcattgcttcaatcttctcgatgaacaagttcaacatggctggcacgttttcagcagccatccattcctttgctgaatccgtaatagcatcagcagctggcatctcaaagaagactggctttaccaatggcacaatttgtgacgtgtatgaaacaccatccatgtatacattcatcactgaacgcaaccattgcatcttttcagccgttaactcggctgggttaaccaattctgacttaacaagttgttgcatcaacttgtcaaagaccatgttttggtcagccgtcttgatccattggttgttaacccattcaagcttcttgttatcaaacttagctggtgactttgacaaacgggcttcatcaaacatcttaaccaattggttcttgttgaagatttccttttcacccactggtgaccatcccaacaaaacaatgaagttcaacattgcttcaggcaagtaacccaattcacgatattgctcgatgaattgcaagattgactcgtcacgctttgacaacttcttacctgtctcagcgttgatgatcaacgtcatgtgaccaaagattggcgcttcccaaccgaaggcttcgtaaatcatcaattgctttggcgtgtttgacacgtggtcatccccacgcaatacgtgagagatttccatcatgtggtcgtccacaacaacggcaaagttgtacgttggcataccatcagccttttgaataacccagtcaccaccgatagtgtttgagttgatttcaacatgaccctttacgatatcatcccaagcatatggcttgtcttctggaacacggaaacgaacaactggttgcaatccctttgcttcagcttcagcttgtgcggctgcaatttcgtcatctgacatgccagcatattcgtaaacgtagtgtggagcttgctttgcagcaatttgtgcctcacgctcagcttccaattcttcagacgtcttgtatgacttgtacgccaaaccgcggtccaataactcttgaatcaatggcttgtaaatatccatacgttctgattgacggtatggaccgtactcacctgggttggctggagattcatcccagtccaagcccaaccatgccaagttgtccaattgtgacttctcaccatcagcgatgttacgcgcttggtcagtgtcttcaatacggatcacaaattcacccttatagtgacgtgcgaacaaccagttaaacaatgccgtacgagcgtttccaatgtgtaggtgcccagttggagatggggcgtaacgtacacgaatcttcttttcagtagtctcagccatgctagtctactccttttttctgtttataataccgcttactaatataccgcggtttttaacgactttcaatgttaagtccttaatcgacaaccacaccaaaaatcatacggccagcatctgtttgtaatgccgacgtcacttcaaccgtcacggtctcttgcaaatggtcacgaccttcttcagccacaaccatcgtgccgtcatcaagataaccaaccgcttgcttgcgttcagtaccatttttgaccaaggtcaccttgaaacgatcaccaaccgcaacccgtggacgcaatgcgccagctaattcattgatgttcagaacctcaacgttttggaactttgtcaccttattcaagttgtaatcgttcgttaccaaaataccgttaacgtccttggctaattgaattagtttttcgtccacttctttaatttcttcatagtcgccctcccacatttcaagtggaatagcgtccgtttcacgcaactcattcaagatatcaagaccacgccgaccgcggacacgcttcaatgactcacccgcatcagcaatgtattgcaactcatacagaacgaagttgggcaccaacagtgtcccttcgataaagccagtcttcactaaatctgcaattcgaccgtcaatcaagatattcgtatctaaaattttatagtggtgatagtttgtttcctcatccgttagcacgtcactttgattagctgaacgacgtggccgtacccgcttcgtgacgttatttaagttgggaattaaattccgccactcatcgatccgcgttgtccccaaacggaagcccaaataccccaacagcaccatgacgataactggaataactgcacttaaaaagaaattattcgcccgctgcaacggtacggtgacaaccaccgcaatcaccaagccaatcaaagttgataatgaaccaatcagcaacaagagtggtgactgctggttcaaatacgtttcaattcgcttaatcccctgatcgattggtcgccataaaggtatgctcaagatataaaacaatatgccaccaataataaagttcacaattgggttatttaaccaaatctgattatgttcacccaaaatgcgccaaatgattggcaatactgttatcgcgagcgcacctccagcaaccaaaaaagctacctgaattattcgcctacgcatagtttcccctttaaattaatctaatgccaaccgtaaagcatctgccaatgtggccacaccgataatttgaatgcccggtatatctttcattgtatcaactgaatgctgtggcacaaatactcgtttgaaaccaagtttttttgcttcaagaatgcgatcaaccacatttggcacccgccggatttcaccagtcaaaccaatttcaccgacaaatgcgtcagttgcccgtgttcccctatcccggtaactcgaagcaattgcaaccgcaacagccaagtcgattgctggttcgtctagctttacaccacctgcagcacgcacataggcatcttggttctgcaacaacaagtttgcacgcttttctaagacagccatcaacagtgaaatacgattgcgatcaatgccggctgctgtgcgttgggcattaccaaagacggttggtgtcaccaacgcctggacttcaaccaaaattggtcgagagccttccatcgcaacgaccactgccgaaccactggcgtctgagagacggtcttccaagaataaaccagatgggttcgtcacttctgccaaaccaccctcgttcatttcaaagacccctaactcatttgttgaaccgaatcgattcttaacagctcgtagcaaccggaaactacgctgattatcaccctcaaagtaaagtaccgtatccaccatgtgttccaaaatctttggtccagcgatggcaccatccttggttacgtgaccaacaataaaaattgtaatcccgttcgtcttcgcgatttggagcaattcggcggtcgtctcacgaatttgtgcaactgatccaaccgccgatgaaacatctggttgttgcatggtttggattgagtcgataatgacataatccggctttgtttcatcgattgccttacgaatttggctcatgtccgtttctgggtacaagaagaaatccgcatcgccacgaactcccaagcgttctgctcgcaacttaatctgtgaagcactttcttctccagcgacgtacaaaatcgttccgcctgaatttgccaactgacttgatacctgaagtagcaacgttgactttccaatccctgggtcaccaccgatcaaaaccattgacccaggtacgattccgccaccaagtacccggttaaattcatcaatttgcgtatcgacacgtggcgtctcctcgatgctaacttggcctaatcgctcaaccttcgcaatttgtccagccaggttaacgcgtgactttcggtccgccttttctggttgaataacttcttcaacgaacgttccccaggcaccacagttagagcaacgtcccatgtaacgttgtgaaacatacccacagttagaacatacaaactgggtttttgtttttgccatttctcctacctctcttaatgtacgccggaactaccaaagccccccgtacgatcattcttctcttgtgttgcatcatcatccgttaccaaaaacggcataaaaatgccttggccgatgcgttcacccttttttagatgtatatcttggatgccccaattaaccatctgaataaagatttcaccctcattcttatcgttatccacgtagtccgcatcaataatgccgaccccatttggcaaaatcatcccacgcttcaacggattggatgaccgattggcaatcattaaatattcattttcacccatgtaagctttaataccagtcggtactaagagaggcttcaatgttgctgtcgcctcttcataatcgtgatctgtcaattgtcgcttcatatatagtgacgccaaaatcttaataaatgggagcttccaaattgatggtagcgtaaagtcctcagcgacctcaaagtcgtatccagccgccattttcgttgcgcgttggggaagattaagccccgccgttgcgtattttgaaacaactgcaaatccacgtttcataattatcccccaaagttagttatgttttaagtatatcgaaaaacgccccaaattaaaaagcacaccggttattttcggaatgcttcaactaactcttaacttttggcctgcaaagcctgatattccggattcctaaagaacgccattctagcatatgaacaaaccggtcgtagtgtgacttggtcaacttgggctcgccgaacaacttcagctaacaactgccccgcaatcccttggcctcgcaatgccggatccacaaaggtgtagtcaatcgaccacgtttgcccatcgttgatcgctggaaataggatttctgcgtcgacttggccgtctgtttcatgatataggcgtcctggttcaaatgtaaattccatattgtcaccccctcataatcattatacccgaccgtacctaaaattaacgtaaggagccaataacatcaggcaaccacgactgggtcaccgctttgatttgcacaacgtcatttagtatatcaaccgtgatatatttcccaccgcctaagtacacaccagccgccgttggtaccgctaggctgccccaaactaagatatcccccggcatcgattccgctaaggtcacttgctgaaccaaggtgaactgcttggcaatattttgcggaaaactgacgccaaatacgtgattatagacatattgaatcaatccgccggcatcaaacccttctgcaggtgtattgccttgcaattgatacggccgaccaagtacactgcgcaatgtttgcccaatgttttcgcgtaaactcgccatgatcatttgcatcatcacgcgttgtacacgggcccccgccattttatttttaaattcggcaaaggtaatggcaaaaggggcctcacctttcgggacatcaaatcgcatttctgcgtcaatctgaccaacatcatcagtatgaattacccggccaggcgttagttcgaacggcatcacttttctcctcgttatacaaaaaagagcccacacttgcgagctctcattaaatctctcttattggtgaatgaacaacaaacctgacgttggaattgtacgctcgtgatacaacattcctgcatagtttgcttctgaaatcgtcactgtaccatcagcgttaactgaatcaacgaccgcaacgtgtccgtatgatgaagcaccttgaacaccagctgcaaagtaggcaattgagccaaccgttggtactgagttaacagtgtgaccagctgcaaccgccgttgaagcccagtctactgcgttaccccagtagttaccaacccagttcaaatcacccttaacgtaccacgtgcattgtccgtatgggtacgtgtttgttgatgacaccgtgttgtttgaatttgtgtagccgttatcaacagtgccccagttgttgttagtgttagcagaagattggctattatctgtagctggcgctgatggtgttgcagtcgcagcaccggcacccgaaatcttcaatgagtcacctgggaagatgtatgaatttgcttgcaacccattcaatgacaacaattctgacaaagtcatgccattgctgtttgcaatgccccacaaagaatcaccggccttaaccgtgtacgttgcgtttgaagccccagcagacgtcgttgtgtttgctgatgcgttgttgtttgttgctgctggtgcagcgttgttagctgatgtcccaggcaattgcaattgttgtccaacaaaaatcatgttgatgtttgacaatccgtttgctgaagccaaggcatttaccgttgtattgtgcgccgttgcaatcgcgtacaacgtatcgccggctttaacagttacagaatctgctgatgcaacaacagatgatccagtcaacgcagcaacagttcccgcagctaccaataacgtatttttaacagatacattcatgtttatgatattcccctatcaaatatagatttattaaacgtaagaaccaaccaattcttaatcttttctttattatctttattatttgtacgttatttattctacgcgaaataatttgcacttcaaggcacaattcattggtttacaatgacgaagtttgcattagtattacaaagccatattttgcgtaaatattgccataattttcgcgcaaatttcacggtcacaaaatgtttttcacaagtgttttcaaaatttgaatggtgtgacacaatcccacaatcacgacgccaagtcagcctgggcataacaatcaggtgtgacacgttgtcaaattatctattttttgtcatctgaatcaaaaaaacgaccaatgtcacaaagaatcggtcgttttttaaattttatttaaaattcaatcgcgagtttgccgttaactttgccggcggccactttttcttgtgctgccagaattgtttcagccgtcatgccagtcatcgtctccgtcaaagttgtccgtaaaacaccttgatctgctaacgtcgctgccaaagctagggcacgaccctgtgtcgccatgttgaccccataattagccttggcaaacataaattcccaatcgagggatgctgccttatttttgattaacccaaccggcaaaggttccactgactccacaatggctccgatgtggccaaacggtccaaccaaagctgctgcttgttcaaaatgggcttccggggcatgcaaaattgcaatgtacggtactaaatcaaagcccaagctgtgcatatccgccacataatcacgtcggtggttaaccacatgatcggcacccaacttggttacccagtcgcttgtttcttgacgtgaagccgtcgcaacgaccgtcatccccatccactttgctaattggatcatgattgacccaacgccaccagcaccattaataatgagaatcgtttgaccctttgcactattttcagcaaccgtcaggccgaacttatcgactagtaactcatatgccgtcaaaaaagtcaggggtagcgcagctgcttcagcgtgcgataacgttgtcggcgctttagcaaccagtgctgcgttgaccgcttgcaactctgcattcgcacctaaacggcccaactgaccagcgtaaaatacagtatcgcctaacttgaaatccgtcaccttagctccgactgccacgacttcaccagtcgcatcaaaacctaaaacatgggacgacttatttgcgactgccgcttgacgttgcttaccatcaaccggattaaccgccacagctttcacacgaacaagcacatcttcatctgaaacaactggcgcagggatcgtcattacctcgagtggttgtgcctcatttgaagtggtcacaactgcttgcataaattcgctcatctttctttacctctacttttcttactcagtcattgtaccgcctttaccaaaaaaatggcagacaattgtgtctgccataatcttcttaatcgtttgtgttaccttcagccgcagtaacaccttcgcgaagcccgttcatatcgagatggtgttcacggaaagcggtattttcaattggcaaatgcaactgatagtcagagaacgccaccagtgaccccgttaattcaggcgcctggaattccaagacgtggcccgcaaattgacgatcatcactaataaagtgaacgtgccaaccagcagctaccacaccatggtataactcaggtgagtaatagccaaccagcgtaccagaaacattttcacgttcgaaaactggttgttgcttggtaatctcaagcaatgatggaaacggttcagatgccttgggtgcaatacgcaccttgatgtgtgaaaactcaccatgcaggccgattcctgaaaaattattgtacaagttgtattcattaatgacgtcaacattactcaacgtaacatctttcaaggtaatcgcctttgactcaggcccatgagcctggtgcacagtcgcaaaaggcaccaaggtcgacatgtccgtaatatgattaactttccctgatgactcagcttggtaaacctcaccattcaaaatgatgacttccccatcgacaccgtgtaacgtaccgatacctgtatcaccatgttccttcagttcgccgacagttatcgtaccgcccaacaatcctgccatcaatgcagctaacgtactatgttgataaaccgttgccattattcgattcctcctatttttttacaaaaaaggggcgtccatgaccggacaccccctcatcattagatttctgattcaatcaattgtgacatcaattcgaagttgtgtgagtaatccactggtacttcaacaacaactggaccttcagtcgcaaatgcttcgtccaagacggcgtccaattggtctggcgtatcaacgcgcaatcccttggcaccagccgcttcagcaaacttcacgatatcaatatcagcgatcttaacaccagctgacttaccatcgtacttcatttcttcttggaacttaaccatgtcgtagtggtgattatcttgccaaacgatgtgtacagtattcaacttcatttgaacagccgttgccaattcaacacctgagaagaagaaaccaccgtctcctgatactgaaactgccttagcatttggacgcaccatcgccgcaaccatggcccatggcaaaccaacacccaacgtttgcataccatttgaaatcaagaagtggcgtggtacgtatgacttaaagtgacgacccaaccacaagtagtgtgaaccgatgtctgacgtcaacgtcatgtcatctgtcatgtggttttgcaatgacttgataacattcaacgggtggttcaaaccagcatcagctggcgtgtacttaggctcgtcagctgcacgcaaagcggccttcaactctgccaacttgttttgtgaagcgactggcaactcgtaaccagcaaccttttccttcaagaaggccaaggtgtcggccaacgtaccaatcaattgacgctctggcgtgaagttgttatcaatttgaacagcagccgtatccaaagcaacgatacgcaaatcagcattcttgttccagttacgtggctcatactcaattgcatcgtaaccaaccgtaattaccaaatcagattgggccaacaattgatcacccacttggttacggaagaagccgatacgtccgaagaaagtcttttcttccaaatcacgtgagataaccccagcaccttggtacgtttcaacaactggtaacgtcgtttgcgtcaacaattggtgcaatgcttccgtagttgcgtcgtctgatccacgtgcgccgaccaagataacaggcatttcagcttgcttaacttgctcagccaaccaagcaatatcagtcaatgaggctgaacccatacgagctggctcaacacgtggcaatgcattagcttcaacaattgcatcgtcaacatcttgtggcaaagaaacaaaagcagcaccaggcttaggaccattggcttgcgcaatcgcgtttgacaagatttctgaaatgttgtttggatcttggatttcaactgaataattcgtgattggctcaaacaaagcagcagatggcgtgctttggtgtgtcaaacggtacaagtccttacgaggtacttgtccgccgatggccaatactggatcgttttcagcgcttgccgtcatcaaacctgaagccaagttaccaacaccaggtcctgacgttgcaatcacaactcccgtctttcctgtaatgcgagcaaatccttgtgccataaaggcagcgttttgttcgtgacgcgtaacaaccaacttaggtgacacagcaccttctgctgggtgttccaacgtttcaaacaaacggtcgatcttagcaccgggaattccgaataccaaatcaacgccgtgattgttcaagctgtcgacaactaggtcggcaccatacttcttcatctcagccatgagtttaatacctctttaaataattgcgtaataatattaataattttcattgtacgctttctttgtaaaaatgagtagtcacaaaacttattgtgaaaaatagcattataaaccagccccaccgagctaaagatgtggattttaaagttggttagtttgtgaattttcgacaaaaagacgcgactactcaaattgaatagtcgcgtctttcttaattactaatatttatttaggcgtccaaacgggcgaaaccaccttcagcaacttccttcaaagtcttagctgaggctgccatcttagcagcttcttcttcagacaacgttgcttcaataacagcttcaacaccgttagctccgataacagcaggcgttccgatgtaaatatcgttcaaaccgtattgaccttccatccaggcaccaactggcaagaccatcttctcatcgcggaagattgctcgcgtaatacgagccaatgacgttccgataccgtagaacgttgcgcccttacggttaatgatttcgtatgccttgtgtgctgtgtcgtacaagatttgatccaaatcagcgtctgagatacctgcttcagcagcccacaacttcaatggacggccaccgatcaaagcttcatcaaagttagcgaactctgaatcaccgtgctcacccaaaatgtaagcatcaactgcctcaggtgagacattgaacttctttgccaaagccatgcgcaagcgggccgtgtccaatgatgtacctgatccgaagacacggttctttgggaagcctgagaacttttgtacagccattgtcaaaatatcaactgggttagcagcaaccaagaagataccgttaaatcctgattcaacgattggtgacacgattgacttgataatcttcaagttcttgtcaaccaagtccaaacgcgtctcacctggcttttgtggggctccggccgtgataacaaccaagtcggcatccttggcatcgtcatatgaacctgagtagacattcttgttaaacgtccaaggagctgcgtcctccaagtccaaagcgtcaccttccgtacgctccttcataatatcaacgattaccaattcttcggcgataccttgttgcatcaatgcgaatgcgtatgatgaaccaaccgcaccgtctccgacaagaacaaccttttggtggtgttgtgccatgattatattcctccacaattacttaatataagtttcaaatcttttatagtttagcataattcacttacaatgtgaatatctgtacaacgttcgaatagcgacatttcgcaacgtgtgtggtacaaattagtcgatttttccatttgtgaaacatttattcacaaataaacgcaaaataaaaaggcgcttccgaaaaatcagaaacgtctttccgttatcactgggcatactgggtctaaaccaaatagcctaaaaacgcctgtgtaataggcttttgagtaacggaaaatctcataagtacaccggcaagtacaccggcacataaaaaacactaaaaaattgaacgctcaactcttcatgtctgaccacttggccaatagtccggtggtcagtttttttgtacctgctaggggatgaacttgctgacagtgccgtaccgttcaaccccaaaaaataataataactgcagcgtgttgaagagacggcactatttgatattcggttacttcctaagcaacagggcggggggtataaacgattttcaattatcaatcagctaattactcgttgaaatataaaacgtctcacacacgcccctgtggcttctcacgcaatacgttacgccaccactcacaacttgctctcttacgtatattcaaatgctactcctgtcggaaaataatagccgcatagagatagtcatgttcaaataatctactatcctcttataactcgctaatcatttttttgatagatttcaatgagtcatgatcaaatacctgtacaggttgatccattctttttatatctatttctgtcggtgggtaactagttccttcgggtttaagtattgctatcctgtattctctttggcctttatatttcaatctctttcggaatactaaagacacagcatcttcatctctaaacggtttatctgtatattctataggtccgctatatgctcctctgctattagtttacagggcagagaaaaatctgtccgtaaatctagcataagagcagcttgctaatcgccttcattttaggcggttgcgttggtgttgtgggtatgccactttttgttgctggtgctaacgctgatcgacgagattcaaacaagtaataataacaatgggcaacgattctatcacgctagagtcgttgaccattttttaatatgctgaaaagaaacgctttttcttaattggtgtttggtgctgacgagataaacgctcaccgttgaccaacgccttggcgttatcatcaaattgttttgctgaatcagagccatatgctgcttttagtttatcgaatgcagatgtcatttcatatttgcgacctggaatatgatgtgcatctgatgcaaacaagtgtgctaacccattagcgataatatcttcactaaaggccgtcaccgctttaccaaatgtaccaacatatgaactagcggtcacttgtgcatatgccccacgtgacaccatgtcatacaacaattgtggttccttcattaggcgcgtgttgcgttctgggtgcacaatgattggtaccaaaccgcgttgttgtatttggaacaacatatccatcgtaaatgctggtacatcatctgatgggaattcgattaagatgtaagttccctgctcatctgttgtgagaatgtcgccgtcatccaacgctgacaataagccaccattgatgcgaacctcttgcgatgggaaaaccgtcaatggaatattcgcattgttcaattccgtctgaaaatcagccgttagcttaatcacatctgatgcatgattaacataacgtccgttcatatggtgtggtgtcataagtgcgtgcgtcacgccatctgcaaccgcatcacatgccatctgcaacgaaacgttaaggttctctgaaccgtcgtcaatgcctggtaataagtgactgtgaatgtcaatcatattcgtctccttaaaccttctctccttctttaaggataccctaattattcacggattgttatataattattcatgttttgaatacattttaaggagtttttcccatgattaaaaaggtgttactttggattttgggtatcgctgttaccctgattgtgattggtggtggcgtcgctgtattcgcgctacacaacacaacttcgaagattcactcgatggatagctcattgagcaagcgtccgctggtaagccagtttcctacctcttgttgggaactgacaccggtgcattaggtcgcacggaaaagggtcgtaccgataccatgatggtaatgacggttaaccctaatacgaagacaacgaccatggtttctttgcaacgtgatactaagattactattgatggtatgactgaaaagttgaacgcttcttatgcacttggggacgccaagcaagccatgacaaccgttgaacaattgcttgatattaagcttgatggttatctgttggttaatatgaaggggatggagcaattaattgatgccgttggtggcgtgactgttaaatctcccctaaccttctcatatgaaggatactcatttactgaaaaccaagatgtcacaatgaatggtacggaagcattggccttctctcgcatgcgttacgacgatcctcgaggtgactacggtcgtcaaattcgtcaacaattggtaatcgaagccgtcatgaacaagttgaaggccgatccaaggtcagcgctgaacaacgacttccttgatgctgtttcagataacgttcgttcaaacatttcactgacttcaatgcgtaacttggctaccaagtaccgtgatgcaggtgaaacaatcaaccgtgaccaaatgactggtaccggtgtgatgattgatggtgtttcttaccaagagatgtctcaagatgagattactcgtgttcatactgaaatcgtgaacgcgggtaattaacataaacagctagcttttgtaagaagtagttgctcaaaatctgcaaataatccatatgtcacccctctaaatctatcgtctacatttaagcgataaaagccatccggcagactgaatcaaaaactcagtctgccggatggctttttgttgaaattatttacaaaagcaacaacgcggatcgttttaaaatctcaagttcttcgcgaagtttggcgttttccttttgtaatgcgtttacatcagcttgcgtccatttttcgccgtccactccgtggactgtgtacacccttataatttcctgttttgagagtttagacaattttttccaataatcagagaagatataaattgcatgtccatatatggcggaatctaaaatatatatttttttgttttcaaagcaaaaaaccacatagccctttataattggcgattccccgatattcagcatctggtttaaagctttcaatataattaaatcgctctttcattaaatgtttttcactttcagaaacattagaatagttttttccatttttaaaaacatttcaaattactaccatcgacaatctctcattagtgatttcttcttttcataaaatcagttacataactagtcacaactggattctttaacaagaataatattccaaagtaccccaacactgaaccaaccactaatactataatgttaatccacattgatgagacacaatattgaacaagtgagcaataaataacaataaacaagcatccagtaacagaagtaaacatggctttctggttatctttaacaaccataatgtctttgacaatatcgaaactccaatataagttcaatgacattgacaaaaattctgataagactgttgttaacgacgtaccatcatatgacattataggaatcaaaacaaaatttaacgcaacattgaaacatgccgtaatcaatgttgtccttaatagtaatttttctctttttgatgggattaacacacaatcagagagaatccaactaaaaatagaaaagattattgcccaagctataattcgaagagccatctaccatcgtcaatcttttcccaatctaatgtcacaccaattcccgactcttctccagtgccacttcgatcgtcttgttcatatcataatacttgtcatccgccgaagattacattcggttcctgatcggccagctatttcttattctacttctgaaacatacactgtttcttgcttttccatctgaatatttggaacaacgtcatgatagatcaactgtcggaatgccaacatcatcatattgtaatcaatgttcatccaaagtcgttcgctgattccgtatgcaaagagaaagaaaacagcaatagccatagggatattatcatattggtacagatcccttatcagtagcatataagcaactgtaactgcgataaaaacaaggatacctgagcatattgccaaataggcatataagttgtcacatgtccggtttccaaaagaaatactgtgtcccagaatagtggggccaagaagttgattgtaataaacaacattagtaattctgcctgaaaaagccgaatccagtgccttcattgtctgggaacccgattccatcatatgcgccgatactgcggtcagcacagcacatataacatagttcagctgcataaaaatctgccatccctttttcttgaatgcattcggccacttggcataaaatgcagtaaaaataagcagcgcgattgaatagacttctgatgtgcgacttccagcaattcgatcttcaaaaacaagaattgcaataatcgcagcataaagccagaaatgaaacttcatgcgtgcaagatataaacattccaaaataagaatgaatacaagcagtccaaaatgattaggattctggaatcccatgctgtggcgcatgatcgtcccaaatgccgatgttgtatcaggggcaattcccgctcgccacaagaaatacatcaaaacaatggtcaacaaccgcagaaagacatcgtattttatgcatttattaaaatcaatattctttgacaccgtaatcataaggatcagcttaaaatagccatagtccccgacccggtatccaataaagaatgaccacaaaataagaataaagaaaatgattccttcttttgcatagtaatcatgaagccgtgtaaaaaatagaatcagcaaaattgcgattccaaagtaagtaatattcttcagatagccgccgattcctgcaatatgcccaaacatagcaaatgcataaaacgtcgtatatgcaagcaaaaaaaagaatgtagtcagcttgttgcggtcaaccaataacataataaaacaaacatctcctgttcaatatttaggccttctgtttttctgtgctctgtccttttccaagaaaatcgttccaaatgaacttcctgttcaaaacagcaaatacagcaattgccactaccattttgaccgcgaagctgataaccgtttcatggaagagacgcgaaataatcatgcatgcagcaaacattactgccgatttccataagctatttaagaaaagccgaacatatacaccaatttccagttcttttcttgacttaatcgtctgccacagcattacgctgacctcagcaagcactgttcctatgcaagcaccatatgcgccataccctggaataaaaatgctattgaagatcaggttaatcactgcgccaaatattgtcgattctacatagacccgatctctccttgtaggaatcaaaaactgagtccgcacaacatttgcccaagcggtaaatggcaggtagatggccagaaatctcattattccggcactctttgtaaactccggcccaaacattatcaacgatatttcatcagcaaccgcccagataccaaaagtcattgtggttgccatcaccatagccagcttcatagatgccctgagaatcggcttatattcggatttcttgttatttaaaacatacgacatacggggaagcatgactgttcccagcgctgtaataacagaaatcggaatactaatgattttctgtgcattttcaaaatttccaagctcaactgttgacgacagtcctccgatcattatcttatccataatggcatagattccatacgccaagaccggaataagaagaacgagaacctgtttaaaatggctaaagatctcactccatttgacccgtacaatgtgaacgtaccgatgtaaaataaagataagataaagctggctgatcagtgttgcactccccatgatggccgtgtagacccacagatcgtttatattcctaacgcaaaggaatataaacactaacgaaatcaccttaatcaggacatttcttgatatcgtcagcttaaatttctccaagccaaaataaaaccaattcacatcaaagcatgtcgaaataaggaaaataaactgaattgccgcgatctcccggtatctcctgcaaataaagatcacatagaatatataaaccgcaagcgtaactgtgctcgtcaccaattgcaaaccatacatactggaaaattttcggttaatctgagtctggtcatcccggattctggcgatttcccgatttccgtagttgttcataccaagcattgcggctagcataaagaagttgacaatcgaatatgtgtaggaataaattcctatattgttaacgcccagcactctcgaaatatagggcgttgtaatcaaaggaaagatgtatatcaaaagctgatatacaacattcattataaagttcttattaccactattcattcgtcgtgtccagactgtcctttaaatattgaattgccttatttcgtagaatgggaagttcctcctcgtaataggagtaatccaccattttcatatagttaaaattctctatatattcactcggaattaaccgttcttctatccctaactccttaattaaagtttttactctatcatcatcaccaaacattccaccattcttgatcacccacaccggctttctaaaaatagtagggaaaacagttccatggaacgatgttgtcatgatcaaagttgcattcttaataagtgtcaggtacgatcgagggttctcgatttccggaagtttaaagccggttctttgcattcccttcacataaaatgtttttgcattaaatgcaatcaccggaagatgatacttattcgatacgcactgcaccaaatggacaatatctttctggtaagacggcgaatagaaaaaaatatacttatccggtaagttcaaattttgatcagcaatctgttcatatgcgtcggcatctaaaagtaatgtcggatcaagtaatacaggaacatctttttcgaccaaatcctgaagccacttttttccattttcctcacgaatagagagcgcatcaaaatcagaaagatatgtcttgtacttttccggatcatcagcatatttcatgacattctttgcaccgaaagatggagcataagcaattttacgtgcattcctcacccacggtaaatagtatgcgtcatcaccatcttcaattgtaatattccaaacctgatcgctccccgtgactaccacaaagtatctggtgtccgtcaactcttccattcgtgaataagattctggagaaagatgaaattcggcgttcttgaattcttcgaaactctcaaaattttttcttattctatccttgtatggaaagagaatgatattcttgagaatattttttacagaattattgggctgtgtcacactgtatagttgcttctgaccagtatttgagaaatcgatgatttctgcttcataacctaatcgctcaattaccctttgcaaagcaaacgcctgcaacattgaaccgcaattatatgaatgatgaaatgtaataattcctacacgcttatctgtcataaccaattaccttcccgttttctttacatttctataaaataatattcattctttcctgaccggaatctgtttcgaatatttctgactgaattcaagcaatctgtaaaaatcaaagcctgactatctttccgttgctctattaacttgtaactgatctgcacaaccttctcaggatgaactgtcgttggaaagcgcagaaaatactgattcatggactttgaatgcatttttttcatttcctgcgttttctctttcctatttctgattctgcttatgaggaacagatacagatagacactgtaggagaacgaaaagttgatagcatagtctatttcgttctttgcgaactgtccagattctgacatcagcttctcttccctctgcaaaaacaaaagatttgacttgtaaaacctcggattaaatgtctttgtcgaagaactattgtgaatcctgtacttatataaggatcgcgttacaaattcgaaacttctacacttaatgacagcctcaaggttaaataaggcatcttccccattgatcagattactatcaaatgcaatacgattgatgttcaaaaagtttctattaaaaatttttgaccatggcgacgccatggtcgtcagggcattctcttttctgatcccaaagatgccgtctacaatagcttttatatttttgtcttttttatcaagcttgccagaaaaataaacaatatcaaaactcctgccgatattggaaaagactgcttcttgccacccttgcagtagtacatcatccgcgtcaacaaacattacatattgccctgttgactcagctatacctctgtttcttgtatacgatgcaccatgattatcgtggtggagaacccgtatattcgcccgctcatatctcctgcacttttcaagagacgaatctttcgaaccatcatccaaaaggaggacttctgtttcagcattaagttctgaaataattgagttcagacaatcatcaatatattgctcagcatcataaacaggaatgataatagatagcttgtacatcatcatacctttcttctgtgataagccataacaggcgccgcaaaatacatggacaagaagaatttgattttctccttgccagagaagttcttcatttgcggcgacatgcgctttaactctctgttaacttttcgttccagttccggatgctctttttttaacagatgtgcccggtatctggcctccgttaatgtcatcagatatgcattcgcagctgtgttatatgatggagtatctttcaattcttccataattaccctgtatgttttcagcacactaaaccatttcagattcttcaggttataagttgcgctgttgctcacttgacgataaaaatattgttttcccgagtaaaaaaccgctgtatcacaatacttcatatactcgacattaaagagaagatcttcgcaaatcgctgccttctcattcattcgcagcgagtgctgcttaatgaggttagcgaggtagatttttccccaaaaaaagccttcatatttcccccatagctgcgctgttgcctgatcacccttgaatacttctgttactcccttggagaagtctgtcgggttgtaatctttttcttttacaactcctgtggccgccatctccgcatgatatttttctatcatttggactaatatttctatatagcccggagcgatgatatcatcagaatccactggtgcaatgtaagtcccagtactatgctctattgcgtaattccgcgagtatgaaacgccatgattttcattatggaaaaactgtatacgtgaatctttcgatgcatatttctctatgatttttccggtagagtcggttgatccatcatttacaatcaatatttcaatgtttttatatgtctgttcacagacactatcgaggcactgctctaggtatttttcagcattataagccggaattattatactaactttttccatatgcttaatccccggctttcaaaaatttgttatattctttgtcatattttactgtcatggccttatcagacaattttttcagttgaaaatcttttattgcttctttatcgactctgttaaaattttttcgcagttctcccattgctgtgttaaaactccggccatcattttgaatagagaagttctcgccaagatataaatcttcccccattccgaccacttctcgatgtgatggaatatctgataggaacagacctaagccacacgacagtgcttccagcacagaaatggaaaatccttctgatcttgaagctgatgcataaatattgcttatgttgtaataagccgctggatcgtcctgaaaacccaacagctttacgtggtcatccaccatttgctcacaggcttctctttctggtccatctccaagcagtaataagtattcatccttattgtgatattgtacaaaattttgtgtcaaaaattgtacatttttcccgaaagacaacccacccgaaaaaacgaacacaaccgcatcttctggaatatctagttctttcctcgtaacagtgtgctttgcaatctttggtttgataccgttgcggataaatattacatttttcagatacttccgcatcacctgatagaccgacttagagcatcctacgcggcagtccattttcttaagagcatcaatgtgcatctttataaagatcttcgccttcacttttccatacgtctgcacatagtcctcaaacatattgttgtgaagggtggtaaccttcctcacagatgttttaacccttgaagaaagaatgtctggaatgattccatgggaatgaatgatgtcaaacccttctctttttacaagctcttggaattccctgccctgtcctagtaggcactttgcccgactaagagttttacaagtgaatatctggacaccattgtttctaagatcagcaacgatgcgttcgtcattacctttgaaaagtgtgatcaaagaaacgctgtactgctctttatccagattccgtatgatatccaagatcacattgcttggaccattattcgttatgtagttggttacaaatgcgatcttgatcattcttttctaagccctttgtaaatcattttccttattccgtttggcatgacacataccgctgcatgcggaactgctcctgtcagaaaatctatttctgatgtccaccctatacttcttagccatttatggaacttcatcattgtctttgcgtaatctctgctaccacgccgaagatacatatcagctggtgtccggacatcaacaagcacatcagggatgttttgtgctttatattcttttctcagcattcgaacccacaggtagtagtcctcaaacaaatgaaatgtttctctatatcctccggccgattccactgcattcttcttgaacatcaccgccatatggttcatcgggttcctcttcttggagaatttaatgatttcctcatttgtggtcggtaaatgacgcacaccaaaaggcaccttcggatctgtttcaaattcgctgatcgttccactggtgaagtcgatcgctggattctgttcaaatacacgcagttgcttctcacaacgatctggtctgctaatatcgtcgctatccattctggtgaccagctcatttcgacaaatcttcaagccttcgtttagagcattacctaggccgccgcttttctccaacctgtgaatatgcaacgcagattcaaacttttcttgttcttcccgtagcaccgcatcaagttcggaagttaatggaccatcacacacaaccacaaaatcgtttgttggagcagtctggatccgaatactttccatacttgtgcgaaggaattccggggattccttgtaatacactgacataagaactgaatacgaagtggccatcatgccacctccagtaatgcagtgctgtagttgtcaaaggaaatgatgtaaggtttaagatcatagcccccatgaatttgggcatagcccgttaatccagggattattcgtaatctttgtggaaattctgaccacttttccgaaaacttctgtgttaaagtaaaacgctcagggcgtggcccaaccagactcatatcaccccaatttgaacgagtaatacagtacattattttcattatctagctccctccccggtcactacaacacgaatcgtttcaaaaaaaatcccaatatcagtcaataccccaaaatgctctatgtagtacatatcattagcaagcttttgtgctggtgtatcatcgtaaccaccgtgaacttgagcataaccgcttagaccgggtttaaccaataaacgttgctcaaaaccttcaatgtcttcactgaattgttgcgtgaatattggccgttctggtcttggaccaatcaaactcatatcgcctttgactactgaccataattgtggcaattcatccacccgtattttacgcatgaaatgaccgatccgggttacccgcggatcttctttttttgcccacattgcaccagattttttctctgcatcactatacattgatcgtaatttagttactttaaacgattggcccattagcccaacacgctcttggctatagaagcacttgcctggtgtttctaacttaactaaaatcataaaaataagaataataattgaagctggaatcatcaataacgttgcgaagattagatcgaataaacgcttaaatggtaaatagatgtgatgaaacggtcgatctaatttagctacaaaatcatattcatctaccgtttgtgtatgactgattttgtttcccatgataagattccccctaatccgttaacgattcccaatataactttaacccagtcgtaatatcataatgcggctgatagcctaaacttcttaattgtgtaatatctgcatatgaatgtttgatatcccctacccgttctgctttatgaataatttgtagttcacgatcaataatctgttcatacacctgaattacttgattaaggctagtatgtttaccggcaccaacattaaaaacttgatgtacgatgtcgctacccttcgtcaataggcataatgcttggattacgtctttaataaagacaaaatcacgggtttgttcaccatcaccgaaaattgtaaattccgattggtgtttagctgcttgcgtgattaatgacaatactcctgaatacggtgatttaggattctgtcgtggtccataaacattgaagaaccgtaccgccactgttggaatattgtatagttttccatagtcaattacgaaacgttcagttgcaaatttatcaattgcatatggtgtcaacggatcaatcgttgaatcctcacgtttaggtaactctggattgtttccataaacggccgctgacgaagtaaacaatacttttttaatagctaaattatgttgacgaatggtctctaagataaaaatattcgcttcttggttgatttgatgtgtttcatatggtcgcgcaactgagtcagcaacactggcaatggctgccaatagataaatatagtcaaactgttccttgagtaataagtctttcataaagccatgatcagtaatgctatgttcataaaaagtcactttaggtgaagtgggtacattacttgctaagcccatcgataagtcatcgacgacaatgacctcatcaccatcttgtactaactgatcaactaagtttgacccaataaaaccggcaccaccggtcactaaaactttactcatttgtctttcctccaaattcaactattatctaaacaaccaaaattttttcttctctttaatatggtggtactcacttggctctaagtcgtcgccattaatgatctttttagcgttatcttgcatccaagtgaccatttccgtcccattatgcttttccagcttagcgaacgccttctgcatgcggaaattctgcctctcaggttatgcgcgtcagaggcgaaaacaaagcctaagccggcatcaatgactatctcatagaagtcgttattcataaatgaacctgactattcatcttttgaaccataaccttggccgtagccataaccgtatccgtagccataacccacatctgtttttcctccgcgcacacgctgcacaattcccaaaatttttgtgtcactcatccgtagcgtctcaacagtgcgctgcaaatttgtctttaaagtttttccgaaaatggtaactagaactgcaccgtccacaactggcatcagcacttgagcatcggtaactgccataacaggcggaacatcaaacacaacaacatcatagttatttcgcatccatcccattaaagatgtcattcgatttgagctcaatagctccgcaggattaggtggaactggacctgaagttaaaacctcaagattatcaacaaacgtttcttgcactacatccttaggttgagcatcggccgctaaaatagtcgttagtccccgtgtattaatcaagccaaatgttgattgtgctgttggacgacgtaaatctgcatcgacatacaacacacttttcccagcttgtgcccacgtaaccgctacgttagatgaaaccgtcgtcttcccatctgacaattcagccgacgtaaacatcaccacttgtaacttgtccaaagctgcaccagcaaattcaatattcgtgcgcaacgtacggaattgctctgaaataacgtgctttggttcaacgaaagtcaccaaacgtgcgccattatcttgtgtctcagtatcgacaacgtgctttttcttcaaaaaattaaaactcatctcttatctcccgttaaatgcgtttaccgatacgtgacgtacgtgtttcattacttgtattcttcttttcattagctgcaacgacatccttcacatcgcgaatcttaccgatatatccgataacacctaaattagtcagttttaattcatccgttaggaattccaaatccttaaccgtacgatcagttacttccttaatgaagccccatgcaaagccagcaaatacaccaagtaaaaatccagccaaagtaatcaacttaacatttggcgcaacgggctttgaatttgtcattgcttttgaaacaattgatacgtttgaaacagacataattgaagcaattttgtccttgaacacttccgcaattgtattcgcaatatccttagacatcttggcatcgcctgacttaacattcactgagaaaacttgtgaatttgcctggttagagatactaatcatcttagccactgaatcagctgttaaatcagtattgtcatacttggcagctaccagcttatacttagccggttgtgcaggtgcagtttgcacctgcttaccataagcattattctcatattgagctggtactgctgcttgaatttgttccttatgtggctttgttaaatcatttacaactgtgtttaaaatgattggtcgcgtaataatatccttatatgtattgataatttgtacatcggcttgttggtctgcgtactgcacacccgcttgatcaccatcttgcttgcggctaacaagcaacgcagccgaagaactgtactgcgggtgaatcacaaacttagacacaccaaaagcaacgccgccaacaatcaccccaagtgccagcatcaacgtccagttacgacgaacaatcaaccatagtcgaccaagatcgattacgttatccatataaataaacccacctattctacattggtaataataccttcaaaaaaattccgtttttcgcaaaataattgcacacagaaaagacacatttaagtttatcactttttaaggtagggttatgtgaagacataattgcataaagtatcatttttacaggtattaatcagactctttaatgttttttgtctggatattcggacctaaattgtacttttgcctcttgtttctcatatttccggtaataaattacagaaatataaaccggacattacgaataattgtcaataacgttttttcgattccgaaaatcttgtaatttgtaacaaactattaatattgactatacaaaagctcttgcaaatcgatctgtatgaactgaaccccgaaaattggagtgacgtttaagcggctaactggtcggaaagatttcggtattgaaccggagttcttccggccagttttgtttttatccgcttattgttgtaataatagacatagttagttatggcggactttaattcgtcataactttgataatggttgttatgtaccgttcctaccttcaagatgtagaagatactctcagccattgcgtagtgtaaagaggtcatcctgttaaaggatgacctcttttgttatgatgaagaaaaggggcgtgtgacatggacgaagcagcaacaaagattcaagaattaacagaagcattggcgtctgcacaaacggaagttgataagtggcggacgggtgccgaaatttatgaagcacaagtaggtgacctgcaaggcgcactacaagaaatggcggcggaattggatcgcttggcacttgaaaatcagcaattgaagggccaattaggtgatgcaccaatccttcaaccacaagccagtgtacctactgatgaagatgcccaaattattcaagccgccttaattagccgcattaaagaattagaacgtgcattagcacaacaataaaagacgccaaaaagcccagttcagatcgctgtctgactgggctttaatagttgggattaagctgtttgtaggtcacgcaaaccaacgtttgaatcaagcgtacctgaaggacctgataggctataacgcaagtacttatcaactgaaagcgtcatatctgaatccatctgggcagctgtgtaacccttgatgtaaacagggccaagtgtactatcgatttttttgtcaaaatcattagtaatttgatcgctttcgcaaaggatgatgttaaaggccacgtcgagggtacacatccctgcgtctgaaaatggaccgacgccatcatcaaaatccaaaacaatcttggtttgaggtgtaagacgttgcgtcagctttgcttttgcagcatcggaaattgttaaaaacataatcattacctcctgtataccttatactctaccatagtatatcgcagatgaaacaactgtccaaaaattttacgttaaaaaagcattccgtttgtccaatatcaaggacactggtaaagtatagatatagttatgagcacagcaaaacaggaggatatgaagatgcatttaatttggacattaattattggtgcagtgattggtgcgattgccggggcaattactagccgaggcgcatcgatgggttggatagcaaatatcgtcgctggtttgattggttcttggctgggtgagatggtacttggatcatgggggccttcactggccggtatggcattgttcccatcaatcattggggcgattatcgttgtcttagttgtatcttggttgttgactaagatgggtaatgattaagaagatgcctattaagcgttctaccgtaacgggtgggacgcttttttactggtattgacattcagataccagggctctaagattagttgtctggaattgtggttcttctcaaaaacgtcatgattaaatgctaaaatgtaagcataattcatgattaaggggagaatatgatggaatttgtgactttaaacaatggcgtaaaaatgccgatggtcgggtttggtacggatgcggccaatgcagaactaacctataatgaagtaatggcggcggcaactgaagcaggttaccgaatgtttgatacggcagcgatgtatggtaatcaagatgaacttggggcttacctggtaaactcagggcttgatcggtcagattacttcctaactagtaaggttgcacagctggagcaagggtatgaaaataccctacaagcttttaagcgaacaacggcagcgctacaaacggattatctagacttgtacctggtccactggccaaagtttgatccattttttgaaacgtggcgtgcattagagcacttgtacaaagaaggatatgttcgggcgattggtgtgtcgaattttgaggcgcaccatttagatcgtttgttgacgcaagcgacagttgtaccggcagtcgatcaaattgagacgcacccatacttcaatcaacacgtgctgcataattacttaacggaacttggcattcaacaccaagcctggagtccgttgggccgcggtgcggtgctgcaggatgagacgttgcaggggattgcgacgcgatatggtgtgagtgtcgcgcaagttattctacgctggcacatccaacataacgtggcggttattccaaagtcaggtaatccggcccgcatggcgcaaaacattgatttgcaattccaattgaccccaacggacatggcacgcattgatgccttacaacgtggtgaacgtatcatgggcgcaccagatcaaaactatacggaagatttgtggtaataaacaatggttaaacaagggagtttcgcgagtgttagctcagtgaagcagttacggcaatttaaacagcgtacgaagttggccgagagccaggcgattcaaccagaacagattaaagagttcttggttgtgcgctaccacttaacgcagaatgcgcgactcgccccagttaccaaggagacgatgcaacgctttttgatggcgtggttagataatgccacagcgcaaacttgggcgttgacaaccattacccagcaaacattgggccaaatcgccacgcaagtaccatggcaattctatgctttggtcaatagtgaatggcgtcggttccaaaagtttttgcaaaaagaagtaccagcgatgccattggcaacccgccgcatggtaacagctgaagccgaaacaattacagcgttagtggcacaacaattggccttaaactggttcttaacgatgtacgcgaccatgccggaccggttagctgcagttactgaacaacaggtagctgatttgcaacaatcgttgctgagtgatgaccaaattaattggcaaaatgttgcaacggtttattcgacggcgccatttgtcatgccgacagatgccgatgaaggtaccgtaacctggttgcagacactgactgatttaacggccgatcaactaaagtaataaaaaatcccgtttgaatgtggttgttcaaacgggattttttattattcacgggtaccttcaatggccgtacgcatatggtcaaccacctgttgtgttttgtcgccaagttggacaccaactaacgtgaagaggctgtccatgatggtgatttgggcaatcaacgaggacattgattcgcttcgaatattaacttcttccgcggcgctggccaataccaaatcagcgagctttgccaattctgattgggggtaggcggtaatggcgataatcttaacgccgttggtatgaagttgacgcgcaatggttaacgtatcgtgattgcgccctgagtgagaaactacgatggccacgtcagtcgtgcgcatgcgcacggcttgcatgagctgcacgtcgtagtcagggtgctgttcaacgtctaatggggtgcggagcaacttgtggtaaccattcaaagccacgatggatgaaccaccgataccaaataggccaacccggcgtgcttcaactaaccacttggttgccgttgtccagtcggccgttttaatcatattgaccgttgattcaagggcgttggttgcgccgctgaagaccttcttgacgatttcactggtatcatcttcttcatcgatttcaccaaagaaagtatcatctgattgggtcacaacggccaagctaagtgaaaattcacggaatgagctaaagccgacgcgctttacaaaacgagagatggttgccgttgagagaccaaccgcatttgccaggccctgaatagttaaagaacgaatttcttcggggtttgctaagataaaagttgcgactttttcgtcggaaccagaaagttgttcacgcattgaacgaatgcgtgtaaagccggattgcgccattttatctcctttttaaatatattaattatgtgtttaaccctttatgggcatacttttccattgcctaatagtttttagtgcgttccaatattcctgactaaaaaccctatgaaaacattttacaacaaaaagggttgcaaagtgaaaaacttttgcattataataatgattgtagaaaaaacaagcacaagaaaaaagaggtaactcaaatgaagttcgctatgatcggccttggtaagatgggtttgaacttggtaaagaacgccgttgataacggtcacgaagttgttgcattcgacttgaacgcagacttcgttaaggaagcagctgattactcagataaggtatctgcagcatcagacttggacgacatgttggcacaattgccatcaccaaaggttgtttgggtaatggttccagccggtgttccaacgaactcaactatcgacacgttgatcgagaagatggttgaaggcgacatcatcatcgatggtggtaactcaaactacaaggataacttggagcaaaacaagcgcacgactgctgctggtatcaagttcttcgatgctggtacttcaggcggaatgtctggtgcacgtaacggtggaaacttcatgatcggtggagacgacgctgaagcttggaaggttatcgagcctttgttcaagtcagtcgccttggaagacggttacctatacactggtcgtttgggttcaggtcactacttgaagatggttcacaacggaatcgaatacggtatgatgcaagccatcgccgaaggtttcgaagttttggaagcatcacaatacgactacgactacgaagcagttgctaagttgtggaaccacggttcagttgttcgttcatggttgatggaattggccgaagagcaatttgctaaggaccctaagttggatgccatctcaggtcgtatgcactcatctggtgaaggtaagtggacgatcgaagagtcattggacttggaagttccagcaccagttatcgcattgtcattgatgatgcgttaccgttcactacaagaagacacgtttactggtaaggttgtttcagctttgcgtaacggcttcggtggacacgctatggacgctgctaagtaattttagtcaaatcagtcgtgtgatgtgcgacgttaagtttactaaagctacgatgtagaagacccacaaaatatgagatttaaacacacagagtgactaaggaagccgctgttggttgccctatcgacctttggcgctgcgtacttgccattggggggcacccatggcaggaaacttagttcattcgtttcacgaataactctgtgtttccaatgcttaagttgtgagattcttgagtattgaagccatccatttcgatggatggcgagattgtgagagatacacccgacagatttctgtcgggtgttttttaatgagtagggtataatagacgtattaactttgaggattgagatactatgaaatatactttgacacttgatttggcggctgcgaacatcgtagcggttttaacagatgaaaacgacaatcaaacaacaacgcgctacgcctatgctggtgttgaattcccatcagatccggtctcaccagataacatcgtgacgaccttactcgacacgttaacgacgatcaacaatggtctaccaggcgatacagatgttttgtctgaagttcactttgtctctggcatcgcgaatggctggattgcgttggatgcggacttcaatgcgctgactgaagtgatttcaggcggtgataaccgagctgctaagtatgtcgatgcgttgatgattaacggcattggtggccaattacaacgtaaaacaggattacctatgacgccaactgagccccttgcgctgacgttgtggttaaaaaatgaaaatcaagaggcttatgcgaacgctgcccattatatgggggtccaggagtttatcgtgaaccgcttgtttggcttgaacgaggttgatgaggcgcacgctgcgcgaactggtttctacaatgtggcgcatcaagattgggatatccaagcgttagccgtgaccggtttggtaactgagcaactgccaacgttgacgactgctgatgcgattacaacgccattattagcagcggttgccacacagactggtttgacggatgcaaccaccttttaccgccgttaatcgcattatgctataataagtgtgttaccggggatgcagttagccagggaagtgatgagcccagggctgccgcttggcggagggtgcgatgccctgctgtccggtgacggttccgcgtgggaggtgaaggacccacgcggaatcggaggaaaagcgcttcgaggcttggacacctcgaagtatggggattgttaacggggtggtgcctgttaacatgatacggtgaagacgtcgaaacggtcgtggtgggctgtttcgacacaaagggagacctgcactcatttagtgagagaggtctctttttttgtgcgcaattttcgacatatatcattgataattaatatagttttaatatatgggctgttaacagtgtgaactgttttgtatgaaaacccttccaacgtctttacatcaatgttttaaactatacaaaattaatacattaatcaagtttttaaacaggaatttctcataataaactgataaactcaaggtaagtgaaggtagtgtttcagatatgaaacatacatgatgaattgagaaaatacttaacggggtttattgacatgggtgagacaaaatttagaaagaagatgtataaaagcggtaaattttgggttgccgctggaatgacagccctgacggtaggggtggttaatccacaatttattaataggttgagtaaggacgttgatgcggtgtttgccgcgcagacaacttcgacacaaacaattgatacagtgacggatgcggatgcgaatggtcgttatgtggtttggaataagactgggattaacgataatgacgcggttgctggaaaaggaacgtataatggaacggcatggagtgcggagtattcatcatacgctgatccatcaagtcaaacctattcgaagctgaccgccaatggtagtaacacaattggatactactatttgactcgtcaatttgatgcgtcacaaaaatttaccattgatggctacttccaccctaatttgagtggacaagatggtaagctgccaagcaatggaaattggtctgactgggtgggcttggttttgacgccaaccgacccgaataagatggccacggattacaacatgagtaacggtggtggtggccttggtatccaagggtttggaaatgccatggctttggggctagacttttatcaaaactcaggggatcccgctgccggtccattcggagccttgcgttcaactaacagtagtggcgctttgaattcagtaccggatgccttgtataccaagggcatcaacatgacgaattggtcaacgacgattaagtaccaattgacgtactggccaacaggcggcccaaatggtggcccttatattacggcgtcatttaccgacaatgcaaatgctaataataagtggactgttaataccaatcaggcgggtgtaacgattaatccaccaaaggccttttcagtcggtgtgaacgctgccaatggacaaaaagccgcggataactttgcctcaattgataatatctcgggaacgtttgcaacgggaacaaccacggttaaatatgtggatgctaatggtaatgccattaaggatccgacaacctttgtggcggccgttggtgatgtgattgggattacgaatctgtcaacgcaagccaaggcaggaacggcagattatgcctatgccgcaccgacgattcgtgggtataaggtctcttcagctaacgatgtgaccgtgtcacaaacggcagcaaacaacacgattacgattaagtacacggcgttaccttatcaagaatcaattattcaaacggacacaccagcattgtggagcaacaactcagtgattacgtcatactggagtgttgatcaagataacccgttgggaagtggtactagtgtcgctaacagtattatggatacgtcgttggtgcgctcaggttatagctactacgtgacggatcaaaagggtagttcatacgcaacgatgtcatcagctgcggctgcagcatcagtcaacgcttgggatagcacctcaaattcagctggcgtgcaatctgatgcggcccctcaaagttggacagttaagtatgtgccagattatcaaggggcgtacctgtacacgcgtgattattcatacgtgaatggatcatattcagcaaccacatcttcgggtacctataaggatgcagccggtggccggacgggtggcgcaattagcttcggcaccaccgatagtagtttgccaaagtcagggtatacctacacagtgacgggcccagataacattacgtattaaaatttgtcatcagcagttgcagcgaattcattcgataacacggataacaaggtagctggtgtccaagcgtcaagtgatacgtaataccagtactttacggttaactacaccccagcaacgcaaaccaccagtttggttgttgattcgaactcaccggtaaaggctggctcagttttggcctcatcattgggggcgacaagcgcgacgatttcattgccatatacggatgcttcattgtcaacagctggttattcatacgtggtgaagggaccaaatggttcaaactacagcacgttgtcatcagcggttgctgcaaattccctgtatgatgcgacgaataatacaggggcgacagattcgtcagcccaagtctttacggttagctacgtggctcagtaccaagcggccgcgttgcgctacgatgctagtggaccgattagtgccggttcaacgaaggcaactgcttcaggtacgacgggtggtacaatcgcctttgccggcgtgactgattcaaacttggccagtgcgggttatacgtatacggtgaagtacatgggcacggatgcccctgatagtacggcgtacacgacgttgtcatcagcagtggcagcacacccacgttatgatgcaacggccaatagtggtagctcagatgcgtcatcacaagttttccaaataacgtataagacaaatcaatacgcatctttgtttacggattcgacggacacgtcaagcaactctgttttgagttattcagcgattaacgaaacgacgaatggaccagcaagcagtgcaatttcatttagtacaacggattcacagttggctagaagtggttatagctatgtcgtgcaggtattgaactcggcgggtagtgtcattaattcctacacaacgctgacgtcagccgtggctgcgcagaagtatgacaatacctcaaatgcagcgaatgcaacgaccgacgctcaagtgcaacgtttcaaggttgtttatgcaccacaaacggctaatattacgtactactactatgatgaaaacggtaaaacgattgcgacagcggtgaccaagacgggttatgttggggcgaagattccagctaatccactgacgatttcggggtataccctaattggtccgtcatcagactctgacgacgatgggttgtttgatgccgatcgtaattcagttattaagtaccaataccgggctcagtatcaagccgccaacgtggtagttgatagtgcgtcaccggtggcggctaactcggctgtggcatccgcttcgggtgttacgagtggggccctgtcatttagcacgacggattcgcagttagcgaagagtggttacacgtacgttgtttatgggccaactggttcaacgtcgtacgcaactttgtcagcggcggtgcaagccaacagtttgtatgacgccactgaaaatggctcggcatcatctgatgcatcagcacaaacattccgcgtgtcatataaggcggatatgcaatcagcgtacattcgtgtgcaacaaaattcaccaattagtagtggggtgatggttgatagcattgtcggtagcacgagtggcaagttggccttcagtgccacggatgcgacattggctgtctcaggatacacgtacacggttggttatggttacgatgctgccaatacggtttggtactcaaatttggctgccgctttggccgctaacggtacctatgatgcgacgaataacaatggcggtgccactgatacgaatgcccaacgttttgttgtgctttatgcaccaatgagtcaagcggcagcggtggtgatcgatgctagctcaccaattagcgctggctcgacagcgatgtcagctaacggtatgactggttcagctatctcctttgcgacaagcgcttcaaacacaacgttggattcgcaattggccaagagtggttacacgtataccgtgagatatggcagcgatagtgcaacctttacgacgctatcttcagctttggccgcccactcgttctacaatgcgaacaacacgacatctggtgttgcagatgatacaccggataagtttacggtgagctacaaggcggattatcaatcagctgttgtgaacgtgacaggaacttcaccaattcgggctaactcaaagtttgcgtcgaacactggtgggacgtcggatagtatcagcttcagtattacggatgctaacctgtacgcccgtggttatatgtacacggtaacgggaccggatggtcaggtttatagcaatttggcgtcagccttatcagcgaacccaatttatgacaacacgaataatttggggacgttgaatgattccgccgtgcaaagcttcatggtgtcataccgggctaattatcaatcagcttatttgcaaatggatgaaaatgccccaagaagtgccggggcaatcgttggttcggcagcaggtgtaacggccggtaatatctcgtttaatgtaacggattcacaattggccgtgccgggctaccaatacaatatttacacggcaatgggtagcagctatgcaaccttgtcatcggccttagtcgcagaaggacgttttgatagtacacaaaacgttggatcatctgatcaaagtgcacaagcttacttcgtcgtctacacggcagaccagcaaagtgcttatattcaagtaaatgcgaagtcaccaatcagcgccggtaacatggtcgactcacaaattggccaaaccagtggtgcgttgacgttcgttgatacggacgatagcgacctttacgtgcgtggttaccactacacagtaacgggaccggatggtaaggcgtacagcaacttgtcatcagcaattgcagcaaatagtatctatgacgcaacggataacaccggtgcgaatgatgcgagtgcgcaagcctttacggtgaactatgtcgcggatcgccaacaagcatcgttggctgtgacgtctgattcgccaattagtatgggtagtgtcgtgacgactgcatcaggtgggactgctgagacaattccattcgcatataacgattcacaaattgcggtctctggttacagctaccgtgtgatggggccagatggtgagtggtacagcacgttggcagaagcccaatcaaacaatacaacgtttgatgacacgagtaacgcaacggattcagatgcggaagcccaaatgtttacgattagctatagtgccctgagtcaagcagcacgcgttgtcggggctgataagtcaccaattcgggctggtttgacaatgggttcagcggctggtgtgactagtcaagcaatttcctttgctagcacgactgatgcgacgttggctcagagcggatacagttatgtcgtttacatgggttcaaacagcacgacgagttacagtaccttgtcggcagcaatggcagccaatagtttgtataacgacacgaatacggcgagtggcgcctcagatgcggatccacaaatctttacggtgtcatacgtggccaactatcaatcagcgaacctggttgttgggggaaacacccaaattagtagtggggtcacggttgattcggccgctggtgtcacgagtagccaagtttcgtttggaaccaatgactcagctttgcgtgttgctggctatcgatacactgtgaagacgcctgatggtaagacgtatacaacgttgtcatcagcgttagccggaaccactggattgtacgacaacacgaataacgcgacgaattcagatgctgcgccacaaacgtatacggttgagtatgcggcaattacacaaacggctgaggttgtcgtggctgagaccaaggatgagtattctggtcaagtgttggagaccgtcaccggtgatactggtgcggcgctaggtattaagttgacagatgcgacattgcagtcaatggagatgacccaggggtatacgtactatgtaacggttaagcacgcagacgatagttttgtgacggatgatgctgggaatgtcatacgttatgcgacgttggacgaagcgattgcggcgaataattcatttgatgcggttgatgataacgctgaacattcgggtattaaacaatttgtgattaatccagtaccgtcatatcaggagagtacgttgacggtaacgagtgattcaccaatttcagcagcagctgccgttgaaacaacgtctggtgtaacaaacagtgccatttcatacagcacaactgacagtacactggcagtgccaggttatacgtaccaagtgtcggttgttcgacctgatggcacaacgcaatcatatgcgacgctgtcatcggccttagccgcgcagtcactttacgacaatacgtcaaatggtgacacgcagtctgataagagtgcacaagccttccaagttagctataaggcagactaccagtcagccaatattacgttcatgactgattcagggacggcaccaatgtcagcgattgcagccgccggtgtgacaagtggtgtctacacatcaacttatacagcggccgctggttactatttcacggcagatggtcaaccaagtggcgcaagcattgcggctgacggacgtacagcaacctttacatttaactacgataatactgacaatgcgggtgcttcagatagtgcggctcagagcttcactttgaagatggcaccagctagtcaatctggaaacattagcttctcttatgcagatgccattggttcaccaacggtaccagctgatgtgccattagctggggtgaccggtgattctaagacgggtacaattaccgcgcctgaaggttattacatcgtgtcgattgccggtgatccacataatgtggtttacacggacgagacgcaccaagaagcgacttattcagtcattctagatgatactccgaatggtaatagtgccactgatggtgattcacaagatatggtggttacttttgcaccaaataaccaaacggcaaacattattcaagcaatgccggatggtacgacgagtgttgttgacacgcagaatgccaagactaaccaatcatatgcgtatgagtacacaacgccagccggatactacgtagcaagtggtagtgcagcggccgcctcaggcatgacaactgagattagtaatgatggtaagacggttaacgtaacgggaacgtacgataactcgaagaatacggatgcgtcaggcacggatgagcaaacgcaagatacgaccattacgctaagcaagtctgaacaagtggcaatgtttaagattaacgtgccaacttggccaacaactgtgacggctaagatgacgccagtgcagggctatacggctgagaatatcacgttaccacaaggcttctcagatagtgaattgactaaggacgggtacagttacacggtaactggacctgatggtgagatttacgacacaatggcgaaagctttggccgcaaatccaatctttgacagcacgaacaatggatcagcgcaagatacagaagcccagaactttacggtaacgtatgttgcggctgatcaaagtgcgacaattaagcaacaatatgcggatggtgcgcccaacacgccagccttcccacaatctgatgagacgctaaatggtaagtcagaacaagtggttaagggaacgtttaacgcaccaactggttacaagattacaagtgttactgatgcaccaggtatcgtttggacgattgcagccgatgagaagtccgcaacctacacgttgacgtatgatacggtggctgatacggatggaccaacgcaaaacacggtcgtgacgtacacaccattggctcaaaaggtagtcgttgaattcgttgatgaagttggtcgaacgttgacaacggataccaaggtgcaaagtcatactttgacaggtgtgacgaacgagacggttaattatgacgacgcgtcgttgcaagcggatcaaaaaattgcgggttaccaattggtagttcaaaaccaatcggatgcggctaatttcgacaacaatacggccgtcgaccaaaaggtgcgttacgtctaccgtgatgtgcaagcaccaacgattacgacgacgaaggatgaactcgtctcatcgaagtcggggatgccggcaacagaagctgatttcctagcagcagttggctttaagacgactgataatcagcagtacggaactagtgtgacgacaaccgattatgaaacgattgccgcgcaagttgctgaagatggcgtctcacgcgatgtcacgattacagtgaaggatgcaacgggtaatacgacaacgaagacggtgacgttgacagccgttgaaactgcgccagtttcacaagaaacagcggtaaaggacgcacagcaacaattggatgatttggcgaaggatccaacagcgagcgacgctgatgtggcccaagccaagcaggcgttgcaagatgcggttgatcaagctaagcaagatcgtgatgcagccaaaacaacggctaacgatgcgttgacgtcagatgatacaacggcagttgcaacggacccagccgtggcggatgccatgcaagatttgcgtgacgctatcgctgctggggatgctgacaccggcactagtcaagccattacggatgcgacaaatgcattggagaatgccgttgcacgggcagaagcgaaggcggttgatacggcaccagttgcgcaagaggcagacgtgcaagcgaagcaagatgcgttgaacgatgtgctggatgacccaacgtcaacgacggaagctatcgaccaagctaagcaagcgttgcaagacgcggttgatacagccaagcaagatcgtgatgcagctaaccaagcagctgatacgattacggatcaggttgcggctagtcaggatgatgcagtaaaggatgctgttgcgaagctggcggatgcagtgaagaacgcggccaacaacgaaggcacgacccaggacattaccgatgcccaacaagcggttgtcgatgcggtaaaggacgccgctaatactgcattgaatcaagataatacgccggttcaaaatgaaaccagcgtgattgatgctaagcaacagttgacggatattctgaataacccagacagcacaccagaacagattgttgatgcaacgaatgcgtatgacaaggctgtcgctgatgcaaaggctgaccgtgatgcggctaatcaagcggctcaggatgaaatcacgtcagccagtcagtcaaatcaagcgaatgaccaatcggtaatcgatgcggccaagaagttacaagatttgattgatgcggcgaagactggtgaccctaacgccttgaccgatgatatcgcgcaagctacgcaagcgttgaaggatgctgttgctgatgctggtggggcccaagatgcggctcgagctgatgcggcgaaggcgttgaatgaaacgacgccggtcacgtatgagccgggtgtacaagacaagattgatgcgttgaataacgtgttgaacgatccaacggccacagctgaccagattaacgacgcgacacaagcattgcggactgcaactgagacggcggttgatcaacgtgcggcagtcgatcaagatgcagcgacggcaattacgaatgcgcaaggttcaaatcaatcggatgaaccaagtgtgcaagcggctgaacaagccttgcaagatttggttgatcaagcgaagacagataacccagacgccttgacacaagatattcgcgacgcgattaagaatttgcaagatgcgattgcggaagccgcggataatcaaggggatgcgcgtcaagcggcccaagatgcattgaatgcgactgcaccagtttcacatgagcaggccacagcagatgcaattcaaaacttgcaagatgttctgaataatccagctgcaaccacggcagatattcaggaagcaacggcgaccgatcaagtcgatcgtgatgcggcgaatacgcaagcgaatgatgcggtgtcagctgctgaaacgtcagatcaggcaactgagccaggtgttctagaagcaattcaacacctgaaggacgtgcaagctaaggccgccgccgattcatcggatgcattaacagatgatattaagcaagcaattaatgatttggcggcagcgcaagaagcggctaagcaaaatcagcaggcagctcgtgatgcagcggcccaagcgattgctgactcacaaccggtctcaaacgaggcgactgtgacgaaggcccgtgatgctttgaatcagttgttgcaagatccaagttcatcaacggccgatattgaaaaggcaacccaagccttggttgatgccaatacggctgagcagacgaagcgtgatacgatcaatcagcaggcggatgcgtatgagactaaggtcactaactcgaatcaacgtgaagaaccagccgttcaggccgctttggatgcgttgcaagagttgcaagatgaagctgcaactgactcgccagatgccttgacggccgatattgcgaatgctttggatgccctacgaacggccgtgacgcaagctgccaaggaccaagcggaagcacgtgataacgcagcggatgcgttggcagacttggcaccggtctcaaatgagccagctgtgcaagctgctaaggatgctttggatgccttgttggccgatagcacatcaacggctgatgatattaagcaagccacgcaagatttgctgaatgcaaccagtgatgctaaggcggagcgtacaacggcgaacaccgatgcacaaaatgcgatgacagatgcgcaaaatagtaagcaagcggatgaaccagcagtacaagacgcactgaagcacttgcaagatgtgatggacgcggctgcaaatgatgatgccaatgcgttgacggcggatatcatcgacgcacaaaaggcgttggagcaggcggtggcggatgccaaggatgcacaagaacaagcgcgtaaggatgcggcgattgccattgcaagcacaagcccggtatcgaatgaaccaggtacggcgcaagcgttgaacaatttggaagcggttttgaaagatccaaatgcaactcaagctgaaattacagccgcaacgaaggcattacgtgatcaaacagcaactgacaagcaagcgcgtgatacggcgaatacaaatggtgacgcggcaattaagctagcccaagcatctaatcaatcggatgagccgagcgttgttgcagcaatcaagaatttgcaagatatcatgacagctgcggtcacggatacgaacacggcgttgacgaaggatattacgagtgcaattgcagcgttgcagacggcggaagagacggcgcaagctaaccaagagcaagcccgcacagatgcgcaaacagctttggaccaaacggcacctgtttcgaatgaagcagcagtggctgacgcaatctcgaacttgcaaaagttattagatgatccaaagtcgaccgctaaggaaattgccgatgcgacgacagcactgacaacagccgtagctgatgcaaatgagaagcgtgatgcggccaataccgctgctgaccaagctgttgcagatgtaccgagtgaattgacgtcagaaccaacggttgcggccgctgagcaagctttgaaacagttgcaagatgctgcagctgctgatcaatccgatgcattgacggctgacattgaagcagccacgaaggcgctacaagatgctgttcagacagctgaccaagcgcgtgatacggcccgcgatgccgcgacagatttgttgacacaaacggccccattgtcaaatgaagccaaggttgcctcagcgaaggatgccttacaaaagttgttggatgattcaacttcgacgacggctgcgattgagaatgcgacagcggcgctacgtgacgctttgcaagcggacggcgctgaccgtaacgctgcaaacacagctggtacaagcctagttgatttggttaagggtgcaccagcctacaccgataaggcggtacaagatgctgtgcagaagttgcaagatgtgatggctgcagcggctaaggatagtgcaacagatctaacggctgatatcgaagcagcgacaaaggcgttgcaagatacttttacagcagccaacagtgatattgaagctgcccgtgatgcagccaatgcgttgctaggtaagacggccccaatttcacacgagccagcggttgcgacggcaattgccgaccttgagaagatcttgcaagatgcgtcaagttcagcagagacaattgaagcggccacgaaggcgttgcaagacgccatgacaccagctcaaacggctcgtgacacggctaatacagccggtcaaaagttgcttgatgcaacgaagaacacgacagcagccaaggacaagggcgtgcaagatgccatgagtcgtttgcaagccgtgatgacagcggcggctaaggatagcgccacgaatttggcggctgatattgaagcggcgatgaaggcattgcaagctgctgttaacacggcagacggcggtcgccaagcggcggttgatgcggctaatgatttgttgacgaagacggcgccagtttcacatgaagcggatgttgctaaagccatcaagcaattgcaggcagtggtcaatgacccaacggcatccgaaacagatattgaaacggcgacggcagctttgcaaactgcacttgatgcggcgaacaaggcacgaacgactgctgatacagctggtacgcaagcaattaagacggcgcaagcatctgaccaatcagctgatccagcagtacaagctgcgattaagcatttgcaagatgtcatggccgctgctgcgaccgacagcgctaacgatttgacggctgatattgaagccgcaatgaaggcgctgcaagcggctgtgcaacaatcggcgagtgaacgtgcaacggctgccgccgcagccaatgacttgttaggcaagacggcgccagtctcacacgaaccagcggttgctgatgcgattagcaagttgcaagcggtcttggatgatccaaagtcgacggctaaggatattcaagcggcgacggcggctttgcaaaccgcattggatgctgcgaatgctgctcgggcaaatgctaataaggccggtcacgatgcggtgacaacggctcaaaatacagctgttgctggcgatccagcagtgcaagctgctttggctcacttgcaagcaattatggatgcagctggtaaggatagtgccaacgatttgacggcagatattctggccgcggtgaaggcacttgaagccgcaattgtagcggccgaaggtaagccggtaccaacggaaacgtcaacagtaccgacaccggttgcgacgccagtaacgtcaagtggcgaaacggcaccagttgcaccgcagtctggtggtgtgttgccatatgtcgcaccaaataacacaattgtgccaacaaatgttccagtccaacgtagcggggtgctaccatacactggctacacggatgactggcgtttgacggcattgggaatcttcctgttctcagcttcattactgttcgtcgctgctaagcgtcgtaagcgtgaagaagaggataagtaaacgataatcggtcagtaatgactaagacgaaagtcgctaatccaccaactggtgggttagcgacttttcattttggctaacgttgcttcccgtgtaccgctggcgtaccacgcttttttcataatgccttccggaaaatgctataatatcgggttgagaacactttctttttagaagcgaatagcgatttaagaaattggggaattgggaaatgaaaagagtagagatgcctaaaaccgccacggcaaagcggtttttacgtaaaaagctatataagtcagggaaaagttgggtagttgccggtgcggtctgggcaacggccatggcattcggggggcaagttgtgtcagcggatgcagcgcctgttgtatcaagtgaagcaacgaatatgacgagttcagcagccggtgtgcgtgtggcacaatcggttgttttgtcgcagacatcgactagtgtgacaacggcgtcagtgacaaccaacagtgtgtcgatgagtagcagcactgtgtcatcatcagtcgcagtatcgtcaagcacaagcctacaaggctcgtcagtcattagcagtcaagctagtgagacggtccgttcaagtgcggtgtcgtcgacttcagtgacgccaagtgtttcagcgagcgtttcagtggctgccaaggcttcaagcagcagtcagtctgtcagtgtgaccgcacaaagcgcttcagaaaaaacagcttcgtcagctgaagttgtgattgatgtaccagctggtagcagtttggcatcagggcaactggcatcgctgtctgcttcagccaaagccagtcatcaaatcgtgacggtgacacagaaattggcagcgacaccagtaacggcgtcatcagcggtttctaatgacgccacgagtttgtcaaagcaaattcaatatgatgagcaaacggcgtcttcttactattcgcaattggttagtttggcttcaaaccagcccgcgttgacgtcaactgtatcgcaagctaactcggtattgggtcaattaaatggcgtgaccacgtcattagctgccgccatggcagcagctagttcagcttacgcgctgcagaacagtgcggctttttcgagcgccgtttcgacgttaacgactttgagttcagccatttcattagacacggccaagatgggggctttggcgaacggagctggaaccgtgttgaacgtggcgaacgcttcatcggccgccgcggacactaaaaacgccttgaattcaacggccattagtaatctgttcggtgcctttactggcggtggcttcttttctaatttgaccaacatggtgacggctttaggcgcagccggttcagtggctaatttacaaagttctttggcttcagtggcctcacaactacaggtagcccaatcgacagttgcaaacgcatcaaacgccagtgcactatcgacggctatgaagagtgttagtgcagctgctagtatgacgaatagtttgtatacggcggtagcaagcgcagctaatacggcgggtaacgtgatgccatctgatttcgtgcagtcatccgcagccgtgcagctataccagcaagcgaatgcgatttcagccgctattacggccgcaagttcagcggtcgatcaattgaatgcttggcaaacgttgctcggaccagtatcggctagtgcgggtagttattatcgctcaattgcggcggcctacagtcaggcacaaagcaacttggcagaattacaaagcttaggcagtgcgtttgcccagaatgaatcagccattatggcctctggtgccaaggcgaaggacattacgtcattaatgtccctgacaaactcacaatcagcggcagccgtagcggattcaagtgcggctttgtcagccgtagcggttggtcaagcggcggcctcatctgcattgacggtgttgcaaagtgcggcccacacaaatattgccgatcaacagacggtgctgactaaccagagtttgcgcgcaagtacggcaattaagcagctacagtcgatggtcgctgctaatcccacgaatcaatcattagcgcacgatttggcagatgctaagtcacaagttgcggtgattacgagcgcggtgaatgcgctcaagagcaatgatgcgctagttgatacggcggcacctggtaatttggccacgttggttaataatgcgttgttacaagtgacccaggcgaccggggcggctgatgcagcgaccacagatgcacaatggattacagcgaagctaacgaccactaatcggccaggcagtcaggtcgcagaacaggtaatggtgaagcaggccacgaccgctagtttcacacagacagatcagaagttaacggttcccggttatcaattgacggtcgcagtcaacgggaaaacctatccctcgctagccaaggcaattgcggccaatccagcgattgcacaacaagatatgacattccaagtggcctatacgcctgatacccaaaaagcaacggtgacgattgttgatgccaccacaggtaagacgttgaatacggtcaatttgacaggatcaaccgcaacggcgattgattttgacaatgtcgcgcagttggtaaaccaatatgaaacagctcactacttggtcacgacgaatccaacgacggcaggtgccacttttgacagtgataccgcgacgacacaaacgtatcaggtggtactgcgccacgcggttggttcagcaacggcgagccaaacctacacgaatacggtgacatacacaggtgcagggacacaaacaccaagcgacgcggtgacaagcgcggtagtgaccacaacatcgccaattgatttggtgacgtcatccgtgattacaacgacagacgccaagtcgtacggtgatgattattttgcaccagttgcaacggcagagggtgcaacgattgataatgctggtcaattggtttttgcaccagttacaacgccaacggttgctggctatcaagcggataccacgacggttacaggcaagattaagttaggtcaagccacgacagcagtgcaacaagttacgtacgtcccaactacgcaacgaatcgtggtgacgttaatcgatgatacaacgggtcagacgttaggcacggtcacagttactgggccatcgaatggcacgccaaattggcaagctgttcaaactaaacaggctgacctagtaacagctggtctacaggcattgctagctaacgaccaggtattacaggggcaaacctttgatacagataatgccactgatcagcaaattaccttgcattttgtgcatggtgtgacgatggcatcggttaagaaacaactgacaaataccattcattacacgggtgcgggagctaacacgccagttgataagacgcagacggtcacggtaactaagacatacgcggttgatcagtataccggtgagccgatttcagctacagctgcgagtcagtatccagactatcaagcgccaacctacgctgtttctgatgtgacggcaacggtgagcgaagatggtcaggttacctttacgtcggtcacgacaccagacgtagcaggttacgcgccaaatctaaccacggtgactggtgaaaccacgtttgaccaaggtgatacaagcaccacggtttcatacgcttcattggcccgaacggtggcggttattattaaagatgccgtaacgggggatgtcttacagacagtcacactagcaggtcaagccggcagtccgttggataagacaccagcgacgcaggcgcttgctgatttgacgagccgtggctatactgtgacggataatggtttgacgacggcaccaactgttatgccgacggaagtgatgtcgccgattgtcgtgacgttgggtcaccaacaacacgaagcgacaaaatctgtgacactaacccatacggttgtctatcaaacagcagacgggacgacaaaagcgccgactgccacacaaacggcaatcgttacgcggcatgtgatggttgatgatgtgaccggggatgaagatgctaccaccgtgacttatacggtgactggtgatggaacagtcgatgcgaccacgggtcaggtggactttgcacctattattacaccgacgttagcgggttataccgctaatcacaagacggtcactgcaacagccacgatgacttcgcctacgaagcatgatgttgtcatctatacaccagcaacgcagacggcaactgtcacgattgttgacgccactactcacgatacgttgacgacaatgacgttaactggcgcatcaaatagcacggtgccaaccgatgctgtacaaacgtatcttgataagctaaaggccgcgggctacgatgtgaccgacgccttacagccattgttgcaacaagcgtttgatactgatgataccgtcgatcaaccgtatacgttgacggtgacgcaccatgtgagccagcaaagtgagacgcggacatcaacgaacacaatcaaatatatcggtgcgccgactgtgattgatccagttacacaaacggttgatgtgacccggacgtatagtgttgatgatgtgacaggacgcgaaattcaagcgacggatgctgacaagtacggcactgcttatcaagccgaacacttcaccggtagtaatgatgcggtcgcgacggttgatggcacaacaggtgtcattacctatcagacaatcccaaccaagccacaggccggctataccgcgaaacctgatcggattgatgcggttgccacgtttgataatttgaacgttaatgaagtcgtacaatatgacgccaagccacaacgcgcgcaaattacgtttacggatgccatggcagataatcgtgtgattacgacggtttatctcaagggtgaaacagatggcgccatggatcaaactgaagtgcaagcacaaattgcggccttggagaaggctggctatgtgttggtaacgaatgccttcccaccgacggcaagctttgatgcacaagacgatggtgatggtgtaccgtcacagttgtatgagattgtgtttaagcatggcgttacaaccacaacggatacgaagccaatcagtagcacaattatctatcaaggaacaacgactaaggtaccggaccaagttgtgtcagtggaagtgacaaagacacagtcggtggatgcggtaacgggcgatgaaattttgccggcggatgctgctaaatatgagggttaccaagcgccgaggtatgcactagcaacggagaacgcagcagctagcgtagatgcgaaaacaggggttgttacgtttgcgccggtcacgacgccaagtatgccaggctacacgggtaatccaacgcaagtcacggcgacggctagctttgataatccaacgacaactgcggtagtaacttatacgccagcagaacagacggcattggtcacgattcatgatgaaacaacgggcaaggacttgccagcaattaacttagcaggtaaaactggtgacacaatttcctttgcaactgttgagcaggccttgcaggcgtacgttaagaagggttatgaagttgtttccgatcaggaactagtggcagggacgctatttacgccggccacagatgatcagcaaacgttccaagtgacgttacgtcatgcgacgaagctggaaacgacgccaattgatatgacgaatacggttaattatcaaggggtaacgttgccaacgacgacgcaacacgtgacggtaacccggactgatacctgggatttggtgacaaaccaggtggtggcgtcaacgtatatggtaccggctgatgcgccagtcacgattgacgaggcaaccggcgcagtcacgttcgcccaggtggattcaccagcggtggcagggtatacagctagtcagcagaatgtgcaccaacaagtaacggtgcaacaacctgtggcgaacaatactgtggtgtacacgcctgatatgcaaaccgtgattgtgcactatgttgatgttaatggtgacaagacggttgcaacggtcacgattaatgggcgcagtgatgcaaaaattgatacggcaacagccaataagacactggccaatttaaaggcggccggttacgtgattgttgacgcaggtgattggccagctacttatgacacggatgatgcgacgccacagcaagtgacggtacgcttggatcatggtacaacgacccagcaaagtagttatccggttcactatacggtcaatgctgtaaccgcaccaaatggccagccagtggttgtggccacacaaacagcgaccgtgacgaagactgtcgttgtcgatgcggtcacgaaagcggtattgacggatcaagcgccaacctatgccatcacgggtgatgcaacgattgcgactgatgggacggtgacgtttaaaacagtgaccgtaccagctaaaccaggctatacggtgacgcaatcaacggttaacggccagttaacaccgcaacagcaagcaggtcaaacgaccgtgacgtatgagcccgatgtgcaagtgacgcatgtgattgtgcgtgatgcggtaacgggtgaaacggtaactagttatccagtgtcaggggtgacggatgcaactgtaccgttgacgagtttgccggatgtggtggcgaagtatgtaacggcgggctatgtcgcaccggatactttgccgagtcaggttgcctttggtgcgactggtgcggctgatgtagtagtgaccttagcgcacggttcagctgtgcaagtcacacagcataaggtgacgaacacggtgcactatgttaacgcaccaacggcattggctgatgtggttcagtcgccagtcgtcacaaagacgattgttgttgatgctgtaactggccaacaaacgactcaggcaacgtaccagacaacgggtgcgacagtcgatgccaaaacgggcgtggttactttcccacgggtcacgaccccagcccaaccaggttatacaccaaatcagcgtcaagtgacgggtcaagcgtcatatgatgctgatgggttagaacaagtgacctatacagctgatcaacaacgcattcatgtggtttacgtggatgacgatgcacatggtgcagttgtccaacatggcgcggacgtcattggccgttcggatgaagatgtttacttccaaccaattgaattagcaaattatgatattgcatcagttgatatgcaggatgcccaaggctttgatcatgatgataatcacgatcaaacaattacaattcatttgacgcatgatgttgggacagtggttgtagcagttaaccgcaatgttagttaccaaacgagcaacggctatccagcgccaaagcaggtgacgcaacaagtgacgttgcatggtcaaatggatttgattacaggtcaggtaacgtggcaaccggtgacggtaggtgcagttgatacgccaacgatgacgggctttaccgccgatcaacgccaggtagcagcggtgaccatcacgtcaccaacggacgttcaagatgtgacggtgcactacacaccacagcaacaacaggctcacgtagtgtacgtggatgatgaccaagatggtcggattgtacaaaccggtccaacaatcacaggcttgggtggtagtcatgccacagtaaagccggttggtgtaccgcactatcacgtgattaacgaaattggtggcatcgactttgactacgacacaacgactgatcaaacgattgtggtgcatttaggccacgatcaccgtcttgtgacaacgacggtgcaacgaccaattcattatgttgaccagcatggccaccagctcgtaccagatactgtgcaagcaaccgttttgacgggggatgaagatttggtgacgcaggttattacctggttgccaagtgaattgctagctgaagcaacgccggtagtggcgggctatcagacgtcaacgactgaaatcgcaacggttgcggtgactatgccaggtgatttgcctgctgtgacggttgtctatcaaccaattccggttacgaccgtgcaaccaaagcgtccggttaagcagcaaccagttgtgaagcatgtgccagctaagtcagcagtacagccagttgcgaaggtaagtgctaagcatgttgtcgcaccagcaccggtgccagtcgcagttgcacaaccgacgcaagcgggtatgacgacgacggctagtgcaccggcaacgccagtgattacggcagcgaagcacccattggtaactagcgaagccaactcagtttcagcagcaacgttgccagaaactggttttgaacaagaatactggctaacgattgctggtttgctaagcttgttggcgacagctggtgtggttttgaaaaaggttttgtaaattaatggtactgggaggctagaaacctagagtttccggcctcctttctgtttgcagacctggtaagatggaagtaaagaaaaattggagaggtttgccaaaatggctaagaaaaagaaaaatcccgtaacgacgtgggtcaagcgactcgctgcgctatttatgctgttcctgatgttgtttggtgtgttctgggcggcacgttcagctttcattcagaatgaaccaacgagcagtaaaaaggcccaacaatcatcagctaaggcggatacaccgattgcagaactcattctaacgaatggggagtcgtatattttaccaggcacagatacgatttcaaagaacccagaaacggtgaagtcgattgtgcgtcagtcagacggtagttatattattacgaagccggatgatcaaacccgggtgaaggtcttgaaaaaccaagttcgtcaggttattcatgaaaagtaagcgaaattgtttgatacaatagacgtattaaaatggatttgggagataacgtaatgaagattgcagtgattggcgcaactggtatggcaggacgcgcaatatttgaagaagcaacaacacgtggtcatgaagtgacggctattgtccggaatgtcgaaaaggcacgtgccgaacttggcgccggggcaacgctgttggtatcagatatctttgatttaaagcgtgcgacgttagaacagtttgatgttgtggtcaatgcatttgccaaccacaaggaggcatatttgaatttggatgcggtgacgcatttgattcatgaattccgccaatcagaaacacgggttattttcttgttgggggcggcttcattgattcaagcgaatggcacacgcctctttgatttcttggtcgagttaccaggtaatgaagcttggattgatgagccacgttatggtgtgctggaattagatattttgcgggcaacgccagatgtgaactggactggtgtctcaccgcaacaaaacttcacgccaggaccagcaagcaagcaccgcattgcgttgaacgatttgttattgtcagcagatggtaagtcacacgttacggccggtaacatggcggtcggagtgttagatgaaattgaaacaccccaacacatccgtgaacgcttcacggtttcagatatgtaattaagccaaaaccatcaagtctaatagtgactttgatggttttttggtgtgtcgtgctatcgcacgagcaacaggtcgggggtggatcctacgcctttgttcaaaacatcggcaaccgaatggcgcagacgccattcagcggggcaagtaattccccctaaagcctccgggtctgtgtgggcttttctgaatagcgctggccatgcggcatgttgccgatttttgaacgctccggatccacccccgacctgttgcaacagccgagatgtactctgatgtttgggaatttcaaagttgtgtaggcatgcataattataatgacaatcccatcaccgattaccaaacaaatagagattatcttggctgctagtatggtgggtggggtgtgacgtagtgattggccggggtgaactcacaagttcggccgaccgccggttagataaggagaacaggccttgacccttagcccaattatttgggaactagccggtgcttgtgccggcggagtttaccccggtcaatctttggcgaagtcgcaccccacccaccatacttcgtcgcaacgcgacgacccaataatccaataagacttactggtcaaaaatcgtgcctaaaccactaatttttggtaaacttaattttcggacaaacaaattttaggagttttttatgacagaacatttggtattacgcgccctacaggtgctattaatcattgcattaattgggatggcaattttgtacatcaccacaatgcgtcgcaacaaagtaaacctactccaaaagtttgtcccgggattcatcattgggtttattacagatttcggcgatacgatcggtatcggttcattcgcaacgacgaccgcgttctttaaaggttttaagtggctggatgacgatcgtaagttgccgggtacaatgaatgctggtcatgcaatccctgtgtttgtggaagctttgttcttcctcacatccgttaaaattgaagtgtcaactttgattccaatgacgttggcggcggtggccggggcggcatctggtacgcgtatcacggccaattggccagtgcgtaagatgcaacgcgggctatcgattgccttgacgctggcggccgtcacaatgttcattaagttgctgacgaacccaggccatgctgaatcaatgacgacccacgggttgcatggttggctacttgtcttgggcttggtggtcaactttacgttgggggtgttgatgaccattggcttgggaaattacacaccagagttgatttttttctcactagtcggtgttaatccgttggttgcctttccagtgatgatgatggatgctgctatgatcatgatgacgtcagcgattggttttgtgaagaccggccgtgttgagtggcgtggattcaccggcatggcaatcggtggtgttatcggtgttatcgtggctgcaaagttagtgaccaacattaacattgccattttgagctactttatcgtcgcactagcgttgtacacggcatttaatctattccgtgattcacgtcaaccagaaccagcagatattattaatcgcgataactaatttctaaaagcaatgttgccagaaaaaataatggcagcattgctttttaatttcgagacatcgcgataactgacaaccatgttattagtatctgtttatcggaaaaggtgcgtgctataatagatttattacatgagcgaatccagtagggattttggtggacatgcagagagctagtggatgttgtgagctagccaagtccaaaacctgaattacactcgcacaaacatcatgtacgtcaccccaacgttactgggaagatgagtggtcacgaaatatcgtggcaatttaggtggtaccgcgtttaacagcgccctaatcagtgttaactggttggggtgctttttattaccccaaccaaaaagaatgtcatcattttttagaggagagtagctatggcagaagatattttgcaagaactagcatggcgtggtgccatcaatcaaacaaccgatgaagatggtctacgcgagcaaatgaccaaggaacaaatcggtgtgtacgtaggaatcgacccaaccggggattcaatgcacatcggacacttgattccatttatgattttgaagcgattccaattggctggtcaaaagccagtgatcgttgtgggtggtgccactggttcaatcggtgacccatcaggtaagaagtcagagcgtaagttgttgtcacaagaggacgtggctgctaacgttgagaagattcgcgcccagatggtaaagttgttcggtgaagatggtttcacaattgtgaacaactttgattggttgggcaagttgtcattgctcgacatgttgcgtgaatacggtaagttgttctcgatcaacaccatgttggcgaaggatgtcgtggcgtctcgtttggaagccggcatttcatttacggaatttacgtatcaaatcttgcaatcaatcgacttccatgagttgtggaagcgcgaaaatgtgcgcttgcaagttggtggttcagaccaatggggtaacatcacgggtggtatcgatttgatccacaagcttgagggtggtgaagcaccagcctttggtttgacagtgcctttgctgttgaaggctgacggtacaaagtttggtaagactgaaggtggtgccgtttggcttgatccagagaagacgacgccatttgagttctaccaattctggttgaacacagctgattctgatgttgagaagatgttgaagtactttacgttcttgtcacaagacgaaatcagcgctttggtagccgacttgcaagaaaatgcagctgcgcgcaatgcacaacgtcgtttggcacaagaagtgacgacattcgtgcacggtgctgaggctgttaagacggctgaaacgatgacgaaggtgttgtttggtaacgctgacgtcgctgaattgacgactgaagaagtggcaattttggctggtaacgtcccaacgtttgaaatcgacaatgctgaaattggtttgttggacttagttgtggcagccggcttggaaaagtcaaagacagccgctcgtaagtcagttaaggatggtgccatccgtatcaatggtgagcaaatcactgatgaagaagctgtcattaacccaaccgcaaagtacgatggacaatatgtcattgtgaagcgcggtaagaagaagtgggccgtagcggtcgtacgttaataaaaaatgcctgatggaaatctccgtcaggcattttttcattagtgatgacgctcgctacgtgaagtaggttgttggtcaacttcaggttgtggcgtagtctgttcttttagaattggcgcgtcggccattgttgttgttttaacaatcgcttctgatccagcgccactaattttctcgtacaacaacttatgctgtggtcgaaaaatggtaatcagccaatcaatgactaaaatcaccgctggggccgcgaacagcaagatgaatgtataggtgcggttcaaagtttcagctgaaacggtcccggttgagccaatcaattggagccagaatgggaagaagtaaatcgtaaatccaaccattaaagcgttacgaacaatgatgcgccaacgttgtgacttggcgacatcgtaacgaatgcgtacgaccatttgtcccaatgatgcgccaagcaaaagtggcacaacaccccaaataacaaggtaagacaagatgtcagcactcgtttcattgggcaaaatttgcgtcaaaacgaaactaatggccgttgcaataacgaaatccaagccaaatgatagtaagcgacgtaccaatgttacacggtggccaagactgcgagcgcgttcatccatccgatcacgagatggcaacaggataccaagtaatggcgcgaaaacccagccaatcaggccaccagtggtgttcaaaatcaaatcatcaacgtcaaacaaacggtatggacgccaatagatatggtacaaaccggtgtattgggttgtttcataaaagagcgtcagcatgaatgtcaaaattaaggtggtgaagaagccacgcttgaaatagaagtgcaagtacatgccaaatggcacggttagtaagacgttaaaggccgcttgcgtaaaggatggatccaatagaccggcttttaacccaccgccgtggaagtagggattgtcttggaagaaggtccgaacaacttgcaagggatctaaattacgcgttggtgcgccgatggcttgcaagtgttcgagagttgcttccgttggtaatggtaaaataaccaagaaaaatgctgtcgtgaaataaaaaacaaaactaaacgtcatcaccgtgtgccaaaaggtcacggcaccataacgacgatactgtaggaataaaaatggaatgaatagcgctatcaaaataataggaaatgcaatgatagcgtcgataataggaacgccaaatccgctcacgagacttacctccgtttttctgtcataatgaattatacagggttgtaacagtaaattcacttaaacttcacttgttaaaaaacaagcaaagtcgccctttgtggacattgtcgcaaattgtttttcacaatcttggctttttttgttgcatttacttttcgtaagtgtaaaattaaggtcatcaattaagagaaatagtatttttgaaacgaaagaaggaataatactcatggctacgatgaaggctgttgtatttgatgaatttggtgacgttgacgtattccacgaagcagaagtggaaaagccagttttgacgaagggtagcatcttgatcaagcaagctgctatcgcaatggacccatacgacgtgaagttccgtgccggtgcctttggtgtaccagctaaggaaaacatgatcggtggttcaacgattgccggtgttgttgaagcggttgcggctgatgtaactgagttcaaggttggtgagcgtgttgtggcagttcctcacgagcacggttacgcagagtacgccgttgttgacgctgacactgctggtcacttgccagattctgtttcattcgaagatgctgctgcattggctttgggtggtcaaactggttaccaagccgttgttgacgctttgaacttgcaagaaggtgagtcaatcttgattcacggtggtgctggtgccgttggttacgccgctttgcaaacggctttgtaccgtggcgcatcaaagatttacacgacttcattgccaactgatattgattacctacacgagttgaacgaagacatcgtggcaatcgacttcacgacgcaaaagtttactgacgttatcccagagtcatcagttgatactgttgttgaaatcattggtggtaacaacgctttgggttcaatgcaagttttgaaggatggcggacgtatcgtatctactgttcctttgggcgacgacgttaaggctgctcgcgatgccaagaacatcaagggtgactactacgtgatgcaatcaacgactgaagttttgacgcaattgatggagcacttgggaaacggtgactacaaggttgctgttgctgaagtaaagccattcagcttggaaaacttgaaggaaggtcacaagattgttgaagcacaagccgttcgcggtaaggttgttttgacgttctaattgactgattaaaactaatcgacaaattaaaaatccgcatgaccttttcctaccggtcatgcggattttagtatatagtagtgtcggaaagtgggacagggatgctgcctgtaattaagaaagcagaagaaggataagaacatgacacaagaaccacttgtaacggttgccgttttgagtcataacctagaaggctatatcggccacagcctaaaaacaattaataagcaaacatatcggaatatggatattgtcattttggatgatgcgtcaacggatgatacattgacggaaattaatcactgggtggcccgtgatgatcggatgcggttgattaagaataataagcgtcgtggcgtggcgacgatgcgcaatcgcgcgcttaaggaaattcgcggtaagtacttcatttttgttgatggggatgaccaattagcaccagcctttgttgaaacgctagtgaagggacttgaagaaaatcccgatgttgatatcgcaagcgtcggttttagctggggcgccagcggtgtacctaagaaggcgaacgaagttaagttccgccgcattgatcgggctgcgatgtttgaaggggttactcatagagggcatgtcatttcaggcatggtttggaacaaggcgtaccgttcagctaatctattagatagtcaggttcgctttgacgaatcattggagctagccgaagatcacttgtggatcgcccaattggtcgcatcaaaggcgatgtcagagtattcaatctttgcatcggatgtcttgtacaacaaggtatcacggtcaacgagtattattcacacagcgtcacatgctttacgtgagcgagaacgcgagattgaccaacaaatcgcccgcattggggataacataatttagcgatgatgaagcagtgtggcactaaacggcacactgcttttttgttgtgtgtcgtgctatcgcatgagcaacaggaccggtaaagaacatgattgttcgcgtaattataacaatgactagcaaacaaatagagaatatctcggctgccggcatgggtgtgggggattggcgtagcgatgacaggtggggaactcacaagttcggccgaccgccggttagataaggcgaacggacccagacccttagcacaattatttgggtgctagccggtgctcgcgccggcggagtttcccacctggcatctttgtcggagccaatgccccacacccatgactcgtcgcaacgcggcgatgaccacaacttactttttgcagttgacaaaactctcattttaatctcataattgtggcacatcaaaaatattaggggaaataattatggggaagacacaggtaacagatttagattgggataatcttggcttcgcgtatcatgatttgccataccggtatcgtgcagtttaccggaacggggcatgggagcctggtgagctcatcacagacagtgattttcaaattagcgaagcggcagttgcgctacattatgggcaacaagcttttgaagggctgaaagcttatcgccgcccagatggtggggttaacttgtttcgcccagatcaaaatgcggcccgcatggctcgctcggcggaacggttgcggatgccagcctacccagaagatttgtttgtcgaggcggtgaagcaagttgtggctgcgaatcaagaatttgtcccaccgtatggttcgggagcaaccttgtatctccgaccattgttgattggatctggtccagctgtcggtgtacaccccgctgatgaatatatttttaacatttatgcgacgccagttggggcctactataaaggtggcctaacaccgactgcgtacgtcacgagtgaatatgaccgagctgcccacggtggtacggggcaagcgaaggtcggtggtaactatgcggcttcgatgctgcccggtgaacaagcgcacgcggctgggtactccgatgtggtgtatcttgacccccgattgcatgaaaatattgaagaacttggttcagcaaacttcttcggtattacgcgggatggccgtttcttaacaccaaagtcgccctcaattttgccatcaattaccaaatactcattgctggccttagctaaagaagctggcctgcaacctgaggaaaccacgattagtattaatgaattggaacaatttgaagaagctggtgcgatggggaccgcggcggttatttcaccggttggttcaattacgcatcgtggccagaagcatgttttttattcagaaacagctgtgggaccaaagacgcaagcgttatatgaccgcttaactggtattcaatttggtaccgaagttggtccggccggttgggcagtcgatgtgccgttacaataactgaaaaattacctggaaaccggtttggatgattgttatccaaccggttttttacatatttttgataaataaagcaataactagataaaaaacttttatgaaaacgcttgcataataaaaagtaagcgcttacaataaatgtataccttgatgaaaggtaaattaataatttattaaaaatatatcatttagtatttgatattgggggaaataatcatggcagagaagacgattatgttagcttgtgcagcaggtatgtcaacgtcaatgttggttaagaagatgcaagatgccgctaaggctgctggcaaggattatgaaatctttgcaacatcaacgtcagacgttgatgagaagttggcaagtagcaacaagccagatgttgtattgcttggccctcaagtgagttacatgaagaaggaaatccaagccaagacggatgccgccggtgtcccattggacgttatcaacatgatggactacggcatgatgaagggcgacaacgtattgaagacggcggaagcccttatttcttaaagagttacaagcagcgatttggtcatgagttaatattcgggggatgacgtaatggatgacgagcgtatggcggttgtaatgggattgattatgcacggtggtaatgccaaggggcaagccttccaagctattcaatttgcaaaggcgggtcagtttgatgaagctgacgaagcgttggtagcagcaaatcaagaattgaaggaagcgcatgatgtgcaaaccgatatgttgaccaaggaagcccaaggcgagcataccgaagttgatttatacatggtgcatggtcaggatcacttaatgaatgccattactttccgtgatatggctgttgaactgattgcgttgatgaagcgggtacaagcattggaggaaaagtgatggtaaaaggatatcgcatgcccgacggcttcctttggggaggggccgttgcagcgcaccagcttgagggggcttgggatgttgatggcaaaggtgtatcaattgcggatgtgatgttagctggtaagaatggtgtgccacgtgaagtgactgatacggttctaccagatggcaactatccaaatcaccgtgggattgatttttatcacacttatccagctgattttaaattgatgaaggagttgggcttgaaagctttccggacgtcaattgcttggacccggatttttccaaatggggatgagacggaaccaaatgaagcgggactcgcatactacgatgccttgattgatgagatgttggcgaatggcatcgaaccagttttgacattgagtcacttcgaaataccgtatcatttggtgaccgagtatggtggctggcgtaatcgtcagttgattacattttttgaacgctttgctcgtgttgtctttgagcgatttggggatcgcgtgaaatactggatgacgttcaacgaaattaacaaccaaacatcctggatggatccacaccccatgttgcaaaactcagggttgaaggattatgacgaagcagatgcggaagaattgatgtacttggcatcacaccacgagttggtggcctcggcattggtgacgaaagctgcgcatgaaattaatccgaatattcaagttggtgacatgattgcgatgaatccggtttatccggcaacttcgaaacctgaagatattatgatggctgaacgcgccatgcaagcacgctacttctggggggatgtacatgctttggggcaatacccaaattggttgcgtaagtattgggaacacaagggattcgatattgatgtgacgccagaagatgaggctatcttggccgcaaacacggttgattatgtggcgttctcatactatatgtcatggacagtgacggatactggtgatgaatggctcgcctacaacgaagaaagtaatcatggcgataatccattcttacagaagtcggattggggctggcaaattgatccagtcggcgtccgttgggccatgaactggatgtgggatcgctggcataagccaatgtttatcgttgagaatggctttggcgcttatgacaagttggaagctgatggcactgtgcatgatgattatcgcattgcctacttccaaggccacatcgaagcgatggaacgcgcggttgtgttggatggcattccgttgattggttacttaccatggtcaggcatcgatattgtctcagcttcaacgggtgagatgttgaagcgatatggctttatctatgttgatttagacgacatgggtcaaggtagtggcgaacgatatcgtaaggattcgtttaagtggtaccagcaggtcatcgcatctaacggtgaagatttggaggtgtaggatgacgcaaccaaacatgccggcagattttttctggggtaactcagtgtcatcaatgcagacagaaggtgcctggcaggaagacggtaagggactgtcagtgtatgacgtgcgaccagccactgatcacacaatggattggcatgatgcgattgatgagtatcatcgttataccgaagatttggatttgatggcggatatggggatgaacatgtaccgtatccaaatttcatggtcccgggtcgtgccagatggtgatggggcgtttaatgaggccggcattcagtactatagcgatttgattgatgcgatgattgcgcgcggcattgaaccaatggtgaatttatatcattttgatatgccactggcgttagcgaaatcagataacggctttatgtcacgacatacggttgacgcctttgtccggtttggcgccgagatgttcaagcgtttcagtgatcgggttaaatactggattacgttcaatgaacataatctgtattttaccgatgaggtgtttgagatttcaggttatgaccatggggaacggacgttgtcagagatgtatcgcatcttccatcatacgatgttggcccatgcgcgcttggatgcgattgcgcataccaagtatccaggcttacaacttggcggtatgctagcccatgcggcaacgtatccggcgacatcgaaaccagaagatgtctatgcagcgcgtaagttgaatgagtttttgaacaacaacctatatgatgcgtttgttttgggccgttattcacatgaagtcatgcactatgtgaaggtccatgagatcgattgggattaccaaccggaagatgcctctgtactaagtaagatgcatgcagatttcttggcgttttcgtattatcgaacggatacagtcaatgcagataagattccagccggtgaggcgccgaatcgttatttaaacacagcaaatgagacgaatcgtttcttagagacgaatgactggcaatggacgattgatccattgggcttccggacaatcttggcggatgtgtacagtcgttatcgtgtgccaatgttcccaatcgaaaatgggattgggttacatgaaacatgggacggtgttcatgaaattgcagatgagcggcgaatttcatatcatcgtgaccatattcaggccatgaaagacgccatgtttgaagatggtgtcgcagtactgggttacttgggttggggcttaattgatatcccaagttctcatgcagatatggagaaacgttatggctttgtttacgtcaaccggtcgaaccatgatttgaaggatatgaggcgcgtacctaaaaaatcttatcattggttcaaacaggtcatggcgacaaacggggataagctgtagccactttagggggaaacattatggataatgttggacgaggtaattgggtcagcgagaagttgctgccacccattatgaaagttgttaatacgaaggcgatgaatgccctgaaagatgggatggtttactcactaccattcatcatcattgggtcaatctttttgatcttatcgaacatcccgtataagccagttgcgcaagcgttgactgattcgggttggagtgccatttttacccaggcatataccacatcattcgggatcatggcggtctgggcagttgttggaattgcctatgtttatgtacgtaatgaagggtttgaggccttgcctgctggtttgacctcacttgcaatcttcctgggcttgcagtcattgcaagttgcctcaccattatcagcagcaatgggtaaggctggttcaggagtgggtagcttatcagggacacaagtagcagaacacatcgataagttgccacacgctttgcaaactttcttgacgtcaccagttactggggcaatcaacatcacctggctgggtggtcagggaatgattgccgccatcttgattggtatcttcgtcggttggggatactcagctatgttgcgtgccggttggaagattacgttgcctgagcaagtgccagctaacgttgcgaaccaatttacggcaatgattccagcgggtgttttgattaccgtagcgatgtttatctacgccttcttcagcttcattgtgaaggaagacttgttgcaaacgatttacacgttgatccaaacaccactacaaggattgtcagattcattcggtggcgctttgattatcgccttcttggtaccgttcttctggttcttcggtgtccacggtgggttgattatgggagccattacaactggtttgttggtaccaaacacatttgataatgcggctttgtaccacgctggcaagttgtcattggctaacggtgcccacatcgtgaccaacgagttctacaacaacttcattaacctgactggatcaggtattaccattggcttggtgatctttaccttggtggctgcgcgttcagtgcaattgaagtcattgggaaagattgaagctgtaccaggtttgttcaacattaacgaaccattcttgttcggattgccattggttttgaacccattcttggcgattccattcttcttgacgccggtgctagttgccgcatcaacatacttagtcatctacttcggtattgtgccaccactaaacggtgtggccgcaccttggacgacaccaccaatcatttcaggattcttgatcggtgggtggaagatggccgtttggcaagctgttgttttggtaatgtcagctgcgatttactggccatttgctaagaagtacgacaagatgttgttgacgcaagagcaagaagctgaggctgctgaaaacgcctaagcaatttgttatcggtcaacgaattccctgaaaggggggatgcggataacatgacaacccaaagtgttagcgtgtccggttacatctccgtgtaaccgattaggtacgctctattagaagcgacggtctatcctccagggtaggccgtcttttgtttttagaaagacaggtgaatacagatggcgaataatttgacgattcataccccaattgcgtttaatgatttggcgggtaatttaggtcgcaaagttgaagaggttagcttaacgattgctggtaatcacttcgatgcgactaaaagcacagcgttatcttgggggctgatgttagcgccacagagcggtcgtgaaattggggcgttaacgctagcagaaaacggtattaaattgcaagacgcaaccggtagcgagattgagacagtcacatatgaagatgtatcgcgggttgaagtaggtgtcctgcagtcgttatctcgttatagttcggcagtcttgccttatcgtcatttctggacctttatagaaataacgttacgtgacacccgtgttttacagtttattaatgctaatctggcagctgcaccagtcttattgacgtatctcaagaaacaagcggttcgggaggtagttgatccgtttgaattggttgatttaactgcgactgaagtgagcacctacgtgacacaacattttgaaagccaggctaagttggtcaattatcctgtgacagtagctggattgggtaattaacattcattatgataaactgttgacaataattagaaaaagattagaattaaaaccatcaagaaatcaaggagagcaaaaatgatgatgacgccaacaatcacaactacaaacgtctattacttttggttctttcggcaactatccgaattgagctaaaagcatttttgcatggcttctcggatagtgattaaaacatccgagaaaccaaataaaacgcccgcgattttttgcgaatacgtgtttaccaggtaaccggatgttttccattaaggaaacgtccggttttttattgtctaaaggagaaatgattatgcccacgatgaaagagtcactcagccaacgattgaaccaagatttagcgaaaatccagcccaacgaaattcgagcgtttgatgcgaaagtttcggcgatgccagacatgattaagttaacgctcggtgaacccgatttcgatgtgcctgaagtcgcaaaaactgcagccattaatagcatcactgccaatgattcccactacgcgccaggcaatgggtcggtggcgttaagggaggctgcaaccaatttcttggctgaccgctatgggttaacatacgatgcggatacagaagtagtgattacaatcggcgcgactgaggcaatctatgccacgttaacagctgtattgaatccaggcgacaaagtcttaattccgacaccaactttcccactctatgatgccattacgctcatgaatggtggtgaacccgtgtacttggatactagcacaacgggatttgtattgacgccggcgcaattacgggcggcgattgcggaacacggtgatgcgatcaaggcaattgtcttgaattacccctctaatccaacgggggtgacttattcagccgcagaattaaaggcgttagtaactgtcttggctgaaacggacatcatcgtgattgctgatgaaatctattcagaattagtttacgaaaccgcccatgtgtcaattgccacctacttgccgggccagacgttgttgctaaatggggtgtctaagtcacatgccatgacgggttaccgcatcgggtttatagccggaccggcgggcttgatgcgcacggtgggaatgacccaccaacttgtggtgacgtcaccatcaaatccggcgatggctgccgcaaccgtggcgttaggaacccaagcggggcatgaagcaaccttagcaatgaaagcacaatacgctgcacggcgcgatttcgtggtggaacagatgcgggcagcgggctttgaggttgaaacgccaggtggcgctttctatgttttcgctaaaattccggctacgcataaccaagatgatcgtgcatttgccctggcacttgctgaaaatgcccatgtggcagttattccgggtagtgcgtttggtcaaggcggtgccggctacttacgtctcagttacgcaacgagtttggcaaccttgacggaagcaatgcaacgaattaagacatacatgcaaacagcaatgactgtaggagaataaaaccatgaaaattttgatgacaagtgttcgagatgatgaagcagcagcaattgcagcctacacggcccggacgggtgttgagattatcacgtcagcagcaccattggaagctaaccttgaccaattggcaacggttgatggagtgattatgcaacaacggaatcgattggctgatgcaatttacgcacaattagctgaagccggtttgaaacaaatttcaacgcgaacagcagggtatgatgtgataaatgtgccactcgcccatgaacatggcttgcgtgtgacaaatgtcccggcctactcaccacgaagcgtcgccgaacatgccctgatgcaaattttgcgtctgctacgtaagtcttatgaagtggatcgacgtgtggcaaacaacgattaccgctggggcgggttgcaggccaaggaaattcattccgcaaccattggcatcattggcgttggccgaatcggcggtaccttggctaagttattggccgcgttgggggcaacggtccttggttatgatgttaatccccgtgatgatttggcaggtattgtgacgtacacaaccaaaacggatttgttgcagcgggccgatgtagtcagcctacacgttgatttaaatgagacgtcagttggcctaattggtgctgccgaatttgcgttgatgcaaccaaccgcgggcttggtgaacactagtcgcggaccggtaatcgatacggaggcattaattacagccctggagacaggcaaattggccggagtagcattggacaccgtgtcaggtgaagaaactatctttaatgtcgatcaccaggcagacggcttgacgagtcagccaaatattgaaaagttgcacgcgatgtcgaatgtcatattgacaccgcatatcgccttctttacgaatattgcggtgcaaaatatggttgatattgccctggatgatgtgcaattaatcttgaacggtgagacatcaccacatgaaattgagaggtgagcataatggaaaaaccacaattagcagtaaagccaaccatcatggccgttttgaacggtaactcatttgcggtcgtcgctgcattaattccggccgctttgattagccaactactcaaagcgctaccgcaaacagggctggttgggcaagttgaagtaatggtcgcattggcacaaagcacgttaccattgattgccgcatttgttgttggtaatatgttgcgcctttctaatttggaaacagcatcaatggcgttggcaacttttgtcgcatcgggcgttgtgacagttaagggtgatgcttacatgattgccggtactggggtgattttgaatatcatgttaacgaccttgattgccagctatgttgcccgcttgagtagtcgattactgggtcaattacggatggtctttgaaccattggtcgtactgcttatcagtggtgggattggtctactgacattgccgatcatggtggcggtgcaaggtgcagtgggtcaagtcgtcgcccaagcaacgcgggtatcaccattgttgatgggggtcttgttggggatgctttttgccttcttaattgtgtcgccactctcatcagttggcattgccacggcgattggcttgtccggcgttggatcgggcgctgcgaatgcgggaattgtcgccgcagcgattacgcttgcagtgatgggagctggggtaaattcaggcggggcaatcattgcccactttatgggttcacctaaaattcagatggctaacatgttatcacatcctaaattattcatgccggtattactagctgccggtgtgagtggtggcgcggcgagtttgctggggatgtcgggcacggccttttccgccggctttggcttgtccggctttattggtcccttgactgcgctgaatgagtcgcagggtgacttattaggtattcgggtgatactggcgtttattgtggtgcccttactattgggcatcttaatgaaactagtatttatgaaaaagatgccattgattcgaggtgaagaattagcgttaccagatatttagggcgttccaaaagcagtcgcgttggtgactgcttttttatatttatgtcagaattgccgttgtgctaaccgcattcctgacatatactcaaggggcaatctaatagtcgagggggcgaaacaattgcggacattttttaatgtggcagatttaagtttgccagtcatggttgaacacgtgggggcggaatggcaacagggggttattattcgctatcagggttttccgcactttcattggttgcagtcacaaactgggacgggggcgttttgggtgcgtgacaaacgctatgagttggcacctggcatggggattttaattgcccctggcgtgccacaccgatatgagccgattggcaacgaaccgtggcacgtccggtttgcaactttccaagggtccttggttgatgatttacaaaaacaaatggtgaattcagagtttgttctgattgaggcaagcgatgcacaggtgtatgaacggttgcatgagacgttattgacgcgattaggtcatgagccggcggatgatctagcaatctcggcggctgcctatcagctattgctgtgcctgactcgccatcagaagcaaacaattgatcaacatcaaccagattttcaacaatatgttggaccagcgattgcgtatatgcaggagcacctagcagaggatatttcaattagccaactagcagcaatgttgtcagtgtctacgcagtatcttaatcgggtgtttaatcgattagtgcagcagacaccgagtgaatacctgacacagattagaattagtcatgccaagaaactgctggtatcacaaaaatatttaaaaattaatgtcgtggctgaacaaagcggttatgcagacccagcctactttggtaaagtttttaagaagcaaacgggcgttagtccattaaattatcgccattggcaaacataacctggttgaggttgagacggtcgctgctgtcccaacctctttttgtgctgctcatcacactgtttcaataagttatattttttggttttatatgtcctttttctaaaatgaaagcgctttattattaattagtagggtaataatgaaaccaaattattgggggataatttaacatgaataaggtgaagcagtatctgtcgtatgcggcaggggcgtttgggcacgatgccttctacgcgacattgagtacttattttatgattttcgtgacaggacaattgtttgatacgccggacaaggcatttaacaatcaaatgattggctgggtcacaacgatgattgtgggtattcggttagtggaaattattttcgatccaatcattggtggtatcgttgataatacaaggacccgttggggaaaatttaagccatggttagttattgctgggctaattagttcagtattgctggtcgttatttttacgaattttggcggtctagcaaccgctcatccaatgctttacttggttttgtttggcattgtatttgtgacgttggatgcattctattcgtttaaggatattgcgttctggtcaatgctaccagcgttatcacttgatagcagtacgcgtgaaaagtttggtacggtggcacgctttggttcaacgctaggacaacaaggtgtccaaattgtcgttgtgccattggtcatgtttttctcaatcacctttacaggcgcacacactgaaacgcggaccggttggttctggtttgcggttgtcattggtgtgattgcttatcttggggcgttgttgacggccgcaggtacgaaagaagaggataacatcgtccgccaaaacactgaaaaagtggggctgttggaggtctttaaggtcgtcggtaaaaatgatcaattgatgtggcaagccatttcatacattatgttcgcattggcttatgttgtgacaaactcattgttgttgtactactttaagtatgtcatgggtgctgatagtaagttctacttggttggtatttttaccgccattgaagggatgattgccgtcgcaattttcccaacgttaacgaagtttttggcacgtcggacgattttcttcagtggtgccgtggtcatgctagcgggttatgtcttgtttatggttgccggtaacaatttaccagttgttttgacagcagtgacgatgttctttatgccatatccaatcatgttcttggttgtgctgatgacgattacggattcagtggaatatggccaatggaagttggggacgcgtcacgaatcagtgacgttggcaattcgaccattgctagataagttggcaggtgcctttgctaatggtgtcgttggatttgctgctgtggttgctgggatgacgggtagcgctaagccgagcgatattaccgcgcaagggttgcaactatttaaggtatttatgttctacgggccaatgattttgattgttatttcagtcttgatttactggcgtaaggtgacgttgaccgaaacacgtcacgctgaaattgtggcagaattagaagagcgattgcaggagaagtaaaatggcatatgaattacaagaagaattagcacaatcatttaacaagcggtttggctatgatccagccaagctttatttttcacccggtcgggttaacttgattggtgagtatacagattttaatgggggccacgttttcccggctgctattagcgttgggacatacggggcaattgccccacgtgatgataatcaaattcggacgtattcggcaaactatcctgaagcggggattcaaacgattacggtgacggatttggcgttgcgcccctacgatacctggattaagtatctccgtggtgtcatgacagtgatggctgaagctggttacccagtgacaaaagggtttgatttggccattgttggcgatatgcccacggcgtcgggtctctcatcgtcagcttctttggagattttgttactgaacatgctcaaggatatgatgggttatcagattgataagttgacgattgttaaattaggtcaagctgttgaaaatgattatctaggtctcaaaactggtatcatggaccaatttgcggtggccttcggggaagacgaacaagggattttcttagacaccaacaccatggcgtatgagatggtgccagccgaatttggcgagtatcgattgctagtcatgaccacgaataaaaagcgcgaattaacggattctaagtataatgaacgacgggcggaatctgaagaagccctggcgttgttgcaagaaaatgttgatgtagaaacgctgggcgatttaacagtaccgcagtttgaagcagcggccgcggattttgaaaaagaccatgctctggtcatgaagcgagctcgccatgcggtatctgaaaaccaacgaacgattgcagcgaaaacggccttacaagcacatgatttggttcagtttggtgaattgctgacggcatcacatgcatctttgcgtgatgactttgaagtgagtggcattgaacttgatacactggttgagacggccttacgtcagccgggtgtcttgggtgcgcggatgacaggagctggctttggtggttcggccattgcgttagttgaaaaagaccaagtaccagcagttaccacggcggttggggatgtgtataccgctgaaattggctatcaacccgccttttttgtcgctgaaattgttgcgggcacacacgaaattgcgtaggagataaagatgttagatgcacatgatacccagttagtgctggattttgtcgcttggggtgttaaattaggtgcgtattcagatttggaaacggtgtatcgcactaatttagtgctagttgaaattcaggcaaatggggtgacttctggactggtggggaacaccgagcggtcattaagtgacttagcgacggctattttagtcttggccccccagtcggctaccgaccgctggcaggcggagattgatcgcgcacgattgcttaacattgtgacgccgacacctgatcaattacaacaaacgttcatggcgaagtatgcgcaaagtccagcaaccgcagtggcttattattatgacctaagtcgcgccgtggaaaatgtgaaagttgccgatatccaacgtaatattgcttatacagcgatgacggatttcggtgagctggaaatcacgattaatttatctaagccagaaaagacgacggctgaaataaaagcagctgcatcggcgcctaagagtgagtatccaccaaccgctttagattatacaaacgaaggatttgtgggttcgattaaacaggcgccacgcagcacccaccggtttattcgtgaaacagtgaacgggcaaacttggggttggcattattcgccgtatgcgtattttgaagagcatgcgatctttgtcgattttgcgcgtgaagcgatgaccattgaccggcaaacgtttgctaatttattgacgttggtggcacgttatccgatgtattttgttgggtcaaatgctgatttaccaattgtgggcggttcgattttgtcacaagaacattttcagggtggccggcacgtcttgcctttgatgaaggccccagttgaacgtgaagtgacattgcctgccttcccggcagtgcatgcggaaatcctcaagtggccgatggcaaccattcgcattacggccaaaacagccgccgatattgtgacggctagtgaatttattcgccaagtctgggcaacgtattcagatgagcggttagatattcatgccatcagtccaacgggtgaggcgcaacatacgattaccccgattgcacgacaagtaggtgatcaatttgaaatgtacttggtattacgtgacaatggcacttcagccacgtacccggatggtatttttcacccacatccagatgtacaacacattaagcaagagaatattggcttgattgaagtgatggggctggcaattttacctgcgcggttacagacagagctacaggaaattgcgaactacttggtcggcgaccaaccgttaagtgcagttgcaccgagccaccgcgattgggcggctgccttgcgtgagaacgcaacagttacacgtgaaaatgtgatgaccgtcatacgccaagctgtggctgacgtatttattcgagtgctggctgatgcgggtgtgtataaatacgatacggctggccgtgaaggcttaatgcgcttcattgcgcacttaacggctgccggtaagcagtgatgataatttaagatgttgcacgaaacacatgcagctaaccgaatgttattggttagctgcatgtgtttttgcgtatgaacccgaaaaaaggaaatttaaagttgtatttcaagagggaaatccgatagtttttcttgtaaattaaaattagattaaaacaaactattgaaaaactcataatatcgtcatattataaaacaaatcattttataaaaagtaagggtggcaaaatatgagcgatgcggaactattagttgcaaaaaatgtcagtgtcagttttaagattcacggccaatatgtccaagcaatcgaagatgttagtttgtcggtgcgaccgaatgaggttgtggccttggtgggtgaatcaggttccggtaagtcaacctttgccacgtcaattatcgggctacatgatttaacactgacccaggtaaccggacaaattttagttaatcaacgcgatgtactgaatctagcaccggctgagtggacacaagtgcgcggcgctgaaatcggcatgatttttcaggacccactagcagcgttaaatccgttgatgaaaattggcgaccaaatcaaagaagcgttggcggtacacgatgtttaccaagagccacaatacaatgaccgcgtgattgaattgctcaatcaagttgggattcccttcccagaacgtgtggcgaatgagtttccacatcagctgtctggggggatgcggcaacgtgtcgtgattgcgttggcaattgcgaataagcccaagttaatcattgcggacgagccaactaccgcattggatgcgacgattcaggcgcaaattttggacctactccaggatattcaggctgaaaatggggccggcattattctcattacgcacgatttgagtgtggtggctgaggtagctgaccgtgtggcggtcatgtatgccggccaaattgtggaagaggctgaggtcggggaactcttcgctaatccgaagcacccgtacacgcgctcactactacggtcaaatccaagtttggacaatgaatcggatgaactttacgtcattcaagggactgtgcctggtttgacacacattgaccaccatcgcgatatgtttttggatcggacgccatggctgcccgaagacgtgcgccaagaacaagatccaaaattggcggagattgcaccaggtcactgggtgcgtggtaatgcatggcgggtatttaagtttgctgacgaagattgaggttagataatgagtgagttattaagagtagaaaacgttaaagtacactatccgattcgaagtgggtttttcaatcgggtgactgattatgtatacgcggcagacggggtaagtttctcaattgaagcaggtaaaacgtatgggttaattggggaatcaggatccggtaagtcaacaatcgggaaggccattgtgggattggagccgattacgtcaggacatatttattttcagggcgttgatatgacggacgccaagaaccgcgcccatgttaattacaacaaggacgtgcaaatgattttccaggactcgatgtcgtcgttgaatccacgtaagacagtgtttgagattattgcggaaccattgcgtaatttttcagggttaaaagaagacgggttagcccaggaagtgcggcatttgcttgatattgtcggactgccggctgaaacgatgtaccaatttccatttcagttttcaggtggtcaacgccaacgtatcgggattgcccgtgcagtggcgacgaaaccaaagttgattgtggcggatgagccagtttcagcattggacttgtcagtgcaagcacaagtgttgaactacatgaagcgcattcaaaaagactacggcattgcctttttgttcatttcgcacgatttgggtgttgtgcgtcacatgacggaaaatttggccattatgcacgccggccggttggttgaaattggttcacgtgacgatatttttaaccatgcccaacacttgtataccaagcgtttgttagcagcaattccagaaattgatgtgccgaaccgggcgaagaatcgtgcccaccgtaaggctattgaacaagagtttcaggatcaaaaatcagcatattatgatgccgatggccgggcgtttccgttagtcgcagttagtgaaacccaccaagtggcactgcctgaatcaatgctagaaggagaggggttctaatatgtggaaaacgattttgcgtcgattgctgattatgattccgcaattgtttattgtgtctgtgctggtctttttcttggccaagttaatgcctggtgatccattctcaggaaaatttgggccaaacactgacccagctcaaatcgcggccttgcgtaaggccgctgggttggatgatccgtggacggtgcagtatgcccgttggattggcaacgcggtgcatggtaattttggtgattctttccagttgaagcaaccagttgcgcgtgtgattggtgcccgtttggggaatacggtttggctgtcattgctggccttgattggtacgtatgtgacggcaattacgatggcactagtggcagcccgtcgtgagaattcacggacggaccatgcgttggtggtctacaactcattgatttattcattgccagcctatctgttttacttgtttggtattttcgtattcggttacacgctgggctggttcccaacgtccgggacggtgtcggctgacgccaatggcttcttcccggtcttgggtagtcgcctgtatcacatgattctaccggctttgattgtggcgctgatttcaacaaccagtaccttttcgtacttgcgttccggtattttggatgagtccaagcaggactatgtgaagttagcccgggcaaaaggggtgcccgagaatcgaattttctcacggcacgtgttgcgtaacgccttcttgccgattgcgtcaacgatggggtatgccattacggggattttcgggggcatgattattgcggaaacgattttctcattccctggtattgggtcattgtttgtgcaatcggttttgacgcgtgattatccggtggtgaccacgttggtcctattcaacggtgttttagcggtgttgggtggtttgttctcagatattatcatgagtgcagtcgatcctcgtattcgaatttcttaaggaggcgcaacaaatggaacaagcaaagaaaacagcgccgacattacgaaatgccttgcgacgcgaatttcaacaagatcaagtggctcagtttgccataattctattattgttaatgacagtggctatttttgtgggagcgttgtttgtccctaaaacggcttacacggacgtcaatattatgaatcaatacctaccgccaatgacagacgggcacatcttcggtaccgataatggtggtaaagatatcttttcattgttggtggtcgccgcgcgtaattctttgacgattgcgtttttcgtaacggtgcttattctggcactcggtacgattggtggcttagtcacgggttattttggtggcgtgtttgatctcgtgttcatgcgttttatcgactttatgacaattttgccagtgatgatgattattatcgtgcttgtcacagttattccccactacaatatgtggtcgctgattatcattatgacgttgctggggtggtttaacaccgttcgcttgattcgggcgcgaacgttggttgaagtgaaccgggattacgtccgagcttctaagacgtcaggaacgtctaatttgaagattattttccgcgagatttttccgaacttatcatcgttgattatcgttgaagccacgttgatgtttgctggaaatatcggtcttgagacgagtttgtcattcttgggcttcggtctgccggcgaacacgccatcattgggaacgttgattaactatgcaaccgaccctgaaacgatgacaggtaagccgtgggtttggattcctgccgcagtggtgatcttgttgtataccgtattgattatgatgattgggcaagcgctacgacgggtagctgatcaacgccaatcactagggtaaccgactaataacgtctaaattagaatttaattagaataatgtgttgacaattaaaataaccgcgagtaaagtcaatgtcaacgaaatataagggtatatatgggggtgttcgtatgagtaaggcagttaaatggttgctcggactagtcgttgtggtgttggcggcggtcgcagcgttcttcgcgttcggtcacgggaatgataaacaagctgttaatcatgacaaagtgggtaagttaccggttgcgtataacaatccggggaaggccattaagggtggcgatttgaagattgcggctgtgtcagatacaccgttccaaggatcgtatttggcaccgttgtcagatgatgcattgacgagtgatatgttcaatccgacaggtcaaggatcatcaggaattttcgcaactgataagcaatttaagattaatgataagggtgctgctacggttaagtttgacgatgacgctaagacggcaactatcacgttgaataagaagttgacctggtcagatggtaagccagtgacagccaaggactatgagttcacttatgaagtgttggcaaacaaggcgtatggttcagatcgttggacagagtcattggctaatatcgaaggtttgtcggatttccacgatggtaagactaagacgatttcaggtattacctatccggatggtgaagacggcaagaaggtagtggttcacttcaaggcgatgaagccaggaatgccatattcaggaaatggctactatcttgagacggttacgccatatcaccagattaaggatatcgcacctaagaaattggcatcatcggaagctaatacaacgaagccactggtttggggtccatatcaagttgcaaaggtggtgccaggtgagtcaattaggttgacgccgaacaagtactactatggtgaaaagcctaagttgaattcaattactgaacaggtggtttcaccaactaagattgcggcagccttcaatgcacacaagtacgacttgtcaattgagaatattgcgtcattgtacccacaaattaagaaggcctctggctataagatgacggggcaaaaccaattgtacgtctcaatggaagtcttcaacttgggacactatgatgccgataagagtgaaaacgtgcaagaccgtgatacacctttgcaagacaagcgtgtccgtcaagcgttgggatatgccttgaatacgcaacaagttattgataagtattcaaatgggcttggaacacgggcaacgtcattaattccaccagtcttctcgtcagtccaagacaaagatgctaagggcttcccattgaaccagaagaaggccaacgctttgttggacgaagctggttggaagctgaacaagaagacgggttaccgtgagaaggatggcaaggaacttgatttggtctacatggctcgttcaggtgcaccaacgtcagaagcggtttcacaaaacaacatccaacaatggaagaaggttggggttaaggtcagcctttacggtggtcgtttgaccgactttaacagctggagcaagattgtccaagacggtacgagtcaaaagtgggatatcacggatgcggcttggggcttgtcatcagaaccttcacaaatggatttgttctcaaaggctgctccttacaacttgggtcacgcgacgtcacctgagttgacgaagttgttgaatgacattgactcacaagcagctttgaagacgtcataccgtaaggaagccttcaagaagtatcaagagtacatgaatgatcaagcatatgtagtgccacaaaagtttgctatcgattacacaccagttaatgatcgtgtggttggttggacaaaggcaaatgatgcatacgatctttgggagaagattggtgtgacctcaaatgacttggcaactaagtaattagaaatatgaaaaggctcgtgacggtctgcgtcatgagcctttttcttcagaaaaatactacaaggaggggacgatgagattattttttcggttgaaatggtttattcgcttagagtggcgatcgtatttgttgggcattctagcattgctgggggtggcaatgcttggtttgataccaccgattatgattgggcggtttgcgaatttaattagtgagcgggcactatctggcgctacgctctgcccaattattgtctggattgcgattgcgacagttggtcaatatctcttacggtttggttggtcatattttatttgggggacatcggctcgtttggagcgcttgatgcggttgcgtttattgaaccactatttggagatggataagcccttctttcagaagcaccgaacgggggacctactggcccacgcaaccaatgatatcaatcaactgcaacgtgttgccggtaatggggtgctgcaattattcgatgcgttgattaccggtgtatcagtcgttgcagcgatggcggtggtggtgaatccactcctgaccattatggcagtggtaccactgcttgggattacgttggtggcgcaactattgggtggctcgatctctgccgccttttcagcagtgcaggatatgttttcgcagttgaataataagacgcaagagtcgttgatgggcattaaagtattaaagaccgttggtgaagctgccgaagatactgacgactttcaaacaaaaattaatgattcaattcgggcgacccgccatgccgagcggttagattccttgtttaatcccgccattacgattttaacgggcatttcgtttgttgggacaatcatttatggtggataccttgtgcagactggtgcgctgtcgattggtagtttgattacttttgtcacctatttgtcggcgctagtttggccctttttagggttgggctttttctttaataacttgcaacgcggtaatgcagcctacgaacggattacgacgttattggctgaacagccagcaacactggataaaaaagggctaaagcaagtgccacgcggtgacttacagattgatctaacgacgtttcaatacccagatgccactgaagcggcattgcagcatgtgcacgtgactgttcaggctgggcatactttgggacttgtcggtccagttggctcaggaaaaagtacgttgattcagttgttgctacgtgagtttgatcagtatgtcggtaacatcaaaatcaatcaaattgatattcgggaatatgacaaagatacctatctaccagcgattggttatgtgccacaagataattttttgttttcaacctcagtgttagaaaatatccggtttgcagatccaaacatttcattggagcgagtgcaagaagctgctcgctgggcggccttgcatgatgacattatgaatttgccagacggttatgatacacaagtcggcgaacaaggaatttcattgtcgggtggtcagcgccaacggctagcgattgcccgagcgttgattatcaacccggatattttgattttggatgatgcgttatcagcagttgatgcgaaaacggagcaacaaattttaacgatgctccataatcaacgccgaggcaagacgacgattatcgccacgcaccggctgagtgcagtcgttcaggcggccgaaacgttggtgtttgaacatggtcgtgtagaagcgcggggcacgcatagtgacttaatccagcaaggtggttggtatgcccggatgtttgcggcgcaacagttatcggaaaaacttgatcaggaggtgacgacccatggctaaacaaaatacgtccgcatggtctggcaagatgaccgcggcggcacaatttcaaacggttcgggcgctatttcgctttatgaaaccgtatgccaaatatttttacggtgctttgatattggccgctgccatttcagttgtaaatgtgttactaccacgcttgctgcagacattcatgaaccagcatctgcatcgcatgtcacccacgtggcgattactaattgttttcgcgttattgtattttacaatcactttggttaaagcagtggcacaattcttcagtgattattggtttatgtcggcagctgaatttatggtggaagatgtgcggatgaagctgtatcgaaaactacatacgttggggatgcgctactttgatcagacaccagcgggatcgttagtgtcgcgggtaacgaatgacaccagttcgtttacagacttttgggagttgtttttgacgttaacgacaggtgtgtttgcgatcgtgtccgcgtttatcgccatgtggttgacggatgtacatgtgatgctagtgacgctgttatttgtgccgttgctgcttggtagtatttggttataccaagttgtggcgacgaaagtgtatcggcatatgcgggaaaagctgtcgcaattgaacgcccaattggcggaagcgattacggggatgtcagtgattcagcaattccgccaagaaagtcggttagcgggtgagtttgcgcagacaaataatgcctattaccaggcccgtgtgcggatggtgaaaacaaattcattattgctgtcgccgatggtggatttattgtatggtggtgccattattgcggtaatgctgacgttcagttggacgagtcagtcagcaaccattgcggctggtacggtgtatgcgtttttgtcatacgtggcggcgttttataacccaattgactcggcgatggattcgttgtcatcatttcaagatggggtggttgcaggtagtcgtgtgttgacgattttagctgacgacacgttggaaccagcccagcaagcaccggcgaatggtcggattacggcgggaaaagttgagtttcgggatgttagtttttcatatgacggtgagcatgacgtcttaaagcatattagttttgtggccgaacctgggcaaacggtagcgctagttggtcatacgggttctggtaaatcatcaacaattaatgccatgatgcggttctatgaatttcagtcgggggatattttgattgatgatcagagtattcgccaattggatatggctgattttaggcgtcaagttggcctcgttttgcaagagccatttctattttatggtgatattgccttcaatattcggctgtacaattcacaaattacggatgaccaaatcgaggcggcagcacaatttgtgcatgcggatgaatttattcagagtttgccacaaggctaccatgaaccggttgttgaacgaggtgcagcgttttcaactggtcaacggcagctactgtcatttgcacggacaattgtgcgtgatccgaaaattttagtacttgatgaagccacggctaacgttgataccgaaaccgagacgattattcagcaatccttggcgaagatgcggcaagcacggacgacgattgcaattgcccaccgactatcaactgtcaaagatgccgatttaattttggtgcttgatcagggggagattgtcgaacgcgggtcgcatgagagtttactggcccagaatggtcgttatgccgatttgtatcgtatgcagatgggtgaggcgtcggattaattagggggtaggcgttatgtttcaagcattatttttaaagaaccaacaatttcgcacgattgcggttagccgagcatttcaagcgttcggtgcaaccttgttcaactatgcgtttttggtatatgcggcggaattaccgcatgctaaattagcggtttcggtcattagtgtggtgctggcattgcctagtatgttgcaatttttctttggggcagttgctggtcgggtggcaaaacgtatccagtggattttaaccacccgtctcattgaaatcgcaggctatgtggtcattgcggtagtctttgctacgactacgccaggctggttgccactattaatcattttgccgtttttggtgttgagtgatgtgattagcaacgtggccgggttggttttgcagccgttaatcaagcatcttgtggtggatgaacacttggaagcggcgaacgggtatatgatggcgattaacaatacgctagcgatggtcggtggcgtgattggggttagtttgctggcgctcgtgcatcataatttcaccatttttgcgttattgaacggtggtttctttctattgtcatgggtgaatctgtttattgggcgccgacaattgttggtcacggaccgacagttttccgatctcgttaaaccggccgatacacacctgcgtgcgatgatggtagctggctttgcggtggtgaagcaagatgcgatgatggtttacatcattagtatggcgggcctggttaatttattgggaaatgccgcgcaagggttgctacaactgtcggtactggccaataagcaaatgtggcacggtggttacgggacaaccttggcgctgatcgatgctggcatcggtgtcggtatcgttgctggttcgtccttgtttaatggctatttgcataaaatcaaattaccaagtttggtgaacgtggtagtaatgatgatggtgattaatgcactagcggtattgttcctaccccggttcggtctattaattgtgattaattttctgcttggtttcgcaatgggcaaattaaatcccaagtatggcgccctggtcacacgtattgtaccggaagaacacttaacaaccgtcgctggattgttggggacgtttgaaatgattggtgtgccattgggtcaagtggttttcttaggaattgcgaatatcttctcaactacgatcgcatggtacggtattttggggctgggggttatcctgatcggctattccgttaagacgatgcgacgaacagccaccaccaattaataattatttgttttctaattatactaatttaatattaataaaactgttgaccgagttgtttttacggcgtattatcaaccctgaagaggtttgactagcctctgctaatagcgtgaaaaccgcggttagtaaaaagcgccctgaccttcccgtttccaggcgcttttttcgtctgttgacgagtgcgtgataaaacgatagggtgttagggagagggaaagtgttttaagggagcaatactatggaattttataagccagtcaatcatactgatgatgaaattaaggacttgcttgcccaaccaggcaagcaagtgatgttcttacaagccgattggtgtggtgattgtaaggcaattaagccatttgtcaaagatattaaagaagccgttgaaaatgcgggcgctagctggttcgatgccgatcgtgatgccaatttggcaatcgcccaagaacaaggcttaatggggattccggcttttgtcttgtttgaaggtggcgaacaagtagcgcatattggtaacggtgagcgattgaacccaaatgatgttttggcgtgggtaactaaaaatatcgcttaaaattagatgaacattttctcatattagtgttgacattctaatttggggcgtgtaatatacagttcatcaagttaagacataaattcgttgatgagaagagtagtgttacgaactgattcagaaagcggctggttgatgagaagtcgttctgttcaagacatgaagatgagctcggagaaatggtgatggtgcaagctgttaccacggcaggaaccgttatcttccctggtttatccgcttgagtgcggcgaactgtagaggtgtatttggtgacaaatacataaattagggtggtaacacgatgaagtcgtccctagtcagacattttagtctggctagggacgactttttctttttatccgcgaatttatgagttgttaagaagatagattatttgattaaagtgaggatatatattatggctattgagattacacgtgcagaagcagataccttggtaaagacacctttgatttcacaattgttgattgaatggattaagggtgaagaatcagaaaagttcccattggccaacttggcgaatgcggcggctattttgcaagaaaacttgaagcaagttaactgggccggtttttacttgtacgatgagaagattgatgaattaatcttgggacctttcgttggaaaggctgcggttgttcgcattaaacctggttcaggtgtggttggcgatgcgtttagcaagcaagagactattcgtgtcgccgatgtgcacgtctttgacggtcacatcgcttgcgatcctgcttcaaatgctgaaattgttgtgccattgacgacagcttcaggtaagcgtttgggtgtcttggatatcgactcaacggcctttaaccgttttggtattaaggaacaagctgaaatcgagcactttactaagattttgttgcaatacatctaagccaaacttgctagacaagactggtatgatagaactacaaaattaaaaaacgtaggagatagaaatggctgaaacattgcattatgacgttgccatcattggtgctggaccagcaggacttgctgccgcggaagatattgttgccgccggtaagacggttgtcttgattgaaaagtacctctggggtggcacttgcccaaactatggttgtgaccctaagaaaatccttttggccgcggttgaagcgaaagaacacgttgagtttctgagcggtgacggtgtcgatggtcaagtggcgattaactgggaatcattgatgggccgtaagatgcgctttacggaagcaattcctgaaaagacagtgcactcattggatgcaaatgggattgcgcacgtttatggggcagcccacttcatcaactcagatacagttgttgtgcatggggatgaagatattgaagttcaagcaaccgactggattttgacggttgggcaacgtccagctgagttggatattcctggggctgagctaacgattgattcagagatgttcttgagtttgcctgcgatgccagaagacgttgtgattatcggtggtggttatattgcggttgaatttgcgtcaattgcggctgctgctggagcacaagtgcacttggtggtgcgtggtagtgagttattgactggtttcgatgaagctttcgttgatacgttacttgatcaattagatgatcgtggcattcgggtgtacttcaacacagaagtgactgaagttgccaagactgatgacgggctgaacgccacattgagctttggtagtacgttgccaacaaaattggttttgcgcgcagtaggtcgtgtgggtaacaatgacacgttggccttggaaaatgctggggttgaagatgatattcacgggattaacgtggacgaattcttgcggacgtcaaacccacacatttacgcggcgggtgacgttgccaacacaagccgaccacggattacaacggtgggttactacgaagcacgttacgcagcttcagtgattttgggccatgatgagccaattacgtatccggctgtaccagttgttgtatacgggacgcctaagttggcggcggttggcgtaccaacgcaatacgctgaggcggatggctattcagttcgtgatatcgatatgaccaactggtttacgtattaccgaacaggtgagccagctgcccgggccaaggttgtcttggacgcaaataagaagttggttggtgccacggttttgagtgcgcacgccgatgagttgattaattactttactgaagcgattaacaacaaagatggttaccaagcgattcgtgatcgtttgtatgcctacccaacgccggcgtcagacttagaatacttcttctaaagcttacttttgaggctgagacagtgaatgctgtcccagtctcttttttgtttcaatttgtgacaaatttagagaacaaaaatagattaatcatgataatctgtaagtaacaggataatggatggggttcagattaatgagaaaagggatgctgtgtctgttggtgagtctggtgggggcaatgtctgtaccaatgacagcatcagcagatacgttatgggcaattggtgattccactgcggttggttgggatggccataaaattgtaacggcgccgtatccgttggtggcagcggataagttacatgtgacggcgcataatgaatattcggtttcgggcgcgatgatttcaggacattcgacgtatcaacgtgatttttcagcaacaacgcaactaattagcaaggacaaggcgtttaaaaaagccaatcttgtgttgatagggttaggtatcaatgattatttgcacagtgataatgcattaccggttgtgattgggacgttgcagaataatgtacgccaattaaaggccttagcgccacgggcgaagttttatgcgttgatgccacaaggaacatgggaagacggggatacgctcaacacgattcgtctaggtggctatagttatttgcaagagaaacaagcattgttgttggcatatcaacagttaggtgttaagccgattaatgcccgcgtggttaataattttaactaccataaagagcttggcgatcatacaacgcatccaactcaggccgcgtattataaaatcggcgaggccgttgccaagcaaattgcgggggacggttatacagctaagacatataccggctggcgggacaaacgctattacattgccgataagttagcgaatgggttgcaaaccacggtcgcgggttatcgttattttgatgatggtgttgcgctaaaaagtcggtggttaaagcggaacggcaaaacatattatttagctaaaaatggcgcgcctgctcagggaaatattctaattgatcacaaagtatatgcgatttcaacgaccagtaacgggtcaaaccagttaacaaatacctttgcttcacgtggcctagttaaggatgcttatgtcatggttaaggatgcgacggggcgcaaggttggctggcgttggattaaagatggtcgaccttatactggggaaaagacggttcattataaagtgtatacctataaaaatggtattcgccaagcagccacggctggcttgccaatcaagtaatgacgaacgatttttattctgttgaaaataatgtttgcattttctggtaagtttgctatagtaagtaacaattaaatatgacgtaatcactatcggtataattgctggagaatggccagcgagttcctacctgtttcccgagagacagactactgatagtgttttaaacgatattcgtgcacccattctgcatgctttttaagcgtgagagtgggtgcttttttcgttagttaacctgttgggggtagtggttgcgacacacatggaggggttatttattatggaagctgtcgcaggtgttaaagccgaaccggtcgtgaagactaataaactacaagcgctagtgttgggcttgcaacatgtgttagccatgtattctggtggcattctagtaccgttgttaatcggggcaacactgcactttacaccacaacaaatggcgtacttgatttcagcggatatctttatgacgggaattggcacattgctacagctaaagagtacgcgcctcactggtatcgcgatgccagttgtgttaggttcggcgattcagtcggtgtcccccttgattaatataggtggcacgttgggtatcggtgcgatgtatggtgcgaccatttcagcgggggtcttcgtatttttgattgcgggcctatttgcgcgattacgtgaattttttccgccagttgttacgggatctttgattacggtgattgggtttgcgttgattccagttggtattcaaaatttaggtggcggagatgtcgctgccaaatcattcggtagtccagcaaacctagcaattggtacgtttacgattgcaattattgtcctcgttagtttgttagcgaaaggctttaccaaggccatttcaattctattgggaattgtgctgggaaccgcttttgccgcaattttgggtaaagtatcgttagcacccgttgcggcagcgtcatggttccatttaccaacgccttttttcttgggtgtgccaacgttccattcttcagcgattattacgatgattatcattgcgttgacttcaatgattgagtcgaccggggtgtacttcgcgttagctgatttaacggggcgcaagctgacaaatcaagatatggcgaagggatatcgcgctgaagggttagccgtggtgttatctggtttgtttaacacctttccatattcaacgttttcacaaaatgttggtgtggtgcgcttatcaggcgttaagacgaaacaacctatttactacgctgcagttattttgattttaattggtttgttaccaaagtttggtgcactggcgacgattattccaacatctgtgttgggtggggccatgattgtcttgtttggtacgattggcatccagggaacgaccattttgcgcacggttgattttggcaaggaacgcaatttaatgattgcagccatttcaattggggctggcattggtgtcaccgtttatccacaaattttccaacaattaccagaattgattcgtttagtgattgagaacgccgttgttgtcacatccgtgttggcagtgttcttaaatattgttttaccaggtcgtgaaaaagaggaagtcacagcatcatgaagttattagaagaacgtattcaaacagacggtcgcgtattgggaaccgaagtgttgaaagttgataattttttaaatcatcaagtggatccagcgcttatgcaagctatgggaaatgaatttgcccggttatttgcaacagaaaaaatcgataaagtactgacagttgaatcatctggcattgcgccggctgtttttgcagcgttggccttaaacgtgccaatggtgtttgctcgtaagaagcagtcgttaacgctctcaggagatcactacgtagctgatgtttactcgtttaccaagcaagagacgaaccatattttagttgataagcgctttatccaaccgggcgaacgcttgttgttgattgatgacttcttggcgaacggtcaagcgatagcagggatgctccaaattgcgtctgacgcaggtgccacagtggttggggccggtattgttatcgaaaagactttccaaaagggccgcgcgctgctagatgaacaaggtgtgcgcgttgagtccttggcccgcatcgcagctttcgaaaatggtcaggtagtctttgcagatgaatcacctgttgccaattagcattcgaataataatttcattggttgttcatagtgttttaagataaataagagtagactgaaactatactatggaggtgaaaacatggcacaaattaatttgggtggttcaggacttatggttcctgacgtagcccttggtgtaatgcgtatcgcggacaagtctgcagctgaagcacaagctttggttgaaaaggcaatggaaaagggcgtgaacttctttgatacggctgacatttatgcagctggtcaaagttcagttgtccttggtcaagctttgaaggacgccggtattgcgcgtgaagacatcatcttgcaatcaaagggtggcatcatcttggaagatggtcaaatctctggtgatggttggaagggtcctcgttacgacttttcaaagtcacacttgatttcagctgttgatgaagagttgaagcgtctacaaacggactatttggatgtcttcttgttgcaccgcccagacacgttgatggatcctgaacaagttgcggcagcttttgatgagttgcaagcggctggtaaggttaagcacttcggaacgtcaaacatgaacccatggcaagtcgaattggttcaagcttctttgaaccaaaagttggttgcgaaccaattgcaattcggtattatgcacacgggtatggttgattcagaattgcacgtgaacatgtcagatgagcgttcatttgatcacgacggtggcattttggcctactcacgtttgaagaatatgacgattcaagcgtggtcaccattccaatatggtttctttgaaggaccatttatcgacaacgataagttcccagtcttgaaccaaaagttgcaagaattggctgataagtacagtgtaacgaagaacacgattgccgtggccttcattttgcaccacccagctaagatgcaagttgttttgggttcaatgaatgtgaaccgtttggacgaaatgatggacggcgacaaggtaacgttgacgaaccaagaatggtacgacatctactttgcagccggcaatgatttgccataaacagcgttaaaaaatgagcgtcactgcttttgcggtgacgctcatttgcgtttatgtgtcgtgctggcgcacgagcaacaggttcggctggcatcctgcgcctttgttcaaaaactaggcaaccgaatggcgcggacgccattcagcggggcaagtaattccccctaaatcctcaagtgctgtgtggacttttctgaatagcgccggccatgcggcatgttgccgatttttgaacgctccggataccagccgaacctgttgcagctaccgagagattctctgttatttgggatcttcagagtgttgccaatagcagattataacgcaaaaaagcaccgcgtgatgcggtgcttttgttgttagaacattaacataatggcaccggcaattccgacgagcagaccgtaaaccagggctggaatagcagttttacgtaagattgcaccttcttgaccggccaggccgaccacggcactggctgcaacaatattgtgcacacaaatcatattgccagctgccgcgccaatgacttgcaaggctaaaatgattggcttggcaagatgtgcgttggctgcgacgtcagcttgaattggcgagaaagtcaaggttgaaacggttgcgcttcctgtgatgaaagcaccgagttcccctaagaaaggtgccacgaatacccacacaccagccatatgttgtgacacggttttggcgatataagttggcattgacggtaagttcatgccgttggtgccggaattcgagaatacttgcaccatgatcaaagtcaccatcaacgtcacaccagtgccaaccattgaggctagcactgacttggccgctggtacaaagggcttcaacgtccgggcttgcaccaagagggcgatagccgcagctaatgtcaaaatgaagccaggcgagtaaaggaccggccagtcggagctaatccctttaatccctaggatgttaacccagccaaaatcgatggcgttggtcatgaaatgctttagccaaccaatggtacgtgatagtaagagcagtacaacaacaatcaagtaaggcgaccaagctgtcagcaacgacatatgacttgatgcgtgttgcatcgtttcttcatcattttgcacaccatcgccggtaaaattcgcccccttccaaggattggtgaagacggttgttggcaataagatgcgatatttgagtgttaacacagcaatgatcaaaacagttaatggcgtgagaatcgacacgaactcataaccaattgtgtgggcgtaaagccaggcgaaaacgttataaaccaagccaattaataatgcccatggcgtaatttctagccacgatttgatcgactttttgcctcgattgaagaacgtaacgagcagcataaccaacatcaaaggcatgaatgttccaccaaacaaatcgatggtagtcatcgtaccggcaatattgttcatgaagtcagcaacatttgctggggcgacgttactcaacccgacggttagtggcgtcccaacagcaccgtatgcagctgatgttgaatcagcgactaaggctaaggtaacgcccgcaattggtgtgaaccctaaagcgattagtaagggtgctgtgaccattgcaggtgtcccaaaaccagatacaccttcaatcaaaccaccaaataaataggcaattaagactgctaaaatacgcatatcagcggttaacgattcgaacccggcgttaattcgtgtgatagcgccggtatggcgtaaaacgtgtagcatcatcaaggccccaaacaaaatccaaagaattgggaatgttttatgaatgccttgtaggatagaggcaaacatcacattgtttggcatttgccagatgaaccagccagctaaggtgacgacgagcgcgctgatagccatcccttttagtgctggcatgttgaacacagccaacagaataagtggcagaataactgccagaagtgcaataaatagcatagaacccccaaagttcgcaattgaaatagatgtctcttgtagtctacatgaagaacttcacaaataaagggtttctatattttttatttgttacacgagttttagataagacgtatcggttgatttcgtgatattatctgggataagtggcagtatcaggtgagatgatggtgtgagagatgaaatggatgcatgataagcaggatcggaataaattaaagttatttcgatacatgcgaacacgtggggaagccccggtactccaggtaatggaagacctggatatgtcacgctatattgtgttatcaacaacacaacaattagcgattgatattgagatgattacaggtatgacggacggcattttgattgaaggtggatcagatgttcgttttagtgtgccagcaacggtattagattgggaatcgttaggactacactatcttatgacgtcgattcgcggccgaatggtgcacgaattatttcatgagcaagtgacgtcgtgggaagaatttgcctttgacgttgatgtgtcggtccccaagatgtacaaggaacgtgcgcaagtcgctgaagatttagcgcgcgaaggaatccggatttcacgagattacaaattagtcggaaatgaagaacacattcggttattcaaattcgagatgttaacttattacaatggtcggcgagattcaccatttccgatcgatgtgcaggaacaagcgcgcgaagtggtgaatgaaatcattgtgccggagtgtggtacgttgcgtgaaacacaattggtagggttgcgccatctgtatgcaatttggtggtcgcgttttagacagcgtcattttgtgtcgacagggtttacgaatcgctttttaaagccaactgctgagttgtctgatcgtagtcgacgcctcatccatttgttgatggaacggatgagtgacacacctgacttgccggttgaaacggccgcgagtgaggcgcggtttatcattctaaccatgcatacgttgggacttttcccgccggagcaaatgatgaccgatgtgacagattcagtcatccagtactggcatcattttgaacgggcgttgaaagaaagttactactgtctcttcatgcttcgagccgaccaagttgatattcggtccgtcacgcgcgtgcttgaacctgaaattttacggttctttgtcttcccatatgtgggggaagaagattatgagtacatgacgaatgttgctgacattgcaccggaatatccgttggcctatgagttctctaaggatgtcatgcaccactttagtgagtttacgggggtgccggcacgtgatttggataactttatgttgccagatttgattgcaacagtgatgggttatcctaatttttatcgggcaatcccagcagttaacatcacgattgactttggcggtcatcacggcatcgaagaagtgatggcaatgtcgctgaacggtttgccaggctataaaattcaaattaaccatgttctatcagaatatacggatattttggtaacggacgctccccagcctaaggatgaaccctatacggcactcatttggcgggggattggtacgcccgggcaaatgacagagctcttacaggaaattaatcgcgttaagatgaagaagttcaatgcttggcgagataataataaacataaataatagtagcgaaacaacacaacatcgtgttagtttcgctttttattttagcgaaacaagtgtgtgaaaccgtttacaaaatataagcgacgcgttacaatgtatttgttaaataaatcacatgcaaagaaaagaaggcatttatcatggctgaaaaagtagcaattgtaactggtggtggacaaggtattggtgaaggtatcgcattgcggctagcccaagatggttatgcagtcattgttaatggacgcacccaaactaaactggacaacgtggttaataagattgttgcagctgggggcgaagcgacaacctttgcgggggatgtacaacaaaagtcagttaatgaagaaatggtgcaattagcattaacgaagtatggtcgtttagacgtcttcgtagccaatgctggtattgattgggttgatacaatcgaagagacgccagaagaacaagttgataatgtcttcaatattaatttgaagtcacaagtttgggccttacaaacggcaccggctgctatgcgtaagaatggtaagcaaggcggttcgattgtattggcctcatcaattgcggggatggaaggctttgagatgttagggatttactcggcaaccaagtttgctacccggggtctggtgcaagcagcggcaaaagagttggcgaccgacaatatccgtgtaaatgcctataatccaggaatcgtcttaacaccaatgtgggatcaaattgatgcccgttttgctgaacgcaagaatgttgccattggcgaaacacgccaagcgtttattgatggtattttacttggtcgtggtgaagaacctgatgatattgccaagtacgtgtcattcttggtgtctgaccaagctgattacatcactggccaatcattagccgttgatggtggtgtgaagttccaataaaatagtttatgaaaccggttttgtgcgctgtgcaaagccggtttttcagttgcaggatgatagtgggtgtacaatagagatactgaaaataacgaggtgaatggaacatgaagattggattcatcggtactggtgtcatggggcgcggtatcattaataacttattgcaagcaaattatgaagtggttgttttcaatcgcacgaaagcacatgcccaatcagtcttggataatggtgcaacttgggcagattcaccaaaggaaatcgctgaagcagcagatttggtgattacgatggttggttatcccaaagatgtggaagaacaatattatggtgataatgggttgttcgctggctcacacgctggtcaaatctttgttgatatgacgacatcaacgccaaccttggctgaacaattggctgttgatggtgagaagtttgatgttaaggtactggatgcaccagtttctggtggtgatgttggtgctaagaatggtacgttgaccatcatggctggcggtgatgaagcagcgtacgacagtttgcaaccaatctttgatgtgatttcaaaggcagctaaccgctttggtgtggctggtcgaggtcaacacactaagatggccaatcaaattatgattgccgcgacaatgttgggcatgtcagaaatgatggtttatgcgaaggcagcggatctagatgtggctaaggtaatggcgactttgtcagccggtggcgctcaaaactggtcattggataactatggtcctcgcgttttggcaggtgattttgaacctggcttctatgcaaagcacctattgaaggatttgcgcattgcgttggacgaagcagccaagatgaatctatctttgccagcaactgatctggctgaggccttatataccaagcttgttgagcaaaagaaccttggtgatgaagggacacaagcgctggttaagttgtgggcacaatttgcataatgtcctaaatttgagtgaaataagacaggtttcgcactttttgtaagtgcgaaacctgttttttagtgtctatggttcaatttgaggagatattaaaaaatcagcaaattattcgttaagataaaaacatcaagaaatgacatggaggcaaataggcatgacgattggacgcatatattcagatttaaaggcaatgtttgagcttttagcttggattacgttcatttttgtattgtttgttttgtcttcacgttatttgtacgggatggattacagcatcttcttacctttggttgtgatgttgtacgctggcgtatgggttggcttgtcagtcgctttggttttgacatggattttcagcgccggaactgcaaagcacgcgactcaaacgacaaagtagtcgtgacgaactggctggattttgatgaaaaatctggccagttttgctttgttttagaaactatagggcgcatttccttttcaacactgctataatcacttgtataaagtacgagaatacggagagtggaaagatgattggacggaagttgtggtcaagtttggccatagtgacggctgcattgggggcgtttggcgtggcaaagccagcggcggcagcagactatagtaatagcaatcctgaaatgggtgtcatgttatcaagtattgaagatgacacggatacgaataattcaacgtgggaactgaatacgaagccaggtaaggtgttgcacggggcggtttctgtgcaaaatacatcaaatgagagtgccaaatacacggtttcctttgaacaagcacgtacaaatagccaaatgaatattatgtattcaaatggtggtacaaataaatcgttggatccgaacatgaagttgtcaaagattgccaaggttgatggtaaagacagtgcaacgattacggtacctgccaactctacaacggctttgccagttacgttaacgatgcccgcaaaggaatttgatgggtatatattgggttctgtggtggttacaaagcaagttccaaagggatacaaggtgaaggatggttttactaaccaatttatgtataccaagacggtgcaaattacagaatcgattgttaacccaaccgcagttttaacgaatactaaaaaaggtggcgttaaagttgttgcaggacaacaagagttccaacttagaatcaagaacaacgaacctagctacatcggtaatatgaagatgtcagctaagattacgtataaaaagactggggatgttgtgttaactgacaagcaaacgggtcggtcagttgcccctaattcatcatttacgtatcgtttgccttcagaacgtgttatgcgtgctggaaaatatcattatgtggtgacgatgacgaatgagaaaacgaagaagagctggacatttagcaatgactttgttgtctcacaagcatctgcgacaagtgttggtattggacgatcaattgcctttattccaacttggatttggcaattgctagctttgttccttgtcttaatcggattcctattcttccttttgtggaagcgtcgcaaggatgaagatgacgaagatgaagcaaacgcaaaataatttcaaaaattgaaaaaaatatcgagacggaatccttgcaaaagggttccgtctttgctttgagctaaaaaaggccacttttgacgtgttttttactaacttttaaaaaattagcgaaaacaggctcaattcaagtactttttgtaagagttgtataaatcggaattatactaagtaatgtaataaaggaactacttaaaaaagcctaagaagcacagagagggaaagaattatgatgaagcaatttttgatgagtgttgctgtattgggagctgcgactgcattgattgcaccagctgtctcagcggacacaaccgcagctgaccaagtgaatgttgccaacaaccaaggtaagacaacagttacttacgtcggagacaagacgacggatcaaacggtcgttgatccaaatcctagcgacaagggttcaacacctgaagatggtaagaacacgactgataagaatggtaagcaagttaagggattgtcattgacagctgtaccaagcttcgactttggtcaagctaacaagttagctgcaacaactgttgcaacggctaagggagcaaccgatttgactaacgcaactgccggaatgaaggaagctgccgctgcagctgaaaactcaggtaagtcatcaatcttcgttaacgacacacgtggtggtagcactggatttaaggtgtacgctgctggttcatcattgtatgatgcagctggtaaccaattgaacgttagcgctttgcacttgacggttaacgacggtgttgcaaacggtaaccaaggtgtaattactggttcaaagggtattgatgtttaccacgcaactaacctaacgactaacacgtcagcagctggtacggatacagcccaagacactaaggatgttttgtcaggtggaacgcaagccaacgatatgtttggtaaggttgctggatacggtaacttgattgctactggtaatgctaagtcaactggtgacacggcaactggtgcagtatctgcagacttgacgttgaagacggccaacgccttggacggtcaagcatacaacggtacaatcacttacacgttgcaagatgctacgttgtcagctaactaattaacatacgctaagtaattagaccaatcgtgacaagtcatgtttggtcttttattggataaaacacggtatacttatttttggtaagttataccgtgatacatataagagagaattgaaactatttggggatagtgagaaagagaggcaacatcatgaaaaacacacggcgtttacaaacaaaagtacaacatatggcgttggcttcaattataatcgcagggattgttgcgccgattgtccaactcgcaccatcattgccaggcatgagcttgcaagatgtaaaagcagcaactggagtggttgataaggtagataagggtactgccagtgaaaattacgcgcgtgatttgttaggcggtagttattcgggtaccactcctgcaatgttggctggtcagacaggcgttgtcgatgaatcttggaaaattacaccacgagatacatcggctacatatgcaaagcgtacaaatgcgaagggtgattttcacattcaatatgctacaaagttggctaatgggcaaaataaaatttttgatggtagccaggttagcacatatgactcaacgccaactgtcgtaaagttgacaacgccggtagtaaatgaaagcacggacgtaaatcgaacagcgacttatatggctgtcagtcctgcatctgacacaagtaccaagactgctagtggatcaacggatgagctggctgtagcagccggaaatgtcggaaccgcgacaactagtgatgcaccaactaaggttagcgggtcgttgaacaagttgtataggtttacaggcaagcagtatctaagttttcatacaccagatgattctacaggactaaaacttaccaatattagttcgtatctagattcaagtactttttcagtgaaagttacttatgctgatggaacgatatctgatgttgattctggtggtgtaaatggttactcaacattctacccaactagtaatgcacaaagtatcttctacagtgttgatccgaagacaggtgtattgatggtgaagcacggtacaattacggtaagccgaaataagacgacgtacaattattcatcgccattagccgttgcgacggatggtgattggcaaaatgcagctggcagtccagcgacgaatatttacgtctactcgaaggtaaaagtaccagcgttgggacaacagctagtgttgtcaggaaatgttaagatgcctacgaatggcgatatgcgccagtattcaggtgatgtgcgcatgtttggtgcgggatctacgacaaatacttcggttaactacaatacggctggtaatgtgcccgaaacttctagttattcatggtatggttcgtatgaagaaggtggcttcaacatcttgaagcacactgatacaggaactattacacacgatgtgtcgtacgcggacggcacgggtaagccaattaccagtggaagtagcgacagttacaaccaagtaattgcgtcagataaaatcacgaatacgcagagtcaagattcaactggtacgtacacgattacgactggaagcaataatgtaacgtttgcgaagcagccagcatttgttaatgcgaatggtgatgatgtttctacggcagttggactaaaggacatgacgtactacgatgcaacgggtgctaagacaactgattatgctaaagctgttaaggccactatgacggtgacaattccagcgacatctagctacacgattaagtcagtcttccaagcatcaaaaaccgagtcaattacttcaacgaccagcatgacgggtacggataccaacatggctaagattgacttaacaaagtcgtttacttggaatggtgcagctgcggtaacgggaagcattaattatgtggatgcgaatggtaatcaggtagctacaggttcttacactaaggcgccgggatcatcaacttctgacatcacagccccaacgacaactgacggataccgttacaaggtcgtgagcgttgataagtcaacgtatgatggtagtgatatcaaggtgacggttgcaaagattgcaactggaaacattaactacgtctacaatggtaagacagtttcatctacgccatttacggatcaagatgctggtaagacggttgcaaacgtcgctgcaccagctggtacggttgatgggttgcgttacaagcttgctgatgcaacgaagtcatatgcttatcctgataaggatggcgatgtgaacgtcgacttggaagcgattgtctcaggtacaatcgagttcgtcgatgcagataacaacaacgctttggttcagcaacaagcctttaccgaccaaacgccaggtgcccaaatctcacctttgacgttgccagatggttacgttttggctgttgatgccaacggtgacgtacaatcaacgtacaactacccaatgactgatgcccaagtggtaacggtgaaggtacaaaagttgacgagcggcaaccgtaatgacggtatggaattgacggaagtgccttcattcagcagcgataacaacacaatcggtgctagtgacacaacgacattgacggcaacaaaggacggcgtcttgtcatacttgaacttaaagggtcaaaaggccgacatttacatgtcagccacagacttgaagtcaaacggatcagctttgccaattaagacgttgaaggctaacttgagcgccggtttggctgatgtctacgctgctaaccagacggatggttatggtcacatgattgttaacgatacgacgagcaagaagggatcactaacgattccagacttgcaaatgacgttgtcgaacaacaactttgcggcgggtacgtactcaggtactatcaactacacgatggtttcagatgacttgaaataacaataatgttttaaaaacgaggtaactacggttgcctcgttttttcatacaataagccaaagctcacaatacagtttgtttatgatagtaactgttataatagtatttaaaaataagtaattaatatcgctcataaaaggagcaatgccgatgaactttttcgttaatgcgacgatgccaaagcaaaagtctggtatcgagcacgcgcaattgaagcgctttgaactatttaataatcaccaggtggattcacggattattttgcgtgattgggatccagttgcgcacgttaatgcgaacgcagcgggtattccggataaccaactcattaatatgtttgattattttcaggaagctgttacggtgacgccgaaaactctgcacgcgcaagagattgaatttggtgtgccaaatgtacaatttgctgatgaaccggcaaataatcgttatttggtaacggcccagaatggtcaattggtagcgcgcgtgaattatgacgccactgccgataagcgggtacggtcaaccgagttatttgatggttataacaatttattccgggttgatcactatgattcacgtgggtttgcgtcattaatccagtggtatacgacggataatcaaattggtacggaaacgtgggtgaccccatcaggccggacggtcattgaaacttttaataagaagacaatggccggtgagtttgttaaatcaggctggcgtttgattgaacatggtggtcacgtgatgcagttcgacacgattgaggagctgacgaaacacttctttgatcgattgaatgatgatttctggtcagaagagcaaccaaatgtctttgtgctggaccgttcacacctaggcgactggggtcttttgcacttgcgcaagcctgcctatgtcgtgatgcaccttcacaattcacatgcgggggatgcccaagatccaatgcatgccattttgaataatcactatgaatttgctatgaatgcgcttgatgaatatgatgcagttgtctcagcgacccataaacaaacgcatgacgtgaatgaacggttccaacctaagacacgcctctttacgattccggtgggagttgtacctgaccgtctgttgcaagctgaacggatgccagttgcgcgccgcgaattcggtaaggtcatcgcgtttgcccgaattgcttgggaaaagcatctcgatgatttggtgcgagcggttgggattgtccacaaggaattcccacaagtgacgcttgatttatatggttatgctgatccagcggataactataaagcgcgtacttctgttgaagaagcgattcgtgaatacggacttgaaggtgttgtgacgatgaaggggtacacaacagagattgatgctgtcgaaaacaatgccatgatgtatgggctaacttcgcggatggaagggttcaacctagcgattatggaagcaatttcacacggtttgattgccttttcatatgatgttaattatggaccaaatgaaatcgttgaagatgacgtcaacggtaatgtggtgccatacgaagactatgaggcgatggcacaagcaatgttaaaggtcttacgcgacccagacttggcacaacgttattcaacgggagcgtacgagtcatcagaacgttattcagaagaaaatgtgtggcatgcctggcgtgaattgttggatgatgcggctgcggtgtggcctgccaagcttgcagcaatgccggcccatgcccatgatttgaacaaggaggctgaatgatgaattattttgttagtgaaaatgtctttacgttcaactccggcacagaacatgcccaagctaagcgcgtgcaactgttcacagagcagggagaatcagcgcaatatgtcacgcgaaattataatcgtttcttagctcgtgatgccgaatcaatcggtttacacgcagaacaagtattgaatatgtatgatttcttccaaggggtcaccgacgtaccgcgtgaggaagtttcactgcgcttgttgccacagattccgttggatgagtaccatattgaaggtcacggtccaaactattcaacgattaatcatgctggtcgcgagttggcgcgcattaacgttatgccagctacggtcggattagttaatgatattgtctactatgaccgttatggcaatacaacggctcgtgagaattttgattggcgtggttttaagtcatcggtagattatttccatccagatggtaatttagcggtgcaaaagatgttgaacttggctggcgagacggttattgaaatcagtcacatgaaggttaatggcacgttatacccaaccatgtggaaattgctgaattacaagggccacgattggcgttttaatacggaagatcaactatttcttttcttcttaaacgaaattacggctgaacatccaggatcgatccttgtgtctgatcgtcgcagtttggatcacgtggttgcggatgtgcaatttgcggcgaagaagttcgcagttttgcatgatatccatacacctgatatcaaaaatccaattcgcggtaagttgtatgatgcttatctgaatgtccttgagcgtcgcgtgcgagacttcgatgcgattctagtaccaacgcctgagcaacaagctgatttgcaaaagcggtatccgggcgtcgatttccgagtggtgccggatacatttgtgccacaagcacaattggccgcaacacgtctacgcttgccagatcgccaagctggcaacattttgtttatggggcgtttgtcgcctgaaaagcgaccagatcaagcaattcgtgcgctagcccgggttgttaagtcagtgccatcagcgacgttgacattccatggttatccagcaaacgcagaaattttgaatgaattgaaggcgttggccaatcagctaggggttaccaatagtgtcatatttggtgattacatcaccggtgacgctttggccgcagcttatcaacgggcacaagtgattgtgcaaacatcagtcgcagaaggattcggtatgaacttagttgaagcgatgagttacggtgttccagtcgtatcgtatgatattacgtatgggacgcgagaacttattcatgatggtgtgaatgggtatgtcgttgcaaatggtgcgcacggtgaaatggccgatcgcattgtgtcgattctgtcagatgatggtgtctgggctgatttgtcggccgcagcttatgataaagcggtgacatttaatggtcaggcgatgatggcagcttggcaacaagccttacaatagtaaaaaatagaaccctcgctaggcaattggcgagggttcttgcgtataatagtgaaaaaagaagttggagaattgggtatatgacgaaatttgggacaatttggcgggaaacatttcgacggtattggcgcacgatggtgatttttgccatcatcaatgtcgtgatttggtttgtggtgttggcactagtgaaattcaatgcttttgggctacatgatttggctttgaaatcgattaaagcaaatttcgtaaacgatgcatcgtcgcacaaaatcaatcatagcggagcctttggtggttttgtgcaattgacttggcacaactatttaggtggtttagccacggtggcgatatcactgattccaattccattttggtgggtgaccgcggtgatgaatccagcctcaattggatatttacttggcttatcgccaatccccgtgacaactttctttgcaggtatttttccgcacagtattgtcgaaatgcccatgcaatggttggaatttagtattgcttgggaaacattccgcttgatttggcaaaatatccggacgaagcaaggctggtggcatggcatagactggcgtcgcattatcacaattctaattgtggtggttttgccaatggcaattgtggccggtgccattgagagctttatcacgccagcattgttgaacatggcgaagtagcgttacaagttgtaaactcttgataataaaaaagaaaatccccaatcggagcgacacttccgattggggattttctttagaggtagtgacgggaatcgaacccgcgatggcggttttgcagaccggtgccttaccacttggctacactaccaaattaatcatagtatttgtaccacgaatacatattataggggaaatgtgaacatcttgcaattcaatagggcattttctaagatgtcaagcaatatgcttaataacttcacgcaatagtttaaccattgtaacttctgttttctatcactgaaaaggaaaaatcgcctcgtatcatacacagtgagggggagtctcgtgacttcctggagtggcgagaatacataaacaagtaatgatagaggcagacttatggaaaagaatgattttgcaaaagcgaatacgcaacaggcaaagcatcgccgtatgtgggtgaccgcggggatgacggcgctaacggttggggcaagtattgctgggccggaactattggatgaggttcagactgatttggggaataatgaaccacgcacgacggtaacgaaagatagttcaccgttggttaaggtgggaaatgtgctgttttcatcacgcacagctgctgcggagacgattaataatgtggtggatgccaatggcggtaaccacagttttaagtcaacgcaaactcaagtgacgacaaacttcacgggttcaggaactggtttttcaaatgcaagtggatcgtatggcgggcaaagtgcaacgtttacgacgttgacgaattcttcaggtcaagatcagggggccattgcctttaataagcaattagacatgacagcgtcatggacgttgaaatttaatttgaatttgacaaaatataacaccggtggtgcgctagcttatggtgattcaaacggtgctggtgactttttggggcttgtattggcgccggttgcccctaacaaattaggcactagtggtggcgggggtggtgcgcttggaatcgggactgatgataagacggctggaattccaaatgccgtacaatggggaatcgatttttaccaaaatgaaggcgatgcgacttcattggttaaccctagcaagggtaatttgttgagtagtggtgataatggaaatcaagttgccggcttccgtacaactgatgctaacgggaaactaaatacagtgaatggatcagagggatttactgcgtttgatcacggtactggtactgctgtcatgggattcacaggagaagggccggcaagtgacacggatccggactggaagggagcatctgaccctaatttggaagcgccaatgacagccacatatacgtttgcgaacggcgtaggaacgctgacaatcaaagccgataatggtagttacaccgctacgaagcaaattacgattactgacggtgtgaattcaacaatgtcggttggatttaaggcttctgacggtaccaagtattcacaaaaaggtgtcacaattcgtgagtttgatttgacgttgccaaccgcagataccaaggttaactacattgacaaagaaggcaatgctatttcagggcaggcaagcacgacaattaagtcaaacgttaatgacacgttaggcattgtgacgtctggtgcgtcaactaacacgacgggtacggcgcacacgtttacggcaccaaccattgccggttacacgtatacagggacgacgtatggtacagccaagtcaacgacggggccactgacggtatctgacaccgatgcgaacaacattattaatgtgcaatacgcgaaaaactcaaagttgacaacggtcttcgtggaccagaatggccacgtgctatcaacggtaccatccgttgaattgggaacagcgggtacaaattacgatgggcagaaggccacggctgcagcggattatgcggattatactgctgcattagcgaccgccaagagtaatggctacaccggtgttagtggcgtttattcagattctgccttaacaacgaaacttggggcggacttatcagcggcgacttttggcaacgctgataaaacagtttatgtgcaattaacgccagctccgcaaacagcgacaatcacatacaacaaagcgactgggctgagtacggcaggaagtacggcgcaagataatgccgtttcagcgtcaccaacctcattgacgggggtcacgaatgacaagtacccagcgaatacgattcaagtgccagcggggatgacggccacaatcaaagatgcagcgggtaacacgttggatacagatacgtcgaaagcgacacacctggttaaaaatagtgacgggtcttatacgattgtgggggcgtttagcctaacatcggcaggggccttagcggtaccaagctacaccgtgacgtatacggcaaatgcggtcaaaatgattcaacagtaccctgatgagacgcgctcaaacgccggcacggcctatggtagctatagcgctgcgggtgttgtgcaaaagtcaggctatgtctcattcgttgatggtacaaaagccaaccaaacgccggctggtacgtttggcgcaaccgataaaacatataccattacgtacgaagcggtccctgcgacggctggcgaagtcgctaatgagccaacggtgacggcggcgttggctgcagtgaatgcggcaacaaccgaaacggattataaagcggctctggcagcgtataatacagcggtttctgatgcgcaaacggcccgtgataatgctgaaacagcagcgaaggccgtggattcaagtggcttttcaacggtgacggcagtttcggatgcgcaaacgaatttgaataacgtgttggctcaagccgcagccgggcaagcaacgacgcaacaagtgattgatgcaacgaccgccttgcagacggcaatttcagatgcgcaagcggcactggatgctgcgaaagcccaagccaagacggatattcaagccaatattgatgatatcaacacgcaaattacgcaaatccaagctgacattgacgccattcaagcgttagctgatcgcaatccgggggatacaaccattgctggtttattggccgatgcgcaacaacgcttggcaaatgcacaatcacaactgacgcaggctgaagcagcgttggcagctgttgatagtgcggcaaccattgcggatgtgacgaacttaagcgatggcgctgatcaaaaccaagcggcagccgattcggcacgtacaattgcggaccaagatttagcagccgcgcaggcgcaagatgcgttgaatttgaaaaacgctaaagatgaagcaacggcaaccgccgaaacaacaacgacggctaaccaagcggcgattcaacaaattgaacaaaatattgccgaactacaacagttggctgaggattatccgaataatgcgacgattgcaacgcagttaattaatgcgcaagatgcattggatgcggcgaataaggcgcaagccgacgttgatacagcaagtggcgaagtgcctggtttaacgacggttgaagcggttcagattcaacaagcggccgttaatgcggcgggtaaggatgcccagaatatgctggttgtggccaatgatgctgtgacagcagctaaggctgaagcagagaaggtactgtcggatgcgaaggcggcggcaacgagcgccattcaacaacaattggatgaggcggatgccaatattcaaacaattaaagataatattgcggccattcaaacaattcttgataacaatccaggcgatgctgatattcaagcggccttggatgatgccaatgcacaattagtgacggcgaacaatcaattggcagatatggctgaagcatatgctgatgcgactgatgcgaccacaccggctgaagtacaggcggcccgcgatgccgcgacagcagctgcaacagcagtcactgatgcgaccacacaatcaacaactgatttgacgacagcccaggcgaagagcgatgccaacttggcagctgctaaagcaagtgccgagacaacgatcggtgatcaaattgaccaagttggggatgatattgcagcgattcaggatgatattacggcgctaacacaaattgcggcggataatccaacgaatacagaaattgcggcaaagttagcggacgctaaggcacaattagcaactgctcagacacaagaatctgatcttaaggatgcgaaggcagctatcgatgcggcaacgactttagcaggtgtgagtgcgcttgaagagtctgcgacaacggcagccacaacgagtgcgacagccaaaacagcagctgatcaagatttgactgatgcccaggcgttagcagctgctgatttgcaggcagcgcaaacggcagccacaacgacaattcaaggtaatatcgatgccatccagaatcaggttgaccagattacgcaagatatcgccacgattgaaacgttagcgacgaataacccaggcgatacagtcattgcggacgcgcttagtgacgcaaagcaacagttagctgatgcccaaacggcgttaacggatgcgcaagcacaacaaacagcggttgcagacgcaacgacaccggctgccgtgcaagcggtagttgatgtggcagcgactgatcaaacgacggctgaaacagccgggacgacatcgacgcaagatgtggcaacagcgcagcgtcaaaatgatgccaatttggcaacggcccaagccgcagcaaaggatgcattgcaagataatattgatgaaattaatgatgcgatcgcccaaattgcaacggatgtggcaacattacaaaccttggccgacaacaatccaagtgatcaaacgattgcggataagttggccgatgcgttgacacaacagcaaacagcgcaggatgcattgaccgatgcacaaacgcaattgaccaatgttgaccaaaccacaacgttggcccaggtcgatgccctgacaacgcaaggtcaggcggatgaagatgcagccaaggcagcagccgaagcggtcaatacagacgtcacgacggcacaaaatcaatcggctactaacttggctgatgccaaagaaacggccaaggacactattcaagctaatattgatcaaattacgagtgatgggacggcgattgacaatatcattgcggaattgacagatttggtgacgaataatccgggtgatacaaccatcgctgatgcgttgcaaacggcccaagatgagaagacaaaacaagccgatgccttgaaggacgcccaagcccaactcgcccaagtcgatgagcagacgaccctggccgatgtggctgatttagtcgatcaagcagcaactgatcaagcaacagctgaccaagcggtggttgatgcgtcacaagccttagacacagccaacgcgcagtcagccgataatttggctgacgcaaaaacagcggccaaaacaacgattaccagcgacctgacggacattcaagataatattgatggcattcaggataatattgcagacctacaacaactagtgactgataatccaacgaacacgcaaattgcggataagttggccgatgcgcaacaacaattgaccgacgcccaggcggaaaagcaggctgcgcaggatgcgttagatgcggttgataatcagacgacgttggcggacgttcaagcccaaactgatgcagccggtcaggcagtggttaattctgatggggatgcgacacaagcccaaaccgatttggatgacgcacagaacttggcaaatgctgatttagcagctgaccaagcggccgcccaaaaggctgttgatgatcaaattgcccaaatcacggatgatattgctgcgattacgcatgatgtggcgaccttgcaagagattgcgacaaataatccagatgatacggaaattgcggataagttggcggatgcccaagcacaacagcaagcagctgaaactgcgttgacggaagcgcaaaatcaaaagacggcaatcgacaatgccacgacgcctgctgaagtgacggcagcccaaacaacggccgaaactgcaggtcaaacggcgagcgatgctaaggatgcggctgaccaggatgtgactgatgcgcaagcaaagtcagatgccaatttggcagcggcaaagacggctgccgatacggcactagatcagaatattgcaaatatcacagatgatgtatcagctattcaagatattgtggatgagttacagacgctcgcggataataatccgggcgatacggacattgcggacaaactcgcggatgcccaggcccagttgacgacagcgaatgatgcgttaacggatgctcagaaccagaaaacagcggttgctgatgcgaaaacgctggctgatgtccagaccgctgttgatgctggtcaggcggatgaagatgtggcgcaaacggccttggaaaatgcgcaggccgatcaaactgcagcacaggcaaagtcggacagtaacttggatgacgcgcaacaagcggccaaggatgccatcacgcaagacttagcgacgattacggataatgtggccgcgattcaggcggacgtggtggctcttgaacaaattgcgactgataatccaacgaatcaattgattcaagataagttagcagatgcgcaacagcaattaacggatgcgcaaacggcgcagacgaacgcggaacaagcgttagatactgtgacgcaggcaacaacgccagccgaagtggccgtgcaagaacaaatcgtgacggaagcggtaacgtcgacgactggtaacaagaatcaagctgaccaagacttggctgatgccaaggatttggccggggctgatttggccgctgatcaaacggctgctcagactgcggtgacgaatcaaattgatcagataacggctaatattgaccaaatcaataaagatatcgcgacattgacggacattgcggcgaagaatccagaagacacagaaattgcagataaactggccgatgccaagacgcaattggctacagccgaaacggcgttaaccacggctgaaaaccaaaaagacgcgattgcggcagcaacgacaccggctgaagtggccacagcgcaatcatcggctgaacaagcaggtgacacggcgcaaacggcgcaagacacggcagatcaggatgtggttgatgcacaaacaaagtcggatgctaatttggcagcagccaagacagcggctgacacggctttggatcaaaatattgccaatatcacggctgacgtcgccgccattcaagacattgtgaccgatttgacgacggtggcggcaaacaatccaactgatacgagcattgcggataagttggcggatgcgcaacaacaattagcaactgccgagacggcgttgacagatgctcagaatcagaagacagcagctgaccaagcaacgacattagcagatgtgcaaacggccgttgacgcgggtcaaacggatgaaaatgcggcacaaacggctttggaaaaggcccaggccgatcaaacgacagctcaagcccaagccgatcaaaatttggcggatgccaagacggcggctgaacaagcgattacggataaaattgcgacgattgatgatgatattgcccaaattacggctgatattgcgacacttgaacaaatcgcaactgataatccagacaacacgaccattgccgacaagttggcggatgcgaaggaacagttagcagcggcggaagatgctaaaacgacggcagaagcagccaaggacgccgtggccgatcaaacaacattggctgatgtggcgagtcaaacggaagtcgccgatgaggcggtgacggcagcagatacagcgcaaaagacggctgatcaagacgtgaaggatgcgcaagctgcagctagtgaagatttggcaactgatcaagcggcagcgaagacggcggttaacaatgatattgcgacgattacggataacattgataaaatcaccgatgacattgcgacattaacagacatcgcggcgaagaatccagcggatacagagattgccgataagttggccgacgcgaaggcacagcttgaaacggctgaaggcgcactcactgatgcaactgatcaattaacggctattgataatgccacgaccccggctgaagtggctgatgcgcgtgaagcagggcaagatgcggccgacttgtcacagacgacagcggataatgcggcgcaggatgtggctgatgcgcaagcaaagtctgatcaaaacttggcggatgcgcaaaaagccgcaaccgacataattacggataatatcgcaaccattgccgataatattaaaaatatcactgatgatattgcgacattgcaagatttagcagataagaatccgggtgataccacaattgcggataagctggcagatgcgcaacagcagttaactgaagctgaagcggctaagacggcagctgaaagtgacttggaccaggtggctgatcaaaccacgttggctgacgtcgctgatgttgtgaatgatgcagctgatcaggtcgcacaagcacaagaaaatgagaatcaggcccaaacggatgtggatgatgcgcaacaacaaagcgccacgaatttggcaacagctaaggatgatgccaaggaagccattaaccaaaatttgagtgacattgacgatgatattacccaaattacggctgacatcgatgcgcttgaacaaattgccacggataatccaactaatacaacgattgcagataaattggccgatgccaaggaacagctagcagcggcagaaacagctaaggacgctgctcagcaggcgttggatgcgattgatgagcaaacgacacttgctgacgtggcaacgcaagaaaaggctggtgaaacggcattggctgatactgacacagcgcaacaaacggccgaccaggatttggcagcagcccaagacgaagcagccaaagatttggtagctgatcaggtggcaggcaaagcgacggtcaatgagaccatcaagtcgattcaagatgccatcacgacgattacggatgatattgcgacgttaacggatctggcagccaagaatccagcggatacccaaatggctaatgatttggctgatgctaaggagcagttggcgacggcagaaacggcacttgccgatgcgcaagatcaattagcagcgattgacgcggccaaggtaccggcggatgttgatcaggcagttgccaccgcacaaacggcaggtgagacgtcagcgactgcgcaaacaacagctaaccaagatgtcagcgatgcgcagactaagcatgatgccaatttggcagcggctaaagagatggcaacggacacgattcaaaccattgttgatggcctggcggataacatcgcccaaattacggctgatattacaacgctacaagatttggctgataagaatccgggtgacacggtgattgcagataagttggccgatgcccagaatcaattaactgatgcaactgccgcacagaacgacgcgcaaaatcagttggatgcgattgccgaacaaccgactatggctgcggttgatcaattagttacgcaggcccaagctgatcaaacggctggatcagatgcacaaacggctgctgataatgatgtgacggctgcccaaacgcagtcagaccagaatttggcggcagctaaacaagcggcgaccgatcaaatgacaaatcaattaacacaaattgatgagaacattacgcagattgaaagtgacatcgatgctttggaacaaattacggcggacaatccgaataatgcgcaaattcaggccgatttggccgatgcgcaggagcagttgcttaatgcgcaagacgatcgggcaacggttgaagacgcccaaacaaagctggctgatcagacaacgttggcggatgtggctgatttgcagacgacggcagacaatgccgttaagcaagccgcagatgcgcaaacggccgcagataatgatgtaaccgatgccaaagcgcaagctgctaaggacttggcacgcgatcaagcagatgcaaagacggcgattaatcaaaatattgcggtcattcaaaatgacattgacgtgattcaagatgacattgcaacattgcaggatttggtggataaaaatccaggtgatgacacgattgcagctaaattagctgatgcccagcaacaattgcagacggctgaaagtgcgctagcgacggcccaggatcaattggtagctgttgatgcggccaaggtgccagcagatgtccaaacggctgttgacgcggcatcgactgcgcaaacggcggcggataatgcgaagacgacagctaaccaagatgtaactgatgcccaagcccagcacgaaacgaacttggcagctgctaaggcgacggctgatgacaccatcgcggatcaaatcgcgcaaatgcaagatgacttggcagcgattcaagctgatgttgcttcgttgacggagattgctgcgaagaatcctgatgacacattgattgcggccctcctggatgatgctaaagcgcaagaaacgctcgcacaaaataagttggcggatgcacaaacgcaagctgacgcggttgcggatgcgccaaccatggcggccgtgactgacttgacggatgccgtgacgcaggatgctgcggcgacagccgacgcgctgactcaagctgaccgtgatgtgagcgacggacaaacgaagtcggatgccaatttggatgcggcaaagacggcggctgatgtggcgttggctgacaatattgcgcaaattaagcaaaatatcagtgatattcaggatgacattgcgacgttaactgatttgcaagacaagaatccaggtaacacggtgattgctaacttgttgacggatgcgcaaacgcaattggcagagtcgcaacagtcattggctgatgtcacgaatctcgcgaaccaagtggaagatcaaccaactttggctgatgtgcaaaaaattgtggatgcggcgcaaacgcaaactgattattcggatggggatgcaacgcaagcacaaaccgacgttgataaggcgcaagctgagtcaaatgctaagttgaatgatgctaagcaagccgcgacaactgctgctaaccaagctttggcggatattcaacaaagcgttgccggtattcaggaagatattcgtcaacttgaacagttagtgactgataacccgggtgatacgacaattgcaaatgcattggctgatgcgcaaacacaactcgacacagcacaagcgacgcagacggatgcgcaacagcaggcagctaaaattgcagatgccacgaccttggctgatgttacggcggtaacagatcaaatcgctcacgacgaggctagtgcgggtgtcgatagggaagatgcagatgctgcgttagcaactggtcaacaaaaatcagccgaaaacctagctgcggcgaaggatgcggccaagcaagatttgcaggataatattgacgctattcagaataacgttgctgaaatccaaaagattgttgagacaatcacggatattgcaaataagaatccaaatgatgcggatattcgtgccgcactaacgaatgcccagaatcaattggataaggcgaatgatgcgttgacggatgccaagcaacaattagcaacggttgatgatgccaaaacattggcacaggtggctgaaaagacagcagcaggggatgctgatgaaaagcgttctgatcaagctgtggcggatgcgcaaaccgagttgaagcaggccggtgccaagtcagctgataatttggcggatgcggttgctgatgcgatgaagcaagctgatgctagttttgcagcgattcaggcagatattgagcagattaaggatgacatttcacaaattcgtgcgattgctgcgaaaaatccggataatcaaaagattgcagatttgctcgcggatgctaacatgcaattgacggaagcacaaagtcgctatcaagcggcccaagcagctaagactgaattgcaggataagaatcaaacgacgaccttggcggatgttaccgaaaagttgcagacgattagtgataagacgactgcagctgatgtggatcggaagcaggctgaccaagatttggctaatgcgaaagtggcggcagctgatgatttggcagatgctaagcagcaagcaacagatgcgattaaccaacaacttgaccgtattgatgaacaaatcaagcaaattgagcaggacattgcagatctgaatgatttggctaagcaacatccagattctcaggcggttaaggacgcgttggcggatgctaagcaacagttgggtgatgcgcaagatgctaagcaaacggcgcaggatcaattgcaacagattggccaagcaacaacgccagatgcggttaataacctaaatgatgccgcccaagcagccggcggtgccgtgacagatgcggttaaggtagcgaaccaagacttggcagatgcaaaggcggcagtcgccaatgagatggcagctgccaaaaatgcagctaaggatgccgtacaacaacaaattaatcagttaacagataacgtgaagcagattcaagatattgttgatcaattacaaaatttggttaaccagcatcctggaaatcaagctttagctgataaattagcgagtgcacagacacaacttaaggttgcacaacaggcattggataatgcccgtgatcagctggcagcaattgatgcagcgacaacgccagccgatattgcaaaggccgttaaccaaattaaggtcgaccaggtagtgggtcagcaagcgctacaaacagcgcaacagctactagcggacgcacaaaccatcgcggcaggtctatcgactacggcgacggttgtacaagcagtgtcggctggtcaaatcgtaccagcttcagcaatgttggcgtacacagtaccacagacggtggcggtgcctggaccggttgtgacggttacgacaactggtgcgcctgagtatcgttgggccggcatgccggtaacatcgattgatcaagcggcaccagctgttggtcaaacaattggtgaacggacattggctggggcagccgcttaccgtgcgctagataataagggcgcccggattcaggatcgacgggttgcgttatcagatattaaccagacgcagcaacaagatggtcatgcatcactattgcgccatggttggcggatgccttactacttatcaggccgcttcatgaatgattggcacttgaatgcagccaatgtggtgacactattattctttggaagcttccttggatggttctttttaccagccaaaaagaaagaaaatgaagaagaatagttaatcgtaaatgcttatatagcaagggtttatagcaaatgcacacaatgaatattcattgtgtgcatttttattttaaaaaaggggttgcaaaggtgtagatatgtatgtataataatttttgttgttgagcgaggttatcaaaaacaaagcgaagcacgaaacaaatatcatggacgtttagctcagctgggagagcacctgccttacaagcagggggtcacaggttcgatccctgtaacgtccattggtcgcatggtctagttggttaggacgttcgcctgtcacgcgaaagatcacgggttcgaatcccgttgtgaccgttataatggctcggtagctcagttggtagagcatacgattgaagctcgtagtgtcggcggttcgattccgtcccgcgccattggaagtaaataacatttacatccaaaataggggtatagtttaacggtagaacgacggtctccaaaaccgttggtgggggttcgattccctctacccctgcttgacgataatggcggtagtggtgaagtggttaacacatcggtttgtggtaccgacatgcgtgggttcgattcccatctaccgcccttgaaagttataactttcatatcatcagattaatattagatatgccgttgtggcggaataggcagacgcgctggactcaaaatccagttcccgcaagggagtgtgggttcgacccccaccgacggcatcggaatcttcgggttcccatcaagcttaggcttttatctaatactaatcatgccgttgtggcggaataggcagacgcgctggactcaaaatccagttcccgcaagggagtgtgggttcgacccccaccgacggcataagtagagaccttcgggttacaagtaagacgttcgagaaatcgaacgtcttttctttttgtcttatgacatttttcagatattaataatggaaataaaaaatcacccacaaaatccgtgcagactctgtaaggtgaatttaggtttacgatttgaatgctgcaagtcgcttaatatcatgagtagtgagctcaccaatgtgacgtagcttggttgttgcgcggtgtaatttgttgatacggccacggtctatccatgatttttgtggcagtccagtagcttgctaatctagaatttcgaaatagtttttctgaatttgtggtgactcatttgcaaacttggtcgtcaaccgataaacaaaatatgaatcttgattctctcgcacatacaatacggggcgttccttgccacctggttgatctacaaatgatacatacgcccaatagagtttctttgccactagtaaccaccatcatcatcgaagaaggcttgaacatcagcgtccgtatttacctcaaaggttggtacttcgtaactgtcagcaattatctttgcttcagccaaatcttcatcagatagttcgtgcgtgattggaatttggccggtgttcaaaatttgtgcatataccaatggtaatagtgtactggtagtcaaaccagctttagctagtagagattcgaccgcttcggcaactccttcgtcaactgaaaattgtacgtgacgcttgattgtgtgagtcatagctgccaccgtcctttctgctgtgtagcactattataccgccatgtggcacaaagcgtcacatggtgccgatttgttaaaggtagattttactatgcctccttatatttcgcgaatattgaaatgaaaattaaaaaacttgtccacaggtcacgcagagaaaccaaaaggatgtattagtcgttaaactgaactgaaccccatgatttggatgcttgagaaccattcgttaattcttgtttgccagaaattatgtttctcacaggtagaccgatttcgtcacgaacggaaggaaaaaacatttgttgtgtcaactacaatcatggtgtactaagagtattaatatctttgcctggcatagtggagaactaaggcaaatcatgtagaaaacatggcttatattttgtgacatttcaatagagtgatgattgacacttgtcaactatgaggcattgatttacaaaggaccattaaaatatgctagttgagtagtgttaatcataaatgacataataaagcactgtgaatgcaattgtttgtaaataaggggattaaaattggtagttttgtacattatattaagctggattggggctgttgttatacatgaatgtggtcattgtatcgtggcttggttattgaaaattaacatagcacgactgggactgtttggttttgttattgatcatcagaaaaaaattcggtttgaagggagtggcctagggagttttgtggtgtttagaaatgctaaaccaactgttttgaatttaggaatactgtatgcgggtggtgcggtagctaatgtactagttgttatgttactgccgttaaaagctggcttaggtgtggagacattcacattgatgaatggtgtaatagctgcagttacattattgccattaaataatttagcaacggatggttcgatgctattgaacttggttatgaatcccgaagaaacggtgctgcattacactgtttcatattttttgacaaatgaatacacagaaaaatttgatgctcttttgcctcaggtattatcaacattggatggtcctttaggcaaggtgcaggagtcacatatcattatttatctaagttatttgaattatgtatgtgccttgaaaagaggtcgattagagaatgaacagaagcagttggtaaaaaaggtttttaatacggttttgtctgataaaagaatgaaatctcgatatttgagtgactatatggtaggtgaagtaatgacgcaaaagcttattaatggcaaaaattcggttggtgattataaggaattgcataaattacctatcttgttaaagagaagaattgcttatttattagaccccgaagatacggggaaaaaggctgactattaccgagaaataacgacaacggcacaaggtgagtcgactttaatgattaatggggagctcagttatttagctttataaactagtattagcggcggtggtgatgccgagcttaatctttccgcggacgtttcgcggatttgtgattgtagcactatgttatctggcgttttgtatctttatttacgccgtgtactttgtatttttaaaatataccaaaatggggttgtctcgagttgaaaagtattatcgattagatgaatagggttagataattacctcacgaaaagtatcaataaacaattaaaacaatgtcataaagtgcccgttaccgtatccgaaagcgattaaactgctggtgagggggtatttaacaatgacaatagatgaatttactaagaggtttcgacccggtaccacgacctctggctatctagatgaccgggctaaagcagaaatcagcgcggcgggaccgagttttgatcatcaaccaacaccggctgaaattcgcgcggtgatgggttggcctgctgctcatcacgaagcggtcaatgaattgacagtgcgggcacataagattgccggggtgtcagtgactgaatttgtgcaacaacaatatgatgaccaagttttgccggctgttgttttcattcatgggggcgcttttgttggcggaagcgttgcgaatgtgacgccaattctgcagcaaatggtggatgccggggcgctacgagtttttgcgcttgattatagcttggcgccggagcaaccattcccagcaggattgttagatgtatatcgcgtagttgtggcattgcatcaaacggcaaaacaatatgggattgatgaaacgcaattatcattagcaggcgattcagccggtggtaacctaacctatacggtggccttgcttgaccagaatttacagtcgaattatttgcataaattggttgcgatgtatccggctgtctacaatggccatgatgccgaaaaggaaatggatttttcgaatatccaggcatatggtgcccaagctgaccaagcgttgattgcgcagtacattgcgtcatttagggaaagcacgttaatttcagattggtatctccaaggcgttgatgatgagcaaatggcggtttcgccgatcaatgcaccagcagcgatgcttgctgagttaccggcatcactactaatcatcggtgagtttgatccgctccgtttggagggggaggctttcttcgaacgggtacgtgatgcaggtggaaccatcgcttacatccgttacgatggcatggtgcatgcatttgtagacaaaattggtgactatccgcaagccaaccaagcagtgttagacttggtagattttgttttagctgaatcgtgattgtgttaaaagttatatatgctggatatgaggcattcgagggattgaatgccttttttattgcaaaaaattggtgttaaattagtaattaatggttttcggatcgaagaataagggaggccaagaaaatggcaaagcgaccagaaacgattgcgcttgaaaattggttatttgcgcgtcttaacccgcgaggtaagggtcgagttagtgcttacggggcgactgaagtgacattgtcaacggatgcctcggcaaacaaattgggcaaaggtcgtaagaaggctggctatcaaggccgggttgatttcattagtatcgatacacaacgaacagtgcgagcttacgaaattaaggtgtcgatacaagattttcgaacacaggcaatgaaatcatgggttggtcattataattatttggtgacaaccgatgaattggtggacaaacatcgtgatgaaattctagcggcgttaccagatggcgttggttggttaacgcccacgcagacagtgcgtcggcccaagcgacacgctttgcaaattgatgagacgtggctggtttggttaatgatgcgccgtaatgcgatggtggtccgtgatagtcggttacaggactgagccggagaagcgaaaaatttggtacaataacaggaatacatataatgaatgggagcgcgaagtaatcatgggacggcaacggaatgaagagacaattaaacagattcgccgcgccgtttggcaactctttctggccaagggctatgggaaaacatctttctctgacgttgcccagactgcccaactgaatcgttcgattgtccaatattactttgcgaaaaaagaagatttctcaaatatgttaatggcccaagtttcggatcaggtcctagtcgtcgtcgatcagcaatttccagatgcgagccgtcttgagcgctattatttagctagccagttgtattttgctgttttttggcacccagaattgcgccatttactaaaagaaattctcgaaaatcgcaaattagcagatgagtcgatgtataaccaggtgatttggtcagtgaatatattaactgacgcagttgatgaagctaaattcgaagctgcctatattgatgtggtggatgcttggggtggctttgcagaagtgatgtactattcattacagcgtgatcgtcaagttgatttggcacgtggtcttaaacgattggtgcccttgattgcgatgattgcgggttatgaagcgaccgtgtgtgaccaagttattgcgacgcataccttaacgcccgaacaacgtgatgaattgcgcgaccgcattttacaacaattaaaccaagaaaataattaatgaaaaccctttggctgttagttggcagctgaagggtttttgtttgacctgttaaaaagttagtgataaagttatcaataagcattacttggtatgcatacaggaaaagaaacttggggtattaatcatgaaatatgacgttatttttattggtagtggtcatgctgcttggcacggtgcacaagaattggcccgtgcaggtaagcgcgttgcgttaatcgagcaggagaaagtgtctggtacatgtaccaattttggctgcaatgctaaaattttgctcgatggaccggcagaattgttacatcacttacacaattaccacggtattgggatgaacgatgcggtgaacattgtttggcctgaattgatggcctacaagcaccaagttatcgatccaatggatgaagcgatggcacaaattttggcagttgatggcattgatattatttttggacacgcatcatttgttgatgcccacacgattacggttaatgacgacacgtacacggctgataattttgtgttggcaatggggcaacgcccagctaagttgccagttacgggtacggaattaacgcatgacagcaaggatttcttagatttgccagaaatgcctaagtcaatgattatgattggagctggctttatcggaatggagtttgcgtcaattgcgcaagctgccggtagcgatgttacgattgttgaatatgctgaccgggcattggctaattttgatgcagactacaccaaccgagtagttgagttgatgacggctaaaggcattaagtttgcttttaataatgcagttgaacagatttcacaagacggtgatgttttcagcgtgaaaacggcacaaggcaacacattccaagcggacatggtctttgatacaactggccgcgtacccaataccgacgatatgaatttagcgtcaattggtgttgagaccaatcgaggcggtgtcattgtgaatgatcacatgcaaaccacggtggcgcatatttacgccagtggtgatgtcgttgcgaagacaacaccacgtttgacgccaacggccacatttgagtcattgtatattgcggatgttttgttaggtcagacaaccgcagcgattgcatacccagcagtgccatcagtgacgtttacgttgccacggatggcgcaaattggggtatcaactgctgaagcggctgactcggatgagtataatgtctatgatattaactttgcgcaattggggatgtttgccagccatcatgacacggaagccaaagtgaagattgtgttgaatcagcaaaaacagttggtcggggccgcgttgattggggatgcggcgccggaactcgtgaatacgttggtgccaattatcaaccataagtacacgaaggcggacttgaataagacgatttatgccttccccacgccgtcagcgatgttaccaatgttgttggcgaatttcttagcctaataatctacatagaaagctcggtgagaaccgggctttttaatttgagaataactattttttaacgagcggttaagtatacgttattaagcgaattagtatacataagtattattaacgaggcgcataaatgtcggttaaaaaatggaaggaatgaagtagggatgttagaaaagattatggcagtgtgtaagtcaaagtgggtgttagggttattggtagttggggtgtcggcttcagcagccgtagcggcttcggctgcggtttccggttggaatggtgcaactaatatgaatacggttaatcaggtgcttggccaattggatggtatgttgacgaaccgtgagaatcaggtgaagcaacttaaagcggacttgaaggatgcggacgccacgattgcgacgttgacgcaacaacgtgacgccgcgaatgcgaagttagcgacggcacaacaggatttgttggcagcacaacaagccgtgacggcattaacgagtcaattgaatcaggctaaaactgaaaatgatagtttacgtgggcaattggatgaaaagataaaagaaattcaacaaaaaattgcggatggtaaccgtcaagttgaattgaagcaacaagaagttgatcgtttaagtgcgcaggttggcagtttaaatgggcaattgggtaatttgcagaaccaattgacgaacgtcacgaatcaatataatgatttgcaacatgcatcacacgcgcaaattagttcgctatcatcagaagttgatgatttacgtaatcaattacgggcagctgaacaagatgcgcaaaatacagcggataatgcacagaatattttggcaaagcacaacaatacgaacgtctaaaatggacattttggatgcagttcctcgcagtttatgggttaagtagtaaactgatgctaagggggatgccaaatgaaaaaatggatgagtacaatcattgcgttagtggcgatagttggcgttgcatttgggctacatcagtcgctgaaattgaagcgtgatacagcaaagtatacctattctaatgtgccaactctcttcattcacgggtatggtggcactttgaattcgacgaaagacttggtccgtgcagcggaaaaagcaggtgcggcaaagaaaatgttaacggcgcgtgttacgaaggatggtcaagtgaaattgtcgggccattgggataagaataagtacaatccaatggttcaagttgttttttcggacaatcgtaatgcagattttcacacggatgcgaaatggatcaaacacgtcattgtggccttgcaacagcgctatggaattaagtcgtttaatgcggtcgcccattcgatggggaatttggggttgctgacgtatgaaatgacgtatggtcaggataaatcattaccgcaactgcgcaaacaagtaaacattgcggggcattttgatggtattcttggtttgaataaagaggttgccaataatacattagatgcgcaaggcaagccaacgaaaatggtgtcatattatgaatggttattggcacatcgggataattatcctgatcaacaagtggcggttttgaatatgtatggtgatttacataatggtagccactcagatggacgtgtcacgacaacgtcagcgaagtcgttgcgttatctgttaggaaatcggccaaaatcgtatcgtgagaaagaaattgttgggccaaatgcacaacatagtaaattacacgagaataaccaagttgttaatcgggaaatgattaatttcttgtggggtaaatagaaacgttattgcaactagtaaaacgtgtcttttatagatagaaaaaccgcttagaaaatttttctaggcggttttttgtgtggcggacaaatgaactttgtaaagtgactatttacgaaatgcataccgaattaaaaagtaatcacaatcaagcctaaatgttggacgactagtctaataagtgtggcagggataggacgattttgccaaagctgattaataattaaaagatttgtttttgttaaaacgtttaacgtcaattaggatattgacgtaaatgataacggaaaggtatgatatcgacataaataataacggagagttactttttggcttttggcaggatgcaccagagccattactaaaattttttgttgagatatgggggaataatcgtgaatgtgaggtttgaacatgtaacgctgacatacaacaacggcgttgaagtgctacatgatatggattttgaattgccggatggcgaattgattgctttgttggggccgagtggtggcgggaaatcaacaactttgaatttggtgtcgggtctactgcgagcaacaacaggaaaaatctttttcggggatgatgaggttactgaaaaagatgctctgcaacgtggcgtggggatggtttttcaaaattatgcgttatacccgcacatgaccgtgttggaaaatattgttttcccaatgaagatggcgaaagtggcgaaagacgttcgtaatgaacgtgctcgtgctttggcaaaattagtacgagtggatgatcaactaaataagaagccgggcgctttatctggtggccaacaacagcgtgtcgccattgcccgcgctttggctaaaaatccgagtgtgttgcttttggacgaaccgttatctaatttagatgcccgtttacgtgttgaaatgcgtgaagaaattcggcgtattcaacaagcaacgggggttacgacgatttttgtcacgcacgaccaaagcgaagcgatgcacgtggctgataaaatcatggtcttgaatgatggtgttattcagcaatttgattcgccacaatcgttgtaccagaatccgcagaatcaatttgtggcccgctttattggggaaccagtgattaatgaagtaccggcgactgccttgcgtgaacatctggtgttgccagcaacggcagtgaccgttggtattcggccggaagcgattaagagtccggtgatggatgcgccagtgttaccagtaaccgcggaacgaattcaagcgtttggccgggaccggcaggcaacattacgattgggcgattatcggttagttaccacggaaattatcgaagctgttgaccaggtgtctttagataggactggagtgtatgccttcaatgcagcgggtgaacgtttgccaattgattgggatggtaaacgggcatgatgaataatacgaaaccgacttggcgtgataatttgaaagcgttaggttatttattgcctatgctgatcattgttggagtgttcagcgtgtatccaattatcaagagtctagcgatgagcttttacacggactacaacttttttacgaaccaagttaatgcaattgggtttgataattttaaaacgttatggcaggatgctaattttcacttagcggtttggaatacgattgtttttgtggtcggggtagtgcctgttgagattattttgtcgttagcgattgcgagtttactcaatcaaataaatcgattggctggtttgtttcgaacgttgtatttcatgccgtttgtcaccagtgttgttgcaatttcgatggtttggcggtggatttataacaaggatgcggggttgttgaattacctgttgggctttgttggtgttcacccaatcgattggttaaatgatccacattatgcaatgccggcattaattattctggcaatttggaagggcttaggatttaatatcttactattcttggtggccttgaataatgttgatcaacgtttgtatgatgcggcaatgcttgatggtgccaatggttggcaacgtttctggcatgtcacgctaccgatgatttcaccaatgacgttcttggtgacggtgaatgcggtgattggatcgtttaaggtgtttgatgagatttttgccttgtttggtggacaaccaggaccagggcacagcacattaactgtcgtttattacctctatcaaatgttttatgaacagaataagtatggattggccgcggcctcaggggtggtgctcttcctgatgattttagttgtcaccttgttccaactttggtggagcaagaaacacgttcattattaggagggtatcatgcaaccaaagaaaatattagtctatatcctcttagttttaggggctttgacaatgttattgccatttttttggatggtatcgacagcgtttaaaacaggctttgaagcattacaaacgccaccaacatggttgccgaaacactttcagtgggggaactgggtgcgcgcatggcaagcggcgccatttgccacgtacttgattaattcggtggttgtttcgctggccacaacgctgggtcaattggtgacgtcaatcctagcggcgtttgcatttgcaaaactgaatttttctggcaaaaaagtgttatttacgattttgctagcgacaatgatggtgcctggcgaaatgttaatcattcctaatttcgtaacgctatcagaattacatttggtgaacacttatggcgctctgattgtaccgtggttagcatcctttttcgcggtgttcacgttacggcagagttttgcgagtgtgccagatcaattgtattatgccgcccgattggatggcgcgagtgattggcaatttttatggcgcgttttggtgccaaatgcgaaatcaacgattacagcaattggccttttgcaaattattgggagctggaattcctttatgtggccgttaatcgtcacgaatacggagaagatgcgaacgcttccggttgggttgcaggcattttcaagcgattcgggggtgcaatatccagaactaatggcggcgtcaacgtttgttattttgccaatggtcgtcatgtacttattactcaataagtatgtcgtagcaggtatttcgaatactggtatcaaaggttaattagtgactgttcacagtatgtttgtgaacggtttagtggtgatgacaaagttgtcggcactaaactgttcggaaatatcacaagggccctgtgatgtgtctgacagtcagcggttgttatttttttgtgggaaaaaaggggaaaagttaacatgaagacttggacgaaattgttcgcaggttcagcggtattggcattgacatcaggtgtattcgcaacggcggttccaacggttgcgaatgcagcatcaaagccaaccaagattacattctggcatgccatgactgggaactacgccaaggcgttggatgaccaaatcaaggcgtttaacgcatcacaatcaaagtatgaaattgttgcaacggcgcaaggtgattatacgaccttgaatcaaaaggtgatggcggcagctaagtcaaagacgctacctgacatggcccaagcaacctatacccaggtgccagattatgcgaaagatggcatcgtgaccaatttggatagtcaagtgaaggggaaatccggcttatcgaaagctgatttgaagaacatctatccaggtttcttggaacaagcaaagtacaaggggtcttactatgcgatgccattttcagcttcggtccgcgtgatgttctataacaagtcgatcttaaagcaatataatttagcggttcccaagacatgggatgacgtcgcaaagatggcaaagacgttgaaagatcacaatattgcagcggttggttacgataaatcatttgatatggaatggaactcaatggttcgatcagcaggtgtaaagttggtgacgccggcaggtaaggtgaacgttaactcgaagcaagcagttgcagcagctaaaacaattactgatatggtggacaatggtgaagcgttgacggccggttctgacatttacgggacgacgaattttgttaatggtaaaacagcgttgtcattctcatcatcagccggtatttcagcaaccaaggccgctgcaccacaaggatttgattggggtacagctgtgatgccgtcatataagggtaagcaagcgacgatgctagctggtaataatttggttacgacggcgcaagcttctaagaaggaacaggcaggggcctttgcctttatgaagttcttggtgtcagataagcaaactgagaagtgggctgaagcaactggttatttgccaattacgaagaaggcagccaattcagctgattacaagtcgtacttgaaggcgaacccattggccaaggctgcttctgattcattgccaggggctttctctgatacggcattcttaggttatcaagagtaccgcaccgatttgctaagtgccacggatgcaatgctaacgaagaagacggcaccaaaggatgcattggacaccttgcaaaagcaaacgacgaagattgtgaaggataacaagtagtatgacgacaacggtaacggttctgaacggagtcgatacaattggtggtaatgtggtggcgtttgaaacgcaaacggctcgggtaattatggattttgggattaactttgcgcctgctgacagccaaccggatgatttgctaagcaacgggattttgccagatttgccagatttatttacagatatcgcaagtgataagcagaccgccatttttatctcccatttgcatttggatcacatgggggcactgaagtatctgacgaaattgacgccggtttacatgacaacggaatcggcaacactttatgcagagttgagtcgtcaggacttagagtcagcacccaatgcacgggtgcaagtaatagcaccgaataaagatgtgcaaattggcgatttaacggttctcgcattcgcgacggatcacgatattatgggtgctgtaatgtttgaggttacggacggacaacaccgctttgtgcatagtggcgatgtgcgttatgacggatggcacccagaacgtgtcacggcttggacgcaatacttgcatgaacatcgaccagatttgttttttattgaaggaactgaattttcgtttgatgacgatacatcacgacaacgacgaactgaagcgactgttttaactgattttacgaacgcaatggcatctgatgagctagttgtcattaatccgtatgagcgtaatgttgaacggctaatgaagctgagtgcagccgcccgtcaagtaaatcgtaaattggtttgggacgaacgctttgctggcattcttcgtgcaatgggcgcgtctaatgagataatgcttggacaggatgttacagtggcggatatgcaacaacagccaggtcgatacgtcttgcaaaatcattttgataatctgcatttgctcgatgcgtttgatacatttagttatttgcatatgaacggtgagccgttaggtgattatgacccacgttatgctgatttaacagcgtatcttgcgcaacgtggtgtggcgctacaacttgcgggtgctagtggccatgcgacacctgatgatttactgcgaatcgcagtggaagtcgatgcgaaaatgacagtgccttggcactcattccacccagaacgtgaggcagaagcgctacgacaaattggcatcgagacttatttgccgaaaaaaggcgaaatttttacgtttgaatagtggtttcaacttcaaaagccgtcaatctcccgatttaaaatcggcggattggcggcttttaaacgtgttcagaaaggctgaacccttaatataatgccatttcgtcgcacattttttctggaatggcggacgaatcgtacccgaattgacttgtcagataaacggcataaccttaagtgcagacatagcacaatgggacatcagggaggcactagttagaatggcagttgttaaacagttggctgatgtatttcaaccagaaaattacaatttatattttgaaatcgaccgcgaaacgaagacaattgtcggtcgaacgattattactggtgaagctagtacgacggatgtaaagctacatcaaaacaagttgcatgtaaaatcggtgtttgtaaatgacatcgcgacgttgtttcttgtggtggatgacgaaattcgaattacggtgcctgcggttggcaaggtgcggctgactatcgactacgagacagtcttgactgatgacatggtgggcatctattcagcagtatatcaggagggcggtgaaacgaagcgcgttgtcgggacacattttgagcctgcttttgctcgccaagcgtttccggcgattgatgagcctggtgctaaagcaacgtttgagttagcaattaagtatgatgaacggcctggcgaaatgattttagccaatatgccggaacaacaagtagttgctggtgtacattattttgcgaaaacagccccgatggcgacgtatttgttggcatttgcgtttggcgaattccatggcataactacgcaaacggcgactggtgttgaggtcggtgtctttgcgacaacggcgcacgcgacagccgaaatgacttttgcactagacattgcgaagcggtcgattgaattttatgaggactattaccaaaccgcttatcctttgccaaaatcatggcaattagcattacccaatttttcggctggcgccatggaaaattggggattggttatgtatcgtgaagcgtttttgttattagatccagataattcatccctgacagaaaaacaatcggtggcgacggtgattgctcatgaactcgcccatcaatggtttggtgatttggtgacgatgcaatggtgggatgatttgtggctgaatgaaagctttgcgaatatgatgcaatacgtagccattgatgcgcttgaacccgattggcatatttggcaactgtttttaacagacgatgtgcctctcgcgttgaatcgggatgctatagatggagtgcaaccgattcatgtcacggtagctgatccgaccgctttgaatgcgttgtttgatgatgcgattgtttatgcgaagggttcgcgaatgttggtgatggttcgcatgctgcttggcgatgctgtgctacgaaacggtttgaaaatttactttgcacaacatgcgtatcgtaatgcgattggggacgatttatgggctgcgctggcaagctcgtcaggcatcgcaattggcgaattgatggcgacgtggttgaatcagcctgggtatccgcttgtgacagcttcggttgaagcaggggatttaattttatcgcaacagcaattctttatcggtgaccataataacgacaagcgcctttggcagattccgttgcatagcaattatgccgcagtgccggaactgctgacggaacaaaggattgtcgttggggattacgcgcagttgcggcgtgaaaatcaaggcccactcctagtgaatatggagaatggggcgcatttcatcgtggcgtatgatacaactttatgggacgatatacagcaacatctgcagacattgcgcgtcgttgataaagcgcaactattacaagatcagcgtttattgttggcggcgcagttggtaccagctcagagggttgtgccactattgctggcactctctgacgataaacatagcctaattaaacacgcaatgaatcaagtcgttgcgacattgcgaatgtttgttgccgaggggacggttgctgataagcggttccgcaggttggttaatcagttaagtgccagcgaggtcacacggcttggcttgtcatcgcgagacggtgagacgtttgacgatagcacttcacggccaatcatgctcgaggcggcagtaactggcgaaaatgacgcgacaatcgttgccttgcatcgggtgtttgtggcgaataatacgcacctggctaatatatcgagcgatattcgtcgagtggtattggttaatgaggttttaaatttttgggatacattgttgtttgattatttaatggcggagtatatgaaagcacgtgatgccaattatcgagcagatattagtgccgctgtggcacggtcacgtgacttaacggccattgcgcaggtgttacgaacgctaaaaaatggagcggtcatcaaaccgcaagatttacggagctggtatggtgacctaattgcgaatgaggctgcggaacaagcaacctgggattggttacgtgaaaactggcagtggttgagtgaaacggtgggcggcgaagcaaagatgaatcgctacatccgtttaacggcgcaaacattcaagacacggaaacggttaattgaatttcaatcatttttcgaaccaaaacgagttgtgccggtgttgcagcgtgaaattcaggtggatgaaatgatgattaagggacgcgtatccttagtagatacatcgcgccagttggttaacgacgcgattgcagatgcgcgttaacccgcacttaaattagcacttatagacaatgagtgctaaaataatggtatcgaggaaattgctttgaagaatagtcatgagggaggctgtttattatggcacaagaaccatttggtttttcaaatattgatgatatttttaggatgatgaataacgaagcagcacgtaatcaagctgcacaaatgcgtcaaggacaggatccgcgcgcacaacggtcgggtaacggcggtaatggtaagcgtggcatgttagaccaatacgggattaatatgaccgaattagcgcgccaaggaaagattgatccggttatcggtcgtgataaagaaattgcccgggtcattgagattttgaaccggcgcacgaagaataatcccgtgttaattggtgaggctggtgttggaaagactgctgttgtcgaaggactagcacaagccatcgttaatgcaaaagtaccagctaagttgcaaggcaaggaagtcattcgtttggatatggtttctttggtacaagggacgagtatgcgtggtcaatttgaagagcgtatgcaacaattaatgacggaagtatctgaacgagatgatgtcattattttcattgatgaaattcacgagattatgggtgctggtacgactggtgatggctcaatggatgccggcaatattttgaagccggcattggcccgcggtgaattccaattagttggttcaacgacgctaaatgagtatcgtaaaattgagaaggatgcggcggtcgcccgtcgtttccaaacagttcaggttaatgaaccgtcagcggatgaggcactacaaattttgcagggtattcgtggccgctatgaggattatcacaagattaagtatacggacaacgcgttggcagcagctgttgacctttcaaaccgttacattaatgaccgtttcttgcccgataaggctattgatttgattgatgaagctggttcgcgtaagaatttgacggtgaaggttgctgatccagctgaaattgaaaagcaaatggcaaatgctgaaaagcaaaagcaacgcgctgttgataacgaagattttgaaaaggccggctactggcgtgatcaggtgaaccaattgacgttgcaacttgaggctgttaagcaacaagcgccgcaaaatgagcgggcgcaacaagtcacggtagcagacattcagcaaattgttgaagaacggactggtattcccgtgggtgaattggccgagtctgagcaaaatcagttacgtaatcttggtgaacacttagctgcccatgttatcggtcaaaaggaagccacagataagattgcccgtgcaattcgtcgtaatcgtgtcggattcaataagactggtcgaccaattggtagcttcttatttgttggaccaaccggtgttggaaagacggaaacagccaagcaattagccaaggaactatttggttcgtcagataatatgattcgctttgatatgtcggagtacatggaaaaacagtcagtttcaaagctgattggagcgccagctggttacgtcgggtatgaagaggctggattactaaccgaagccgtacgacgtcaaccatattcattggttttgttagatgaggttgaaaaggcgcacccggatgtaatgaatatgttcttgcaggtgttggatgatggtcgtttgacggactcacaaggtcacgtggtatcgtttaaggatacgattatcatcatgacatcaaatgccggcacgggtgataagacaacgacggttggattcggggccagtgatgggcaggcaacggctgatttgcaagccaagttagcaccgtactttaagccagaattcttgaatcgttttgacgacattgtgtcgttcaatgcgttgaccaaggatgacttgacgcaaattgttgatttgatgttggctgatatgaatacagcgattgcagttcaaggattacaccttgatgtctcaccggaagcaacggagaagttggtaacgttaggctataacccaacgatgggggctcggccattgcgccgtgtcatccaagagcaattggaagatcgggtagctgatttctatttggataatccagaagttaagcaactccaagcaaccgttgttgatgatgccattacagtgactgccgaatcggtagcgcccgcaacggtaacaacagaagagtaaagaaaaatacctgatcggttatgccggtcaggtattttttgcttattttttagttaaatcagcgccgaagtacttctctgaaagctgcttcatggtgccatctttttctaacttgcgttgggcttgtgaaatcttcttagccaattgcttattgtgcttatttagcattggtgcagccgttgtttggccaagcgcatttgttaccgttgcttgcaaattagtctcagggtggaccttcttgtaggcagtccacgaatcttgtgaattaaggaccacatcggctttaccgttggcaactaattctagttgctcagcgaagccaggggcagcgacaatttgagcacccgcttttttggccgcctgactaaagttggaagaagtcgtctcagcagctcgcttcccctttaaatcagcttaagttttgatatcagaccccttcttggtaatcaaaaccgacttcgtgaacaaatattcgcgcccaaaggtgtaggatttttggcgctcaggtgtaatcgacatatcgttgtagacgacgtcatatttcttagtatccaagccagaaatcaaagaatcaaatttagtttgcacaaagacgggcttcagcttgagctgctttgctacgtcttttgctaacgctacttcaaagccagaaagtttacctgacttcgttcggaatgaaaatggggcgaaaccgccctccaaaccgactgttagttgtcccttatgaataacgttaaggtgaccgactgttgcagcactagcgtttacaaacgctggcgctgaacaatgtccctgcggctaagccaacaagtgctaatttgtaataatgcttgtacatgtgttcgacacgccctttcaaaagtatgccgtcattctaagcttgtgaagctaccgatgtcaaaaaataaaaaacagtctggtttaggggatggatctgttgaaaacaacttttttaattgggctattcaaggtggatttataattaattttgacaggttaaggtcgctattgactttaatgagaaaagttctaatatttatgtaacatagaacaaaataaagatgtgtgcttagggagttaatatgacagcagaaaatgaacacttttacgaaactttccaaccttcgcattatgatttatatcttgatgtgaaccgcggttcaaaattaattaccggacgcacgacaatttcgggtgaggccaaagcattggcaattgccattcaccaaaaatatttaacgattgatgcggttaccgatgaggcgggggaagcgcttgcgtatacggttgataatgaacacgaagcaattcgagtgcaattacgtgaagttggtcccacggccctaacgattacctacacggcgccactaactgacacgatgatgggtatttatccgtcatactatgaggttcagggcgaaaagaagcagattgttggtacccaatttgagacgacatttgcccgacaagcctttccatcaattgatgagccagaggcaaaggcgacgtttgatttggcactaaagtttgacgagcaaccaggggagaccgtccttgcgaacatgccagaaatccgtgaagccgatggcgtgcactattttgcaacaacggttcgcatgtcaacgtatctcgttgcgtttgcctttggtgatttgcaaagcaagacaacgcgcacgacaagtggtgttgaagttggtgtgtttgccactaaggcgcacaaggccaatgaactcgactttgcccttgatattgcgaagcgatcaattgaattttatgaagatttctaccaaacgccatatccattgccacactcatggcaattggccttgcctgatttttcagctggggccatggaaaactgggggttggtgacttaccgtgaagcttacttaacagttgatccagataatacaccattgcggcgtaagcaaattgtcgcaactgtgattgcgcacgaattggcacaccaatggtttggcgatttggtgacaatgaagtggtgggatgacttgtggttgaacgaaagctttgccaatatgatggagtacgtcgcaattgatgcgattgaaccagactggcacatttgggagcttttccaaacgtcagatgctccagctgccttgagtcgtgatgcgacggatggggtccaatcagtgcacgtgcaagttgaagatcctgctgaaattgattcactctttgatggggcaattgtctatgcgaagggtgcccgtatgctggtcatggtgcgagcattgctaggtgatgacgcattacgtaagggcttgaaggcctactttgatgcacacaagtacagcaacgcaacgggagcggatttgtggcaagcgttgggtgaggcgtctggcttagaggtcggcgcaattatgaactcatggttggagcaacccggatacccagttgtgacggcgacggttgttgatggtcagttgacattatcacagcaacaattctttattggcgcaggtgaggatcaggggcgtcaatggcaaattccgttgaacagtaactatgcagcggtgccagaattgctcactgaccaacagattgtggtgggtgactatcaacaactacgagctgaaagcggtcaaccattccaattgaatgttggcaataattctcactttattgtgaagtacgatgaaactttgttggcagatattttgcgagatgccaacagcttaagcacgatttcacaattgcaattgttgcaagatcaacgcttgttgtctgagggtggcttaacgtcatatgcgacggttgtaccattgttgcagacgtttgcgaatagtgagcatgtcgttgtgacgacagcactttatcaagttgcgaataatttgaagaagtttgtgacgccagattctgaagaagcgcgtcaattgcaagtcttcttcgatggcttgagccgtcagcaagttgcccgactaggttggcaggcagaagcaggtgagaccagtgacgatgctattacacggccacttgtgttacgtgcagcactgtatgctgaaaatgctgatgcgattgcaacagcacatcagttgtttgttgatcagcaaactgatttagcagccttgccagccgaagtacgtggcttggttttgcagaatgaagtggaaaacttcggtagcgaagcattgtttgaccaattattgcaagcatacgttgcttcgtcagacgctaactataagtcagatattcaggtggcactaacccaaacaactgaccctgctttgattacaaagttggttggtaagtttgaagatgccaacatcattaagccacaagacttgcgggcgtggtatcgtggcgttttggcaaatgaacgtggccaacaagcggcttgggattggattcgagctgagtggcagtggttggatgatacagtcggtggcgacatggaatttaccacgtacattacagtgacggctggtatcttccaaacggctgaacgtttagctgaatttaaagccttctttgagcctaagttgccaacgccaggtttgacgcgtgaaattacaatggacatcaaggttatcgagacgcgtgttgcgttggttgtagctgaaaaagaagctgttaacgcagctattcaagcagcaaatcagtaataaatttgatagagtatccggttatgaaatcgggtactcttttttacagctaatttgtaagcgcttactaaatctgatatagtcaacttagcagaggttcgtgtgatttttgggggacgattatgtacgaatatgaaaatgtcagtgttgagtgggcagataatactgttcgcttcgattatgttgatcgggcggatgaacgggtgccattagatattccggaacattggcacgaagaattagagattaactatacgattaccgggggcaatcgtgagtatgttattgacggggaaactgaacagatggcagccggcgattttgtggtggtcaatccatttgaggtgcacggcgttcatcgggcgagtcgcgatacaaaaagcttattattactgatatcccgtcagtttattgagaaatttgggccgcggcttggtaatatccgtttcatcttgaaaccatcaattttcatgtcggcggagcaacagcaggcgaaagcaaaattagccgatttgatgttgtcggtgtggcaaattacgaaaacgaatcatgagtttcgtgatgatgaattaataggggtcatcttacaaatactgtcagtgatggccagtcatttcggtattgaaaacaaacatacggtaaccgataacgtggcagacacgattgcgtatgtgcaacggatgtacgcgtcagaattgagtttggaattgctggctgatcgggtacatctgagcacggcgtattttgatcggtgttttaagaagcaaaccggttattcagtgatgcagtatgtgaataaggtgcggtcgatgcatgcctatcaattgttgacggtgcatcataaaggggcgacgtttaccgcaacggccgttggttttccatcgacgcaggccttgaatcgagggctgaagaacaatttcggtctaaccgcgacagcgctgaaaaatagttaagtagcaggtgaagtacgtcagtgtacttcacctgctttttgcttttagcgaaggtgtcaatattgtggtcggcgccaaaatagggggtgattttgactttttgactagctaaatacgaccttgtcatgcaggtgtcttgtacgttgcgtgtgatgttgccataatcaaaaacgtagtaatgtaaacgcttgcattgcggaaaaaattaggtattaaccatgcaaaatggagggacatcgtcatggacaacaaaatgccgaatcaagtggggtggggcgaacgagtcgcctacgccatgtcggactttgggtgtaacacaatttttcaaatcgttggaacgtacttcttggttttctgtacggatactttaggagttgctgcggcagccgttacaggacttttcgcgattacagcaattattgattcaattgatggggtgatttggggacagttcatcgatcgaacgcatacgaagtggggaaagtcacgaccatactggttgtggtttgccattccatttgccatcttctgtgtgatggcctttacggcgccaccactatcagaaacgggtaaggtggtttggatttatatcgcctacattggcgcaaaggttttgtactcaggtatcaacatcccagtgacgtcaattttgccagcactgacgtcaaatccacaagaacgtgtgacgttgtcaacggtgcgtcaattctttggtaatatgggcgctgccattttcttgccattgacattgccggcagttggacttatcgcgggtatctttgataaaggtgctaaggatccttcaacgtcagcaaccggttggttcatctgggccgttatcttgggtgttatcacggctgcctgcttgttggttgccttcgccggcactcgtgagcgtgtggtcacgaaggactctaaccgtgctgttccaatgcgtgaatcagtgaaggccttgaaggggaactacccatgggccattatcattttcatcaactttatctattggggtggctttgccgttcgttcaagttcattgccttactactttaagtacgttttgcacaacgaagcgttaggaagtttggttttggctggaacggttatcacgttggcttcaacagcaatggtgccattcgttgcccgtcgtttgggtaagcgaaacacaatgttgcttgggatggtcggtacggctttgtcacaattggtactttacctggcggatatcatgaacggaaatgttgccattatcttgactggtattgtcttgtacttcatcagctacggtttgacgggtgccttgatcgccgttatgttgtcagacgctgttgatttcggtgagtggaagaacggtgtgcgtgccgaagggttcgtcacatcatttagttcattctcagctaagttgggcatgggaatcggtggtatggtcttagccgccgttctggcagcaggtggttacgctgcctcatcagatgggacgcaaacggcatcagcattgaatgcaattcggatgggattcatctggatgccatttattgggtatgctgcctcagcaatcgcgctgttgttcaacaacatcgacaagcttgagccaaaaatggttgctgatttgacggctaagcacgagcgtgaagctgcagaagttgccgacgcagaagcctaaattgataggcatttcaaacataattaaacggggaataaaaacatgaagtttacgaatggatactggctaaaccgtgatgagtacattgttaactcaccattggaggctttcgacgcaatggtcgtggagaaggatgaggacagttacgcaagtgatgccttgcgtgtttactcagcttaccaccggatcaactctcgcagtgacatgttggatgtcggtgcaacgacgatgacggtgttctcaccagctgaagacgttatcggtgttgagttgaagcacttcgatcgtgatgataagaatccactatacgagttgcaaaacaacaacgtgacgccggcaatcgaaattgcagattctgttgcaacgttgacgagtggtgatttgcaattggccgtctcaatgcatgacaagttcaacattgatttcaactacaagggcaagcgcattacgggttctgaatacaaggcgcaagcgtcaatcgatgatctgtcaggtaagcaattggggcaagtgatgcacgccaacacggttacgggggcgcaaaacttgggcccacaaggatcagttacagcaaccgaccactttatgcgtgagcaattgagcctattgccagggacgaatgtttacggcttcggtgagcgtttcggggccttcgtcaagaacggtcaaagcatcgatacgatcaacatggacggtggaactggttcagaacaaagctacaagtcaattccgttctacatgacaggtaaggctggcgtttactacggtgtcttcgttaacgaaagccaaccaacgagttttgaagtggggagcgaagtagttgatcgggtcagtttctcaacacgcggcgagtcattggaatactacgtgattgcaggtgactcaccaaaggcagtgatttcaaagtacaacaaattgacgggtgggtctgttttgccaccagaatggacatttggtttgtggctatcaacgtcatttacgacggactactcagaagagacagtgatgagtttcatcgacggcatgttcgagcgtgatattccagtttcagtattccactttgattgcttctggatgaagggcttcgagtggtcaaacatggaatgggataaggaacaattcccagatccagttggcttgttgcagcgtttgcacgacaagggcttgaaggtctgcgtttggatcaacccatacatctcacaaaagtcaccactcttcaagattggtaaggaaaagggctacttcatcaagcacactgacggcagtgtttggcaatgggatttgtggcaacccggtaatgcggtggttgacttcacaaacccagaagcccgcgcttggtaccaaggcttgttgaagaacttgttggacatgggtgtggactgctttaagacggatttcggtgagcgaattccaatgcacgacgccgtcttctttaatggcggcaaccctgaaggtgagcacaactattacacgcatcgttacaacgaagcggtattcgaattgttgcaacaagaaaagggtgaagaggaagcggttgtctttgcgcgctctggtacggtcggcggtcaacaatacccagttcactggggtggtgacaacttgagccaattccactcaatggccgatagtctccgtggtgggttgagcttgatgtcatcaggttacacattctggagtcacgatattggtggttttgaagagaatgcgagtccatcaatctacaagcgctggacacaattcggcttgctttcaagtcactcacgttaccacggtaacatcgaataccgggtgccttggttgtttgacgaagaagcggttgatgtaacgcgtaagttcacacaattgaagttggatatgatgccatatatttacggccaagctaaggaatcagttgaagcggggattccgttgatgcgaccaatgtacttggagttccctgaagatcaaaacacggcaacgctggatcggcaatacatgcttggtagcgatgtattggtggcgccagttatgacagaagaaggggatgttgattactacttgccagctggtaagtgggagcacatcttggatggtcgcgtcgttgaggtaactgaaaacggtcgttggatgacagaaaattacgactttatgagtttgcctttgtggcggaaaatcggctaaactagacctatacttttatttcaaccagtcgggggcggttgagtaagattatggggagagaatgaatgaatcaggaagtcaaacagcacgaaatatttgctgttaactcagatgtcggagtccgcgtttttttatccgaagaaccgctgggctttaagccgctgcattggcatacgcatattgaaattgtattggttttaactggtgaagtgacgtttcgatatgaacagcatgatattacgttacatgaaaacgaatttgtggtaattggatcgggaattttgcatgccacgactaatttggcgaatcaagcacttgtgctgcaggtgcccatctactatctcaatcaatattgggaaaatagtgagctgttgcgatttgatttgtggcaacatcatagtttgcatgacgacacgtataatagaattgtcggcatgttacagcagatgacccagatttacatccaaaagcatgctggttatcgcctgcgctttggtagtgtgttgatgcaattgctttacgaattaatcatgaattatgccgttgaattgacgccgacggatttaactgaagatgaccgtttgaaggcagtactcatgtatattcataaacagtatcaaacaaaaatttcgttacgcgaagttgctgaacggtttcactacaatccagactatctcagtcgcatttttaagcgacgggtgggcgttacgtttgttagttacatttaccaggtccgtttggacgcgatttaccaagatgttctggggaccaatcagccgattaagacgatttttgcgcgacacggtgccaataacgttaaattagcaatgaggtgttttaaagaactgtatgggaaaacgcctaatcagctgcgtcatctgactgctgacggtggtatttctgataatcatgaataagtattgaaaagggcgtaagtgcttcggtttttagtcgaagcacttacgccctttttcatgtgctaaaaaatcattgtggttccggttaggcccgttcagcgtctagtgccgcatgcaaaatatttgcgccacgcatcatgccgtaatccatcatgttgatgtcgacaacagggtaatccttaccatagtcatcttcatagcgttggtgcatgtacttcacttgtggtgcaatcataattacaattggctgatcagtggcgatttgatcacgggcggcactatcagaaacgccaatcgtggtcacgtctagactttctgcttgagcggcttcattcatcttgttggctagcattgaaattgacatgccggctgcatctactaaaacaattcgctttgtcatgtgtattacccccaaagttgaaagtgccgatagtttagcttatttatagtaagcgctttcattaatatctatcataaccctatttttggaagatgcaatgaaatagggtcatgtctaaacggtaatgaaagcgcttttatgttaaactatcggtaggataacttgttgtcatgacaacttcaagggggattaataatgaaagatattttgccaggcatgaccgtgcatttaacagtgggcaacttcactaagggaacaattacggtgaatggtcacattctaaagtatcagagtgtttacgaattagcacttggcgatacggtatgcatgtttgatgcagacacagaaaatcagacggtacgtttgcgtaagattccggtgcacacgtattaatgtaaaagagcgacaaggctgccttgtcgctcttttacattatgtcctatctgaccaatatttcttctggtaggccttacgaggcatcatcatcatgtattcgcgtaaggggttcttcttatagaactgttggtgttcttcttcggcgtcgtagaaaggttttgcatcttcaatgcttgtcacaattgggtcagtaaaacggcctgatgtggctaatgcctgcttggaagcttcggccacttggcgttgttgctcatcggcaacaaaaataacgggccggtatgagtcaccacggtcggcaaattggcccatcgcatcagttgggtcggctagttgccagtagagatcaacaaggtcttggtacgacacttgttgatcatcaaaccaaactttgacggcttcggtgtggccggtttggtgagaggcaacttgttcatacgtaggatttgccacgaaaccaccggtatagccagaacgcaccttttcaataccggccatggtttcaaatggttcgaccatgcaccagaaacatcccccagcaaaggttgcagtttgtgttgtcatcattaatacctcccttttgtccttattctaccgcgctaaaattaaatgaaaagcaaatcttttcgaagatacaagtcagatacaaattttacttatgatagactggcggtaagtgatgaaaagtaggtgatgaatatgaaacgtacgttgctgatcgtggatgatagcgtccgcattaatcaattggtgaaaatgagtctgcaatctttgtatgatattcgtcaggcgtataccggtgaggaagcggtcgcaatgttagctgccgccaaaatcgatttagtgttactagatattaccttacctggaatgagcggttatgatgttttgccatatgtcatcgacgagcaggtgccggtcattttcttgacggcgaagaccgaggtcgatgatgttgtgcaaggcctacaattaggcgcggatgactacattacgaaaccgttccatttggaagtgttaaaggcacgagttgaaacagtattacgacgaacagatggtcaaaccgatgagattttgcattatggtgagttaacggttaatgtgccccagcaaaccgtgcaacgtgatggacaaactatcgacttgacccacaaggaattcgaactattggtttactttatccgtaaccaagggattaatttgacccgcgatgcgatttaccaagcgttgtgggatttcgcggatgacgcgaatgacacacgtacggtcgatttgcatgtgcaacgacttcgcaaaaagttacagctggccgatgatattgtcacggtatttaaagttgggtatcggatggtggcccgatgaaaatatcagttaaattatttttatcatttattgtgattatcgttgcctcattagcgattaacagtgtgttagtgttgcaccgtagctttcaaagtggcttgcaggagaaagaaactagtacgaccatgttgaacaaattaacggcgcgccaggttcaacaactagactatcagcaagttaaaggaatcaagccggatcaagtggtcaagtttgtcggtgctacacaagataatgttttgatttggaaccagcaccgtgacctaatttatcatgaagatgttgcgaccaatacggctaagcagatcaaggtcacaacgtcgaataaacagcaagtacagtacttgttacaaggtaaagaaaaaatcgttgtggcgacgattaaggtccgcttattacgtaagacctattacattagttcgtttactaacttgcatacggtttatgtggctcagaagcgcttgctacatgatgttcaggtcaatctactcgtgatttttattattgcagccggtgtggtttatgtgttgacgaaacaaattctggtaccggtgcataagttacgtggcgcaagtcgggcctttcaggcagaaccaatggcgtaccagccactacagccagtgcggcatgatgagctaactgagttgatgattgatttcaatcaaatggcccaccaaattcaggcaatggtggctacggaacggcataatgcagcctttcaaaaagaatttgccagccatttgacgcatgaaattaatacaccgttgacgattattttagggtatgccgaattgattgcggcaccaacggttgatgaaacaaccaaagctgaagcaatacgctatatcgttgaggaaagcacccggttaaaggagcttggtagtcgaattagccagcttattcaatatgaccacgtgacgttggatacggcttgggtgtcgagcgatgaagtgcacgccaaggtgacagatatagttatcggcatccggcaacaagccacacaaccgatggattttcgctacgagacgccacaaacgtatcaactgaacaccgatatgagtttatttgccgaactgctcgtgaacgtgttagataatgctatcaaggcgttaccggatactggtgggcgcattgttgtcagtgagtcgctgacttcggcaggattagagatacgaattcaggataatgggcacgggattgcaaccgacaaattgggcgacgtgtttgccccatttgtcacggggagtcaaacgggaactgatgatcatcttgggttgggattatccattgtacagcgcataattgaagccctgaattggcaaattacgttacaaaataacagtgaaggagcaggcgcaatggtcatcattcagataccgcaagcggccattaaatcatgaagcaaaagcagaatttattagtgatcatcctgtcgatgttgatatttgctggtgtggttgggggactgcaatggtttgtggcctggcaggacacccactatacgaaacggttatcacatgaagttgattacacgttgccaaatgcaaaaaatagtaagctgaccaatgcccaaacattagcagttattttagattatccgagtgccatcaaattcaaaagcgatgtgcttgaagccggtggccttaatgttgagagtatcgcacagcaagtgacgggtgtgacactaccgacggttaaagtgaaatccgttgagaagcgggtctatcattctgaaaatggtcaggtggtaacggcctttgccgtcacagcaaccgatgaggataatgatattgagtttgaatatgtaccaaataatcagttgattgttagttttcaatggattggccagcacgttgcaattgatgagcaacaggttttacaaaattggcaacgaaatattaagctcccagttaagcatacggcttacttagcagatggtgaaattagccagatgtatagtaaagcgattgattatcgtttaacacattcgcaatcaaacctattactaatgccggtttagttaggggtgatacaagttagatacaactgttcgttatgctaactcctgaaaaagaattaaggagcaaatcatgacagagcagaagcaagaatcacgaacgacccgccaacgcaaaccacgctggggtcgcatcattgggattaccgccttggtcggcttggtggtcgttggtggtggcgcggccgcgatgacatggcgtgccaagaccgtggtggatcagacgtatgcaggcacgcatatgaaaaaagcccgggatgtatcggaaactgtcaaagccggtaaaccaatttcaattttgatgttgggtacagatacaggtgaacttggtcgtaatgataaaggccgaacggattcgatgatgattgtcacagttaatccagttaagtctgagacgacgattatgtcgattccgcgtgatgcgttgatggccattccaggctatgaatcaacgttcccacaaaagattaatgcggcgtatgaattggggtcagccaaaacggcgattgaaaccgtgcaaaattggctgaatgtgccgattgattattacgctttagtcaatatgggtggccttgaaaaggtggtcgatgaaattggtggggtgaaagtgaaatcaccactgacctttggttataatccatacacggcccacgataccccagggtatacgttcaactttacggcgggtacgacgaactattccttcagcggtcaagatggcgaaactgttaagtaccacacgatggacggtaagacggcgttggccttttcacggatgcgttatgacgatccgcagggtgactacggacgccaacaacgtcaacgcatggtcttagaagcggttgtgcaaaaggcaaaaaagaatccagctcgcttgctcacgaatggctttatgaattccttgtcaaaatcggttaaaactgatttgacctttggcgatatgacgacaattgggacacattacctttcagcgacgaaaacaattaagtcagactatatccgaggtactgggtataacttgacctctggttcaacagaagttgtttcacgtgctgaagaacaacgggcaacaaatgtgctgcgtcgttctttaggcttgcagcataaagaaactggtaacttgtatgggggtgacatctcagatgctgagattgcggccattggcgtgccaacattagcgacacagacgcaaaactagccctttatttcccgcttgcgaactaacttaccgtataatgcgaatataagttagtgaaaagaggctataaccatgggaattaccattcaaattgacgatgctgcagtgacgaagattgcgggcgctatccggacgaacattccacgtgttgcacggaccaatgaagcaatgattttggcgaaccctgaattgtcagaacgcttgccaaagttggcagcgttggctgatgatgaattggttcgtggttacttgcaggtctttctgatgtcagctaacgacacaaatttgttgttggataaggcgtggattgaccaattcttgacgatgcaattggcaacggttgttggctaaaaaatgattaaaatagctcgcattaaggtcaaaattcattggcgttaatgcgagttttttatatgatgcacatttagtacggaaaaacagttacaatgaaataactatagattagaaaagagattaggcatgattacattaaaatcacctcgtgaaatcgaaggcatgcgccagtctggtgcgattattgctggtatgcaccaagggctacgcgatattattaagcctggcatttcaacttgggaaattgaaactttcagccgtgattatattgaaagtcacggtggacgcgcggcacagattggctttgaaggctatgaatatgccacgactgtgtcggttaacaatgaagtcgctcacgcatttccccgtaagcaattattcttaaaagaaggcgacattgtcacagttgatacggtcgttgatttgaacggttattattcagattcagcttggacgtatgcagttggtgaagtgtcgccggaagtgcaacgactgatggacgttgccaagcgtgctatgtacattggtattgaacaagcgcaagttggtaaccgtttgggggatgttggggctgcgattaatgcgtatgtcgaagatgaaaatggtttcgggaatgtccgtgactatgttggccacggtattcaacccacgatgcacgaagatccaagtgtgttccactacggtgaagctggccacggtttgcgcttgaagccgggcatgaccatcaccattgaaccaatggttaacatggggacgtgggaagttgaaacgtctgaagaagacggctggacagtgaccacgttggacggttcatggtcagctcagtacgaacacgtgattgccattacggaagacggtcctaagattttgaccagtcaagatcctgaatttgatgcaaaatatctttaaaaaattaacggcatttcctaagtggaaatgccgtttttcttatgcctaaaaataggttgtgttggcgttaaaaatcagatagagtagttcgcagaagtgttaatgcatgcgtttggaaataagaagcgcgataatctaactaattggtttgaccgagcgaagatgcctgtttcaggattgggggtttccatgaaaatagacaaaaagcgacttaaaaagagaatcaacgatcaagatgagccgaagaataaaggcaagttgcatgatgacttgcaagaactacatcattttattttggcggtgcagaaaaaagataatgtcctgacgccaagttttctatcgcgggttaatttgcgattaccacaaattatgtatcgtttagaaaaggtggtacatccgcatttatcaccagagcaagccgtgccgcttcatgactacgaattcgttttgggtgaaacgcgtcagttgctataccaaaccgatcaaggcgtgctacttgatgtgacagaattcgaagacgtgacgaacaagttgttgtggcaacggctgtcaggggatgaatattcggcagccttagccacaccatgggtggcgcctgaagatgaaacaccaaccgttgatgcaacgacggaattaacgatgaccttagaacgcgcgaataaaacgttgaaacgccaagcggttgaggcgatggagcgggctttgaaggcggaagacgacttgcgccggttacaacgcgagtgtgatgcaaaagaaaaagcgataacggaccaaaaatatcagctacaagcttccgaacaagaacaagggaatacggtggaacaattgctcagtttgcgccatcaaaatcagacacaggcgactgagttaacgacattgcgccaaacgttgcgtgaggcacagacgacggttcggtcgcaacaagattccctgaccacgagtgagcagacggaggtgcaactgacagatgaaatcgcgatgctgaaggccacagtgcaagcgcaacaagaccagctacatcaggcccagcaagccacagtcgccccactttctgatcataacgtgcaaacgattttaaatgccttagctacccggattacggagttagaacaggctaaagtggcggcgcgcccggaagttggtgaaggggcaccggctttggctgaaacagaaccagttgagattgcggcacaaccggcgcctctaacgaacgctgaattgctgcgtcagttaattgcaaatttaacggccgattcattggcggaataccatcctattgaacggcttgtgcaaaaatataacgatctggttgagggggatgagctgacattatggacgacgttacagggccattttgttactgaagatgatgatcggtattttgtggataacagtttcgcttatcatgaactctcagacgttgattgcaatggccttgacgtgactgatattgcagatggggagctatactctgcacggcaacgcatcgatagtgaccgaattgtcttgattcgatcactccataaacaatatgagcgaccagccagtgtttataatgatgctgatttgcagcgttttgaagatgcgactgtcttggcgggaaagaacgtgcttattgtcagttggtggggtgagacagccaatcacgcgaaacgtaaactggagaagatgggggcaaatgtgaagtggctcgacacgtcaaccgttgccaacaataaagtggctgatgaaatgcggaaagagttgtacgatgtcaggattgtcgtgttacgaggtgcccatcatgagaccgtcaacgaagcccatcagttgcgacgcgaggggatgaacatctttattttagggaacccaggcacgagtacactggtgaaagttacactgcatgccacggcatcataaacgattagaaaatttctaacttgctaattttatgtaaaaaccgtaaactagttggagtattaaaaagtaaataaattcgactttcctatcgagagttcagggagggactagaccctttgatctgacgccaacttacccgtttcgggcgatgtggtactttctagcagataggcgcatatcgattcaacccgacatgccgcctacgagtggtatgtcgggtttttagtttttgagagatattaagtttaggagattttttacacatgacagaaaagcgtttgtttacgtcagaatcagtttcagaaggccaccccgataaggtttcagaccaaatctcagatgccatcttggacgctgttttggcacaagacccacaagcccgtaccgccgttgaaacatcagtgacaacgggttacgtgaacatctttggtgagatgtcaacgaaggcctatgtaaacatcaacgatattgtacgccaaacattgaagcgtattggttacgatgataaggatgctggtttcttggctgatgatatccacgttgggattacgttggatgagcaatcaccagatattgcccaaggtgttgattcagcaattgagcaacgtgaagacggtggggttgatccattggaccaaattggtgccggtgatcaaggtttgatgtttggttttgcaacgaacgaaaccgatgagtacttgccattgtcagttgttttgtcacacaagttggtgaagaagcaagctgaagttcgtcgtaacggtgagttgtcatacttgttgcctgatgccaaggcgcaagtgacagttgaattggacgaaaacgacaagccaacgcgtatcgacgccgttgttttgtcaacgcaacaccgtgattcagtgacattggatcaattgcgtgctgacgtgcgtaagttcatccttgaccctgtgttgccagccgacatggtcgatgacgatacacgctactacatcaacccaactggtcgtttcgttatcggtggacctaagggtgatgctggtatgacgggtcgtaagattattgttgacacgtacggcggatacgcacgtcacggtggtggtgccttctcaggtaaggatgctactaaggttgatcgcagtgctgcctacgcaacacgtcacattgctaagaacatcgttgcagctggtttggccgaaaaggttgaaatccaagttgcctacgctatcggtgtggcaaagccggtttcagttaacgtcaacacgttcggtacgggtaaggtttctgatgacgaattggtagccgcaatccgtgacttgttcgagttgcgtccagccggaatcatcgaggacttggacttgcgcaagcctcgctacgaagcaactgccgcatacggtcacttcggtcgtcctgaattggacttgccatgggagcgtttggacaaggttgacgagttgaaggcatactttaacaagtaatagaaattatagaagcgtcgtgagtctttggatttacgatgcttcttttttaccccagtttgaaccgcaacacccagaaaacacgggatatcttgctataatagcttcaataaaaaacgaacgaggcaaagaattatgaaacgactttgggagttaacatgggggcgattttggcaatcgcggtgggcgtttagtcgcgtctacctagccgttaccatcgtcattacggcattggcgattccagtgttgaaggggctggtttacgtcgggcagtggctggataatgtgccatttttatcactgtcgaattttaagcagatgcttttacaaaatccggccttcacggtgattttgattatggcgattgtggcgctgttagcagtgttcgcctggcaggcggtgagttatgtgcttggcttttcagcgattcatgcggggcaaaagccgaccgcactgagtgccatgaaacaagctggctaccagatccgacggatgggattcggtcgtagtgcattaattgtggcgtatgggttgttagcactgccgtttccgatgctgacctttcattcggcgttattgacggatgtgaaaattccagaatttgtctggccaacgattatggcgactacctggatgtggggaacgctggcaatattgtttgtgggcgcattgtttttggcgattcggttcttctatgtgttgccggaactggttctgcatcagcaatcggccaaaaccgcgttacgtaatagctggcaaaaaacggctggccgggccggtttgcgtttggtgttcaagttattctttggatcgctactaattggtgcgatgacgttacttgcatttggggtgacgtacttgttgcaactcggtatcgatcaactgggtaaccttgatgcgagtgcgctaggcgcggtgctgacgttcattttggcaacactgagtgacatcttattcagtattgtgggtctacaatttgtattcggcctgatgacgcgtgattatcaggtagtagcgttaactgattttgtcagcaagtcaaagcgttcaaaacgttgggttgggacttttttgattttgaatttgattgtgcaaggtgcgacgccatcgttttggtttgtggtcaacacggctaatcggcatatgaaaatcatttcgcaccgtggtgttgacggcggaaatggagtgcaaaacacgattccggcattacaagatacagtggcgaaggcgcatccagactatgttgaaatggatattcggcaaactaaggatggcaaatgggtcttgatgcacgatccaaccttaacgaccttaacaaaaggggcgtcaaacaagtcaatttcggacttaacgctacaacaagccacggcgttgacggtttatgagaatggccatacagctaaaattccgagttttgcggcttatgcaaaggcggctgagcgggcgcatgtgaagttgctcgtcgaaattaagactgagcgacaaacagcaccagatttggcagattcatttttgaaacaatttaaaacggtgatggatcaaaatggttgggaaatgcatagtttgaattattcagttgtgcaacgtctcaaaaagttggaccctaagttgccggttggtatgattttaccgggtgattttgtgggcaatccagttacgagtgcagacttttacacaatggagtattcgtttttaacacgtgagcaggttgaaagtttgaatgaactgcggaagggtgtctatgcctggactgttaacgatgagacggggatggttgcggcatattcacaaggtgtacagggcgaaattacagatgatgccacgacattgcatgcggtgatgcaggattcagacaaagcccgcttgatgcatcagaaattagggcgatacattgttaatatcctggcagaatagtaggagggcatgagatgttaatcattattattgtgatcattgcagttcttgtaatgattgctagttttgcgtctgattcaaatgatagcggaccaacccaagaagatttggaacgctgggatgaagaacggcggacaatcaagcgccatgagcggcatcgttggtgataatagataaagagccatgtttctgcgaagcatggctctttgttttttataaagttaactttataaaaaacgaaaaatcgcaaaaatataaagttaactttatatcgatcagcattagaaagctgacaaatttgtcgaaatcaaaaatttaaaaaacggcggtgtacagattttttgtaaggaattttctatactaaaaggaatgactagtttacaaatagttatttggagaaagaataggaagagaaaatggcattacggggcaaagaatttttatggggtgcatcaattgcaaactatcaaacggatggcgcagaaaatacgcagtggcatgagtgggagcttgcgaatgctgaccgcttagcaagtgactatgatatggcattcaaggatgtcccaacggttgatgatttccgtgcagctgggaacgatccgcaaaattacattagcggtatggggattcatcatcgggagcgttatgatagcgattttgataaactacaagcactaaacttcaacgcttttcgattcagcgtggaatgggcccgcgttgaaccggaagaaggggtttatgatgaaagcgaaattgcatttttaaaggattatattgcctcaatcaagtcacacgggatgataccggtcttgacgttatggcattggacgatgccgttgtggttcactgaaaaaggtgcctttgaaaagcgtgaaaatgagcgatactttgaagagttcgcggcatacgtcttgcagaaattgcaagatgacattgacattgtcttaacgtttaacgagtggaacgtctatacatttgctggctatatagcaggtgaatgggcgccaatgcagacgtcatttttgacagcatttaaggtggctttgcacttaacggaaacgcacaaccgcgtctacgatattgccaaaatgattaagccagcattcaaagtgtcggtggctcacaatacggctgattttatcgcgttaaaccgaaaggtaacaacgaaacttggtttggcttggaatcgttggcaacgtgacaactttttcttagatcggacatatcaaaaaatggatttcttagggctgaattggtataacgccgatagttatgatggctttacagttaaaaatcctaacgaaaaggtcaacgacatgggatgggatatgcgaccaattcgcattgaaaagaccttggttcgcttgtacaatcgttaccagttgccaattttaattacggaaaatggtttagctgatggtgacgattcagatcgtgaatggtggctttcggagaccctgcaagcgctggaaaatgctgaaaatgccggtgttgatttaatgggctatctgcattggtcggcgtttgataactttgaatgggataaggggtattggccgcgatttggcctaattgcagttgattacgaaaacgattatgcgcgtgacattcgaccatcagcacagtactatgcaacgcgaattttagagtatcgaggtatgtagagagaatgaatgagcaaccaatctcgcgacaatttttcttaatgtatgccttggcgtttgttggcgtgtggatggcatttatcgcaccgacaatgtcaggattacagattcgaatcggacaaattgatccggcacataaagcgagtggcttagcgctcgtgttgggggttggggctttattagctttggttagtaatccaatttggggacaattatcagatcggcatatgggccgttggggacgccgtaaaccattcatgttctttggtgggttagcaggaacggtggcattgtttgtgctgccccttatgcagaccgttgtgggcgttgtgattgcttggagtgtggtccagttagtgtttaatgcagcaattgcagcgttacatgccatcacatcggatatgtttccagagtcagaacgtggcaaggccagcgtggcagttggtgtcggtggtggggttggcacggtgttgggtattggtcttagcgcagccctggttaaaacaccaattttaatgtttggtgtgccagcactgctgggctttattatcttactgatctttttagtgtggtatcaggatgcaccgctgcaggaagcgccagtcagagccggtgtactaaaaacagtgcttgatagttacagctttaattggcgacaaacgccggattttggcaagctgttaacgggaaatttcttcattttaattggtttgaacattattacgacctatcaagtgtatgtgatgtccgatcgattagggtggtcagatgctaaagtggctagcatgattacagtgatttacctgatatcaggagcctcatcgatggtagcaaattacatcgcgggatggttgtcagataaatatgcccgatatcgcggttggattgttggcagcgccctattgttagcagggacggccacgatgtttggctttcgaccggacttactaattttggcggctgtcttggccggcttagcacaaggcgctgaaaataatgtggcctatgctgcgttatcattaacgatgccagaccaggaaaatggtggtaaatggttgggtatcggtaatatgtcgatggtcttaccacaatcaatcgcgccggctgtggcgccaattttgttggcaattggtaatcaatcagttaattatgtgtcgctgtatttgggcgccgcaatcattgcggttattggcgctggtgtcatcatgaccatcaaaaaattacaataaaaatgaagaccttttaatttgacctgttgattttttgtgctacgtcgtatagacttatattttgtaagtgaaatgtagcacacagacagttaggagatttattcatgacaaagtacggtgtaattgttggatcaattcgtaagaactcatactcacttggtgtggctgaggcccttgttgctggtttgccagccgatgcagaagtaacgtacttcgacatcgcaagcttgcctttgtacaaccaagacttggatgcaaactctcctaaggaatatgaagacttccgcaagttggttgctgaacaagacgcattcattatcgtaacgcctgagcacaaccgttcagtgcctgctgcattgaagaacgctttggacattgcttcacgtccatggggacaaaatgtatgggctggtaagccagttttgcctgcatcacaatcaatcgccggtcttggtggtgttgtggcgcaccacgtgttgcgtaacacgttggacttcttggacatggttgttatgcaccaaccagaactttacattggtaacacaatggacttggctgacgaaggtggcaagatcactaacgaaggtacaaagaagttcttggctgaatcagctgctaagtacaacgacttcgttttgaaggttcttggctaaaatatagactaatgaaatgacgactcgcaaatcagctggtcgtcattttttgtttgacctgataattagccataagggcctaattgctgttatgattattaacaataattaagtacagtttggaatggtgatacatgttattaaatgaaatgtttgatgattatggtgagttgattttatcaccgactgattttgtgagccttgaagtgtatcacgaactcattgatttaatcaccgctaaggatgctgaaggggccacgacgcttttgcaggatatgcgcgctgttaatatattctcaacccgcacggtggggatgttatttgaagatgctgctaagaaatttgatgtgacaattaaccaagttgatgggttaattattatgacgttgggtactttggtagcgccgtttgtttctgaacgggcaatgcaaaatgccggcctagagtggtcggtggctgacggtgaagcacgtattacggtaacattggatgatttagttgcccaacaagtaagtgtctatacaatttttgctgaattagctgatccggtgacccgccctaagaaattactgccaaagtttttcaaggcagttgttgatgaagtgccaattagttaccaggctgcattggtcgatttacaggaaatgaaatttgagttgattgggcagttgccagcagaacggcagacaacggtcacatcacaaccagacgaaattgattatcgtgaggacgcacggccatttaaatttgttgattatgatcacatgattgactattcgttcctactcaatgatgcgggccaacgggtggctttgtaccggttagatagtggcgaatttgtggcgatggtcccaactcaggatgagaccgcgcgagcattagcagttgaatataaggggcaaatgatgccggttgcggcagcgtatgttgaagaacacggacgtcgcattaactaacaaaaagcagatctttcgatgacgaaaggtctgcttttttgttaaccatgttacttaaaaacgttgctatacaggcgtttccgaccgattgttttgttgcaaaacgaaaaattatcagatatgatgaaattatgttgtgaaagtaatcaatgggggacacgtcatgaatcaagggattttattaccagaatcaacggtacaatttgtcacgaaacaagaatttgaatcattcaagcaacgagaatttacgaagctacaacaggatgtaacagaactacaacgtgatgtgcatgatgttcagaaggacctgcacgatgttaaagatgatgtcgcagccatacagacgaaaatgaacggttttggtgaagatatggcagtactgcgctccgataaccgtgcgattaaatggttacttggccttggtgttgtactgcctggtttgacgtttactgttcggcagcttgtcgaaatggtaacgtactaaggctaaccgactacgtgatgaatattccaccgtgcattcaggtataatggatagtggaaattaatttgagaatcacgagataaaaaatatgagcaatacagttattccggtaaagctcggcgaacagtacgaaggcactgttgtcgacgtgctttacacgggggttggggtcatcatggtggatgattacccaatccatttggagaacgcctttgaaggcgagaaaattcgatttgaagtgacacaagtcaaccgtaaatttggacgtgccaaggtcgttgaaattgaagttgcctcaccagatcgtgtcgattcaggcaaagattacttgcttgaagcgggcattgcaccctatgttaacttggcttatgatgcccaactacgtttgaagcaacaacaagtgcagaagttgtacaaggcggttggcattgatgttgacgtagcgcccacaattgggatggataaccccacacactaccgtaataagacggttgtgccagtgaagtacgttgatgggaaattaacgaccggtttcattaaaaaacgtacaccgggcgatattgtgccattggatgattactttgttaatgacgaaaaaattgatcaaatcattggcattgtcagggatattcttgatgcgcacaaagtatcagtctttgatgacgacacacaagaaggtgaaatgcgatacatcatggttcgccgtggctactatagtcacgaggtgatggtggtgctagtcacgcaaacgccaactttgaccgatgaagacgcaattgctactgatatcgctgccgcagtggcaggtattaagagcattattttaaaccacaatccgcgtagtttacacgtgttgacttcaggtgataatcgcacattgtggggggcagatgccatccacgataagttgctggacattgattttgaaatcgggccaaactctttctaccaggttaacccacagacgactgaagtgttgtatgacatggcagccacaaagggtgagttgaaagaatcggatacggttatcgacgcatactcaggtattggtaccattggattaacagtggccgaccgtgtcgacaaagttttaggtgtggaagttatcgaacgtgccgttattgacgcgcaaaagaatgtcgcaaacaacaacgtgcaaaatgcagagtttgtgacagcagacgcacccgagcaaatgcaaaagtggaaagatggcggtcttaagccggatgtcatcttcgttgatccgcctcgtcgcggcttgacggaagaattacttgatgcggtggctgatatgaaccccgaccggtttgtttacgtctcatgcaaccccgagacgatggcgcgtgatgcccgttatctaattgataagggcttccgtattaagggtgatatccaaccgttggaccagttcccacaaactgcgcacgttgaagcggtggcagtgtttgaaccaattgaaaagtaaaaaataacgcctagatgcaatgatctaggcgttattttttaacgacgttgaacaagcaaagcagtttcgccagtcaaaatgtcttcgtacttgtggacgttgtaagaatcggttggtaattgtgccacatattcttgtgccgcaactaagttagctgggttatctgatagcaacaaaaccaaaccgttcgtcttcaacaccatcaacagcatcttaacggtgttcgttagggttgtggcatccatagtttcatcgacttgaaacaatgcagccgcaacgggcgttgttggttccaggtagttcgtaatggcagaaaaatccttgctgataagttcaacgcgattgtgcaaaccactcaaaaatagtgaggttgcgacgtcatcaatttcagctttgacatctgaaaaggccaataccttaccggtgtcgccaacacggctagccaagaaacgcgtgatatcaccgtgacgaatggtggcgtcaattgccaaatcgccggggactaagtattcgttaagcgtgatttgcgctaggttctgggttgatcgcatgttcgaaaacctctcgtgttcgatatttaaaaataagttccttagacataatcaaaaagaaaacgcctaaactaaagccggccaagacgtcggacaagtagtgcacgcctaggtagacacggctaatggggatagcgaaaaccaacgcgccaaagagtgtcatgaaggcgtagcgcaattggtcctgcttctttagatagtagtgaactaaaactatcaatgaaccatatagtaacacagcatttagtgcatgcccggatgggaaggaatagccaccttgtgcaatgacatgataaatgtcaggacggggacgatgaaagatatgtttcattaacatcattacgccaagaccaaagacaccgacattgacgaccataaagacagcaacgtcaattttacggattagcaaggcaataatggcggtgatggccatgaccaaggcggtccattttgtattaccaccacgggtgatgttacggaaaaaccaagaccgttcaggggttaggggttcacgaatgtgtttgaacccaaattggtcaatccaatcgatatagcccaggtggtgtgtataaccaaacgctaaaaagataaacatcagcaaacccgcaattgcgacaccaagttgcaggtagtcgaatttacgcatttgggacatatgcgacagctcctttcacattaaaaatttcataaactcagtctatcacaaaatgacgtctcaattcggctgaatgttcgagtggttaaccccgcttgttcattgaaataaggcggtttttttgttaaagttagaacattaaagtgaggttatcgataatggcatatcaacacaaagaagtagaaaagaagtggcaacgcttctgggaagagaatcagacctttaagacgtcatcagaccactcaaaggaaaagttctttgcaatggacatgttcccattcccatcaggacagggactgcacgttggacacccagagggttacacggcaactgatatcgtttcacgtatgaagcgtatgcaagggtttaacgttttgcacccaatgggattcgatgcgttcggtttgcctactgaagagtacgcaattaagacaggtgaggatccacgtgttgtgacggcaaagaacgttaagaacttccgccgccaaatgaagacgcttgggttgtcatatgactggtcacgtgaggttaacacgacggaccctaagtactacaagtggacgcaatggatattcgaacaattgtacaagaagggtttggcctacgaagatgaaatcatggttaactgggcccctgattacaatggtggtacggttgttgccaatgaagaaatcattgatggtaagacggagcgtggtggcttcccagtttaccgtgtcccaatgcgtcaatgggcattgaagattacggcttacgctgaccgtttgttggaagatttggatgatgtggattggccagatgccatcaaggaacaacaacgtaactggattggtcgttcaatcggagcgtctgttaacttcaaggtgaaggattcagatgccgaagttgaagtctttacaacgcgtgctgacacgttgtttggtgcgacataccttgtgttgtcaccagaacatgcgttggtatcagaaattgtttctgacgaccaaaaggaagctatcgaagccttcaagaagtcaattgcttcaaagtcagatttggagcgtacagacttgaacaaggataaggctggtgtcttcactggtgcatacgccattaacccaatgaacggcgaagaattgccgatctggattggtgactatgtcttggcgtcatacggaacgggtgctattatggcagttcctgcgcacgatacgcgtgactacgagtttacgaagaagtacgacttgccaatgcgccaagtattggctgggggcgatattgctgacgaagcctacacaggtgacggtgagcacatcaactcaggtttcttggacggcatgggtaagcaagaagctatcgacaaggcgattgcttggttggaagaacaaggtgttggtcacaagcaagttaactaccgcttgcgtgactggatcttctcacgtcaacgttactggggtgagccaattcctgtcatccactgggaagatggcgaaaagacgcttgtaccagaggaccaattgccattgcgtttgccagaagttgataacatcatgccttcaggtactggtgagtcaccattggttaacgttgacgactgggtaaatgtggttgacgaaaacggccgtaagggtaagcgcgagacgaacacgatgccacaatgggctggttcatcatggtactacttgcgttacatggatccacacaatgataaggaaattgtttcaccagacgctgaggcttactggcagaatgttgacttgtacattggtggtgctgagcacgccgtgttgcacttgttgtacgcccgcttctggcacaaggtgttgtacgacttgggtgttgtgcacactaaggagccattccaaaagttggctaaccaaggtatgattttgggtgaaaaccacgagaagatgtcgaagtcaaagggcaacgttgtgaaccctgatgacgtcgttgaacaatacggtgctgacaccttgcgtttgtacgaaatgttcatgggacctttggaacaatcaattgcttggtctgaagacggcttggctggttcacgtcgttggttggatcgtgtttggcgtttgttcattgatgatgatgacaagttgcgtgatcacattacaacggttaacgaccacaagttggacaagatttacaacgagacggtcaagaaggtaacggatgactatgaaggtcttcgtttcaacacggccatttcacaaatgatgattttcatcaacgaagcttacaaggctgaaaacttgccagttgaatatgttgaaggcttcatcaagttgttgaacccaattgcgccacacatgacggaagaattgtggagctacttgcacaaggatgaatctgttacgtacgctgcttggccaacgtttgatgaatctgctttggttgaagatgaaattgaaatcgtcttgcaagttaacggtaaggtacgtggtcgtttgacgatcccagccgatgctgatcgtgacaagatgacagaactagcgcttgctgatgaagcagtgcaaaagcaactcgatggtggccaacctaagaaggtaatcgcggtccctggtaagttggttaacgtcgttttgtaaaaaataacatgtcaggtttcaggacatgacatgatactttttattcagaagtgactatacttaggaggaacactcaaattgtgggtgttcctctttttttatgcctttggtagaggggagggtgcagtatgaagcgtgtactcatggcgatagaaaatttgggacttggcggcatgaaacgagctgcgacagtggttggtaatgcgatgacggcatttgcggatgtacagtactatcaactggcagacgtgccttcttattatgagttacaaggccatttagtcccggccaagcatccagtgatgcccgaaaatggggccgcgccattaacccgttatgcggtgcaaatggccgatttgggggatgttttaataactgaaaaaattgatgtgttaattgtaaatgcggggattttgacaagctttattccgtatcttaagacgcgggcgccgcatgtgcagatgattgcttggatgcataataatattgatacgtactttaatcagtattatcgagagatgcaacctgaatttgtagccggtgttaaggcggctgatgcggtcgttgctttaacagaatcagatttagctggctttcaaacagtcactgatcgggcgattaaaatttggaatccggttacgatgcccattgtgggccaggctgatgtgacgagccacaaaattgcgttcacgggtcgcattgccatccaacataaaggcattgatatcatgttagccgtcgcgcaatacttgcctgacgattggcagattgtcattgctggtgatggtacgccgacggatgtcgcagagttcaagcggttgattcatgctaatcatgctgaaaataaagtcgtgtatcgtggcgcgctccatgatgaggcgttggccgagcattatcggcaggcatctatctttttggcaacatcacgatgggaaggactaccgctggttttggttgaggcaatgagctttggtttgccaattgtatcgacggataacaccggggcagttgaaattcttgaaggtggtgtatacggtgagttagccacgaaggacgcaacagccatctggcaccgattggaaccactgctacacagtacggaaatgcgacgtgtgctgtcctcaaagtcattagcccgtgccaaagactttgcgaccggaccgattatggcgaaatggcaacaattaattgaatagaaaatcatgcccgttgtttcggatttactttgactctacaaacaacgggttttcttgtgtataatagtaacttaggtaagttttggcgctatagttcaacaggatagaacaaggacctcctaagtcttagatcacagttcgagtctgtgtagcgtcattgaaagtagtatcgattatagtagtgactactgtgacaaacgaaaggggacggtcaagaaatggctgacgataaatcatccaattacgaagaatcaccattccgtcgtgacatcacgtttgaggaattggcggctttattaaacggtgcaacagttgatgatatcttcgaagcccgtgatgagcagaaagaggcacaacatgattcagcctcggcgaagttagagccacgatcagtgaccgaagttgtaacccgaccggaaggcgtctcaacgttcaaagtacatgaggtacctgatacgttcgcccgtgaagcaagtgtgaagccagattcgattgaggaaacccatacggatgaggccgcagctgttcagccagtgacggctaaggcggtaaccccgtcggatattatgacggctgaaccagccaccgtagctgaagaggttgtaccagtgaagccaccagttacaaaaacggtgactcgtcctgaacctgcgtacacggcagaaagtgttcctgaagaatcgacgccagctatggctgatgaaattgaaaccgtaccagagctagaagccgacttcattgatgatgagaatgcggcatcacgtatgttacgtggctcggcatggatgaccatcggtagcttagcttcccgtgtattaggggccttgtacattatcccctgggttgcaatgattggaaatctgtatttcacatcagcgaactcgttgtttgcccaaggttatcaaatttatagtgtggccttgctaattgcaacggctggtctgccgaacgtcttggcacgcttggttgcggaatatggcgcatctcgccaatatggggcggtgaagcaagtcttccggcaggccttacaactgggagccatcctgggaatcgcatctggggcggtgctctacttcttagccggcgtgttgtcacaaggtgatccaaatgtgattccagtcattcgctcattggcggccgcggtggttattattccggcgctttcaatgttgcggggttacgtgcagggatttgagttcatgggcttgtcggctatgtcacagttcattgagcaacttgtacgtgtgatttacatgcttgctgcgacgtattggattatgatcggccaccatggtaattggattgatgcaacggtccagtcaacgtttgctgctttctggggtgcgttagctggaattgcaattctggtatacggcatttggcgtcgtcgtcaattctttgcaacacaacttgcaaatgcagtaccagcaccagacttcaatcctcgcgcagtgatgctccgcatggcgcgtcaatcagtgccagttatctttgctggctcagcaatttcactggtgcaagtgattgatcaatacacattcttccgcattatgaatcacttcacgtcagttgtgaaccatgcgcaacaagcgatgttttcacaatttgcgtttaattcaaacaagctaattatgttggttgtgtcattggcagtcggtatggccgaaacagctttgccaatgctagcacgtgcccatgaaattggggatcgcgacaacattaacaaccaaattcaatttgcgtttaagttgttggcgtttgtgatgattccggcctcacttggcatggcagctgtggcacgtccactttatattgtgttctataacacggctgatttaacgaatggtacgctggtgttgcaattcgctagcttcacggcaatcttgctgggcgcttacatggttgtgttggcgttataccaaggattgcatgatttgcgctataccgttaaagtgctgattttgatgctggttttgaagttcgctttacaagtgccattgaccatttggttgtatggtatgggaccgcttgtctcaacggccttggcctttattgtcggattagcgatgtcaattcgtcgtttgacgaagcgctttgatattagttgggcaccatttaattactcagtaatgattatcctattctggagtctggtgatgtacattgtggttgcaccggtcgttggcacgttaggttactttgtgtcagatgggaaaatcccacaacttatcttgttgattgttggtggtttggtcggtgccgtgatttacggtattgccatgctaaagacacatgttggtgaggaagtgcttggcgcacgggctacaagtttagctcataaattacatttgaaataacagaaaacgaactagcgattatcgttagttcgtttttatttgtgtttaatttaagttttacacaggtttctgtggatattattgtggataaaactgttagtttgtggataactttgtataaccggtggatagtgtttagtcttttcaacaggttacccacagtgccgaattattaagaggttcgcgtggtttttgttaatttacaggtagatagcgtataatttagagtattgaaattctagttaagggacataagtgagaagatatgacacgatcatttgaacaattgacggaggcccaatttgatgactttgcacaaggtcatcaggccggtagttacttgcaaactagtgctcaagcacgtttgctcgcacgccgtggctggcaaacggcattggtagggctggtagaagacgcaacggttgtggctgccgccgtactagcttggattccagtgcgcatgggtaatcttttccaaatcgatggtgggatgctaattgattacagcaatcaggcgcttgtaaatgagtttgtggctggtgttgaaaagtttgccaagtcgcacaatggcttgttcttgcgtgtcgtgcccaatgaaatttaccgccgttatgatgatgagggggttcaaatcggcgcagctaacgaagcgccaatgacaaccttaactgctgcaggcttcaagcacacaccagcccctaaggggtggacaacgaacgcctcgccatcatggcaatatgtgaaggacctgacgccagtgctagcagctgacgatgccgacaaggcgttacgtcaatcttttgccaaggatggcaagtactaccttaagaagacggatcaatttggtatcaagttgcgtcgcttaggccgtgaagatttaacggacttcaaagcattgacgcaacacacagctgatcgtttggattatcacgataaagatttagagttctatcaaatcgtctttgatgaatttggtgatgatgcctactttgtcttcgcagaaatggattttccagcttacattgctggccaagaagcagcacgtgatcacttagctgaagttgtggcggatttggatgcccgcattgcggaaaagcctaattataagaagttgcaacgccaacgtgcggaatatgcggatcaacataagcaacacgaaaagcgcattgcccaagcgcaggtcgaacgtgagaaggccggccaagatgttgtggtcatcgcgggttcattattcttggcaaccgctaacgaaatgatttacctgtattcaggtacttacgacgagtacaagaatttctatgggccatatgctgtccaagagtatgcctttaagcaggcagttgcacgtcacattccacactataatttctatggtatctctggtgtgtttgatggatcagacggtgtacttggcttcaagcaaggctttgctggttttgctgaagagaaggtgggcactttcgttaagccaatcaatggccctaagtatgcgatttacagtttgttgaagaaattaatgggtcgttaagacacacaaaaaggcaccttcgtcggaaggtgccttttggcgtaatcggttactttcgaaagaaccccgaccgccataaaataacagtagtaatgctcatcagaattagagttaagataattgtgataatccaacccattggtgtgtgtgtgaagggcaatgagacgttttggccaaaaaaacctgacacaatgttagggaccgtcaatacgattgatgaaaccgtcagtaatttcatagtccaattcaaattagaatttgccaaattaacgaacgcatctgacacgctattggtcacgagctgtgatagttcaccagtatcaatggcttgttgtaattcgacggtaacgtcatcaatacgttcagcctgatggtcagttaattgcaccgttttgcgcgctttgtatgaacgcagtaaatcgcggtcagtatgtagcgaattaagtaaataaattaaatcggtttgcaaatccatcaattggtcgatagtcttttgggtttgcttggttttacggatctcactttgaattggcgtgcgccgacggttgatttccaaaattgccgacataaatttagaagacagtagctcggcgccgtttagaatgacgtctaatggcgttgcgtggtcgggtaatggtcggcgactcacttcggtaccactgagatagttatccacataatcagtttcgggacgcgtaaaggtgaacaaccgcttttggtcattgctaaagagcatgccaattggctcggttgtggcccgggttgaggttggcgtcaccacatcgaaaatgattaaggttaaatcagcatcttcgtcgtactccattcgggcgctttcgtaggggtcaacagcataactaagtaattcattgggaatgagctggtcggttgtgagccatgatcgctcttcgggtgtcatatcatgtacttgataccagatgaaatctggaaacgttgtcttttgtgtaatcatagtaactttagtatacgggcttagcatatgcttctcaacaatttgtgagagaaagtttgacggatttaggataaaggtttgacgcactttgtttttatcggtatactagtaaagttatcgataacataaatggaggaaatgatcatggctgttcaatcaccatataactcatgggctcgtaagcgaccaacatcacacgattctgcaaagaaggctcgtgtggctgaagttgttaacattcaacaatgggccaagggtaaggctgaattggagtcaaagtaatttgacgacatcagtagcttactgaaaaaccgcgttaaacgtagatatacgttaacgcggtttttattttgcctgtttaagcaatattacaaggcatccaagccctttgtcatgtcggcaatcaaatcatcgatatattcaatgccgactgaaatacgaactaattcatccttaatgccgttagctaaacgaatgtcgcgcggaattgatgcatgggtcatgatggctggcacttcaatcaaagattcaacaccaccaagtgactcagctaataagaagacatccaaattctcgacgaactgcttaacgtccagcccgggctgcagctcaattgacatcatgccaccgaacccgcgcatttgacgacgtgcaatttcgtagtctggtgtgccaggcaagccagggaaataaaccttggctaccttggggtgattgtttaagaattcggctaatgccatggcgttttcattatgacgctgtactcgcaaagccaatgttttaattgagcgttggaccaagtatgaatcttggggtgacaaaactgcaccaattgacatttgaataaacttaattcgttcagccaattcggcgtccttcacaatgacgaagccagataatacatcggcgtgaccacctagatactttgtgccggagtgaataacgacatcagcacctaggtctaaggggttttgattgtaaggcgaggcgaatgtattatccacgacagcaatggcgccagaatcgtgagcgatgcgggctgcttcggcgatatcggttacgtgcattaatggattcgatggtgattccaaataaaccatcttcgtcgttggcttaatcgcttcctgtaaagccacgctgtcagcggtatcaacggccgtaaacgtaatgcccaaatccgttaaaatccgattaactaagcggaaggtgccgccatatacatcgttggccatcacaatgtggtcgccggctttcaataaactcattgtggcatgaatcgctgccataccagatgaaaaggcaaacccatctgtgccgttttcgatggctgccatcactgattccaaagcgaatcgggtagggttttcaccacgtgtatactcgtattttgcatgaccaccaagtgtctgttggtgataagttgacgtctgatagattggcgttgttatagcacccgtgtagggatcttcttgtgccccaccgtgaatgacctttgtttcaaacttcatattcgagtcccctctttttctacaaaacaagccgacaaatttgttaaacttattgtaaatgtcagctgagatttcagcgagaaaaaggggcataaatacgccgttgtccagaatgctataattgtaatcacatataaagtagaaagagttaaatctgatgagttataaattccttgagccttttaagttggcgaacggtgttgaaattaaaaaccgtgttgtttttccaccaacaactttgcgatcatcatttgcgacggatgtcgtgaccgatgatgaggtgaattactacaagatgcgggctggtggcccaggcttagttattgtcgaaatggcctacgtatcgatggctggtaagacctatgttggccaaattggggcggatgtcgatgagaaaattccaggcctgaagaaaattgcggatgccattaaaaaccgtggctcagtccctgttttgcagctatcatttggtggtcgtatcgcccaaacggctgctgttttgcacgatgatgttatcggcccttcagatgtaccaggtcaccaaccaggcatggcaacgccacgaccaatgaccgatgccgaaattcgccagagtattgctgattttggtgaggcaacacgccgggcaattgcagctgggtttgctggtgtggaattgcatggggccaatatgtatgcgatgcaacagtttttctcagaacacgctaatcagcggacggacgagtggggcggtgatttagctgcacgtatgcgatacgggttggctgttttagatgcggttgttgctgcacgggccgcgtatgcggatgaccaatttattattgggtaccgtcaatcacctgaggaaccaacaacgccaggtatccgttttgatcagtctttggcaatggcccaagaaattatcaagcggccaatttcttatttccacatttcattgaaagatgctttccagacgccgtttatgaacaaggaagaccaagagccgttgtacgcgaagtataaggccattttgggtaacattccattgattgtggctggcttgttgcgcacgccagaacaggttgaagcacttgtacaagcaggtgtcgatggtgcggcgattgggcgtgagttgattgtcgatcctaactgggtacaaaaggtgactaatcaagacgaaaagggtattcggtacgctatttcaacaagtgattttgacatgttgggtattcctgaaccattgcgtttctggttattaacgcgtttcaagaagggacttgttgtctcaacagatgagcaatttgatccacaagtgccgtgggcatactatcgaggttaatgatggcagataaatatccaacagcagaattaattggcgttgtgatgacgcaaagcaacagtggtgcatttgagcctaaggagaatccactcacgccggctgattttcacagctggcgtattggcaagcacacgaagggaaaactcggtaagccaggtcaactatttttgacggaaaacaacctcactgtgatgttagttgaaaccaagaagctagcctttaaagatcggcacgacatcacaccgatgggtcggtttatgacgacaacagcttcagatgaagtagtgacgtccgtattggcacaatattaaataagcataaagaatgtcggacagtaagttgttcggcattttttattgcgcaaattcatttaccaatcaaggcgtattaacttagctgaattttgtatatgggataaacaatttcacaattaattcaccaacactttttattttgactttaaactaatgaggactaaacttatagtcaatcgagggatagagataaaactttggaggaaaataaaacatggcaactgcagattttggtgttgttggtttggccgttatgggtcgtaatttggctttgaatgttgagtcacgtggttacacggtggctgtttacaaccgttcaagcgctcgtactgaagatttggtacaaacgcactcagacaagaagtttgtaccaggttatactgtcgaggaattcgtgaagtcaattaaggccccacgtcgtatcttgttgatggttaaggctggtgccggaactgatgccgtcattgaagaattgctacctttcttggaaaagggtgacattttgattgatggtggaaacacgttcttcgaggatacaatgcgtcgttcagagaagttggcccaatcaggcatcaacttcatcggcatgggtgtatcaggtggtgaattgggtgccttgcaaggtccttcaatgatgcctggtggccaacgcgacgcttatgatttggttgagccaatcttgaaggaaattgctgcgaaggcacctgaagatggcaagccaacggttgcttacattggaccaaatggtgccggtcactacgtcaagatggtccacaacggtatcgaatatggcgatatgcaattgattgctgagtcatacgacttgttgaagcgtttgttgaagttggacaaggatgctttggcaggcacatttgctgagtggaacaagggtgagttggactcatacttgattgaaatcacggcggacattttgacacgtgatgatgatttgggttcaggaaagccaatggttgatatgattttggaccgtgctggtaacaagggaactggaaagtggtcatcacaatcagcccttgaagttggtgccccacaatcattgattacggaatcagtttacgcacgttacatttcagcaatgaaggacgaccgtgtggctgcttctaaggttttggccggtcctgagtttagttttgatggggatgttgacgcaacggttgaagacatccgcgaagcattgtactttggtaagatcatgtcatatgcacaaggtttcgaccaattgcgtatggcctcagatcactatgactgggatttgcaatacggtgagttagcccaattgtggcgtgctggtgcgattattcgtgctcgcttcttgcaacgtattacagatgcttacgacaatgaagctggtttgcacaacttgttgttggatccatacttcaaggatgttgccgagaagtatcaagcagcagctcgtcgtgtgattgctttggcaacggcggctggtgtaccagtaccatcattgtcagctgcggttgcttactttgactcataccgttctgaagtgttgcctgctaacttgattcaagcgcaacgtgattacttcggtgcgcacacttacgagcgtacggataagccagctggtgagatgtaccactactcatggtatgaagaagcttaatctcgttaatagttaatattaaaaacaattaatctcaaaaactaagggtaacgcgcttggtttttgagatttttttattgcttgtttaatttctgagaatatgataagattttaatcgttatgaaaatgcacactaaaaagaaggagaacgattatgtttatctttgcaaataacaataataataatgatcgttcaaactcaacacaattagtgattgggcgttttcgtgtaacgcttgaactgtaagaacgatttgcagtcatccaatcgctaggattgggtggctgctttttttatatcattgttatgtgggagttgtaggaattacgttatggaaaacaagattgaattgaaacgatcgatgggtatttggtcggggttagcgatggttatcggaaccgtgattggttcgggaatcttctttaagcaagcgggtgtcttgcaaacagcgggttcatcaacggctgggttgttagcttggattgttggtggtgtgattacgctggcggcaggactaacaattgccgaggttggtgcgcgcttgccaaagaccggtggcttgtacagttacattgaagagctttatggtcctgcggctggattcttagctggttggatgcaagtggttgtttatgcaccggccgttattgcttcaatcgcagggtatgccgcattcttgacggcgaacttcttgggcttgtcacaatcatcagccacttggatttcagttatcttcgtggtctttgtggctggcatcaacatgttggagaatcgggtaccggctgctttccaagtggcaacgacctcaattaagttggtgccaatcgcggtcttgattgtgtatggcttgttcttcggtaaggttgatgcattaggccaaacggttcaccaagtagccacgaccggcggtggttttggaatggccatcctggcaaccttgtttgcgtatgatggctggattttgctatcaaacatcgctggtgagttgaagaacccacgccgtgacttacctcgttcaatcgtgggcggtttgctaatcgttgttttggcctacgttggggtgacgtttggtgtgtaccatgctttgccatcagataagattgtggcgttgcaaaacaatgcgacgtttgcggtggttcgagctgcctttggtgactttggtgggcgtgcgttgagtttggctattatcatttcaatgttgggaacgttgaatggtaagatgttgtcattcccacgaatggcttacgcgatgtcattagatggcttgttcccaaagtatttgagcaagctaacacgtaagacgcaagagccagttaatgctattatcacggtgacactgatgacagtattgttggatatcttctataccaagggtgtggatcgtttgtcagatattgcgatctttacgatttggattttctataccgcagcattcttcggtgtcttcatcttgcgtcgccaagtgaagaagggacttttggctgaacaagatacgttgttcaagacgccattgttcccaatcacaccattagttgctatttttggtgccttgtttgtcttaggttcaacaattatcaacgactttgcaggggctgctttgtcaatcgtactagtcttgattggattaccagtcttctactactacaagaagaagcgcgcataaaacaggttataaaaaagcgaggacacatggttgtcctcgctttttggctttacaggggttggcaaactggtttaaaatttaaagtattaaaaaaccgtgagaaaagagaacgctatggaatggttcgaacgaacaaagccgtatgaggcggatttgattgccgacttaaatcaaattgtaaaaataccatcaatattagatccaaatacacagtcggatcggaccccatttggcgttgacatggcacgtgctttagcaaagatggaagaattggctgcgcgtgatggcttccgttatggtcgggttgataacatggtcacgtggattgagtacggaccggctgatgcagccgaaacggtcgctattttgacgcatattgatatcgtgcccgctggtgaaggctggttacgtgatccatttaagccagaaattttggatggcctctattttgggcgtggtgcagccgacatgaaggccgacctgatgagtgcgtattatgcgatgaagtatttagcagaccatgaaatcacactgacccgcaaaattcgtttaattattgggacggatgaggaaaatggttgtcgtgatttacctcgttacttcgaggtagaaggtgagccgacaatgggattttcaccagacggcgccttcccagttgtgaatggtgaaaaagcctttcagacggtgcaactgcggtttgctaaccagactaccggagattacgtgctacgacgtttcattgctggctcacgaccaaatgttgtcccaggcgaagcacgagcgcgtgtttcagtgccaaatccagctcaagtacaaaatgaatttgcgacgtatttggcacaatatccgtttttaagtgggcaaagtgaagttcgtgatcaagaagtacgcctcttgttgaagggtgtgcaagcgcacggggcttacccgcaagatggtgaaaacgcgggcacctatttggccaacttcttgcgccgttttgcatttaatgccgatgccaaaacatttttggatttcattggtcgcgttgtacatgatgatattggcgccgaaaacctcggactgcggtatcatgatgacgtgatgggggacttaacgcttaatgttggtgtcatgcgatttagtcaaaatggtcaagggacaattttgttgaatttccgttacccacaaggtgtgaatgtccaagcagtgacaacccaagtccaacggcatttgggcgactttgcggcgactgttgaagtgtggccagggggaatggaaccgcatttggtccccgaaacagatgaattagttgggacgttatcattagtttatgcgaagcaaaccgggatgtatatgaacccccgtacgtcaaatggtgggtcatatgcgcgtttgttgaagcgtggggtagcctttggtggccagttcccagatgtgccagttacgagtcatcaagcaaatgaatcaacgcccgttgcgaacttaacgcgatcgatggccatttttgccgaatcgttgttaaaattagcgaaataagatcaaaaaagctacctcatttgaggtagctttttattgttgattaagtttacttaccgaatagattgaacatccaatcgaagaaacgcgtaacaccctttggcacgccaccaaggaagtaagcgaaaccagagaaggctgaaaccaaaattgacgcaacagaggtaacgttacccgtgttgaaagtagattccggcttgtaagctggtgtgttattcgtcaaatctaagtgggttgtcgtattgttcttgaaaatattaggtaatgcatttttctgtgctgcttcggcaacggtcgcttggtgggcaacactagccacggccgtttgagttggctgtgaagcattgggagttgtgaccgtgtcagttgttgcaggtgtatcagtcgtttgcttagcgactgtctttgcagttgcagtctttactggcgcatgctcggcgaccgtgttaggcatcaaagtttgcgtcgttgcactaactgaagccagcacagttgcagccgtgacctttgctagattgatggctgtcttgggtgcctgatgagcgtgacgtggcgcaacactaacagctgactcagacggggcaaccgacttgagagaagcgctacttgcagatgtaattggagcctcagaaacacttgaatcgcttgatgacacaggtgggattggcacgctattacttggtgcaatagaaccaggcaagtcgctcggcgtgtagttactgataggcggccaagtgattgagcttggcacgacgcttagtgaactactgtaacttggtgcgattgattcagaactttcgctcggcgctacgctatcgcttggtatgacagagctaggtgccatacttccgtgaggtgtcacgggttcaggtgcttcgattggcacgttaattgaatctgatggcgttgaatctgaatagctgacgttttgcgttgcttgcaatgctgatagtgaagccgctgcaacagaagattcttgggctgctaacgaagataccatggcgttgtacgaagccgctgaagcttcggcggcttgtgaggcagcgatatctgatgcacgctgggcatcagcagcggcttcagcagccactgcttgcgacgttggatcacctgcgtagtatacagggacatcaaggttctgcatgcctgaagcagcaaggtaatcagcgtttagtttaactgatcgatcgttgatgtacgtataagcatttggatcaaccaatgttgctaattgatccgttgcaattctattctgtaggaaattgtcaggaataatggcgatgtagtcgccggcagcatctgcggtaacgttaatgctaattgcatccccgagatgtgaactgccaatatacatatttttaaacgtaaccgtgaaagattgtgactgtgtaaccggagcgagttgctcttgaccaggaatcacatcatcagcggctacgttggttgtggtgtaaccagcacctaaaccagttaaaagtagaccggtcgctaatccgcggaccaggtacttactcgtagtctctttcatttttctctctcttttctctataaaccatacattcccgtatattatacatgggtttgtatgagttaaatcatttatccgtaaaactagaaaatgttaacgcgtaaagtagtaactaaaggaaatagctttcaaaatccaagcaactatcagaccaaataaaggtaggtttcctaaaatagctcgctttatagagttacgtcgaaccgctgtacggacgacgcgaataacgcctaagagaatggcaattgataacaaccctagtgaaagggccacgataccgacttgaaccggtcgaatcattgtatctgccacactcgatataccgtaaaggccgataaagacgggcaacaagaagtttacaatatcaaacttcttcgctttgcgtcgaggtgtcaccttggtttcaggcgtggcggatacatgtgtcgtgtcaactgagtgaggtgacatcatgacagcattctccatttctataacaactatataatctcttttttatatctcttaattcacacttgaaatcggacatctctctcaaaagtgtccagtcatgctgtattattttagcatttttagtaagtgccttcaacgaaaccagcagaacttttgatggttgggtgttgcatgagagagattaggggaaacctaagataactggtaaaatggtagcaacaaagcgctttttaaaggaggggcaaatggcacttgaattattgtttggtcgggcaagctcagaccatgaattagcgttgctcgaacgtgtccaagctacgttagcagctgatgatcaagcggaaatcttttatgtggttcctaaccacattaagtttgaaacggaaattcaggttttgaaccgactagcaaccctacaggatcggcatggcgcggcagttgctgtgccaaatgtgcaggttttctcactgagtcgtttagcttggtactacatgcaaaatgatcctatctatcgacaagccaatttgtcagcgacggggatgacaatgttggtgcaatcactgttgcgggagcatcaaacggagcttgaattgtacggtaacttattgacgaagcaagggtttattagccagtttgcgagtcaaattttggagcttaagcaggccggcttgtcgtggcaagaagttcgtgacatggcagatgccttaacgcaacaagggacgctgcaaatgaaactccatgacttagctttaattggtgaagccctagaccaagaattagctacgcgcaatcagtatttgagtagtcaattattggcagccttgcgggtttatttagcaactgagaaaacggatgtctcacaccactactatttcatcaatggttattcccaaatgacgactccagaacgtggtgtggttgaagcgttaatcgaacgggccgggggcgtcacaattgccttgccagcggatgatggttcggccagcgtgacggcagagagtttgtcagaaaatgatttattttaccgccctaagcggttagcccaacaattgcgtcagtttgcgactgaccatcaagtggcggtgacggcaagcagtgtgactatgcaacggccagtcagtgagacaataacgacggttgagtcattttggattgcttatgaacaagaaggtgtgaaacccaacggccagacgccaaccccaaaggatttggcgatttggcaggcgacgacgcgctatcaagaaattgaacagatggcccgcatgattcgtcaagaagtggctagtggcaagcgacgctaccgggacttcatgttaatgacccgagatttaggtcagtatgaaaacatgttgccggcggtttttgcgcgctatcaaattccggtcttcatggatttggaccggccgatggcggcgcatcccctagtagcctttcttgataaactcttccgtttagcaccggcgtataccatcgcagatgtcatgggcctgttgaaaacggaattactgattccagaagatgtaacagttgctgagtaccgggaagcgttggcggaaaccgaaaattatgtcttggctaaaaacacgccaggctggcgctggacagataagcagccatggcaattcgatcgtaatgtcgccgactcagatgatgaagtcttgcgggaacacgttgcggaaaaggatgcgcaattggcactgattcacgatcaaattagcaccgttgtggcaccatttttggcagatttggcccaggccccagatgcgcgcgagatggcaagacgcctctacctgtttctaacagaaattggcatgcaacagcgtttgctagcatggcgtgatgaggcgattgcccagggagacttgtggacggcacagcaacctgaacaagtttggcggacctttattggcgtactggacgattttgtcgcggtctttgatcatacgccgatgacaattgcagagttgcaagaattgttgaaggcggcctttgatagtgccaagtacacgggtattccagctacgatggatcaagtccgtgtgtcggaaagtgggattgtgcagcgccaaggttatcatacggtgattgtttttggtgccacaagtgtgaatttaccagccacgacacgtacaaaagcgttgttacatgatggtgaccgagaaatcttgcaagatcggttgcccgagcacgcgttcctgcgtgaaacatcggaacagcaaatggcacaagaatcattgctgatgtacagtgcgatgatgacggctgcggatcgtctgatttggctctatgcaactagtgatggtgaagggagccaacaaccatcaacgtatgtcacgcgattgatgaaacaatttaacgtgccggtacgccatttcgcggcgttgccagatccgaatacgatgcgcattggcgattatgtcggcacggttgatagtacattggcgcatttggttagcgtgaatcgccaagcggccaatcagcaacctgccggtacattgagtagtgcgtggcaaaccttgcaacaacaagttagccaaatggcaccagataagacggcgcgggtgatgggtggtctaacgtatcgtaatgaaccacaacaaatcttggcatcattgatgagtcagttatttagtaatgatttgaaggtgtcgatttcacgtttagaaaattatgccaagaacccctttgaattcttcctgcagtacggcttacgtctcaaggagcgccaagttttgcaactaacgccggctgaaaaggggacgttgatgcacacgattctagagcagctgtttgctgaattgattcgtcaagacaaaacgttaagtgagttaacggatagtgagctagaaaacctggaacgcaatatcttgaacggcttgctacgcagtggggatgccacgtttgatatcttcagcagttctgcgcgtatgacgtttttgacgcaacgtttggctgctcaagttcatgatacggtactgaatatgaaacgtgggcaactggtcgatggtggtgttcacacgttaggtgttgaggctggctttggcttgccgcagagtaagctcaagccagttcagtacgaattacccttaggtaaggtgacggtccgcggtaaggttgatcggtatgatttggtcgaaaccccaacgggcaattttttgacgattgttgattataagtcgggtaagcggacgtttgattacacccaggccttcgccgggttagagttgcaattaatgacttattggacggccatgctggcaaatgcgacggtattaccgccaagtgagatgggtggggctgtcttctggtcacttcaaaatccatggattaaggtcaaggatatcgcaggtgatacattggcggagttacagacgcaagctgatgtggcagcggcaaaccaaggcacctatcgtggggttctgcgcaatgatgaggcctatattgagcgacttgaaggcgttgatggtgtgaaggcaccgtttgccatcaaacgtaataaaaacgggtcgtttgcgaaggcagcggacgtcgttgatgaagccgatttggatattttgctggcctttaacgaagtcaaaatccgccagattgcgagccaaattttggctgggcaattcccactgctgccattccgcgatggccccaacaaaactgggatgatgtatacgccgtttaagccagtcatgatgtttgatgccatgatggggaatcagtatcgcaatattaaaaagctagatgctaaggatgctttggcagcgatgcaatcagttattacagacgaggaggacgactagaccatgaattttacagcatcacaagaagccgccattacggcacgcggtgaaaatattttggtgtctgcctcagcgggatccggtaagactcgcgtgttggttgaacgtgtgacccgtcgtttgttagccggcgaaaatgtgaatgagtttttgattgtgacatttacagaagcggccgctgcggaaatgaaagagcgactcgaaggtgcaattcgtagcgctttagctgagtcggagggtacccaacgacaacacctgttgaagcaattgcgattgttaaacgtcgccaacatttcaacattgcacgcgtttgctttgcggttgattgaacaatatcactacaccatcgatttggatccccagttccgtctatctgatgatgccgaacggacattgttgatgatggaagtctatggcgatctattagaggcgcgttatgctaatgacaaggaccaagtgtttgcccgttttgcttcgcaattcgcttcagggtcgacagacgaccggacgttgcaagaggcggtgtttacgctgttcaactttgccatggcgcgaccagatacgacagcgtggttagaaggcttagctgcacaatatgaaattgctgggtcgttgactgagacgccgttttatcaggctcagatgttgccgattatgacgtctgaattgcagacattagtgacacaagctgagcaattattgaaccaagcgcccgatacgatggatgaagcacctgctttgaaccggttattaaatttacagacggatactgatacctaccaacggttattgcaagtcgtccaggatccaaccgtcagttgggacgatatgcgccaggcctttttgtcagccgatgtgatgggctgggggaccggcgcagacggcaagcgcaagaattttactgcaaagcatgatcctgaactaaaagccgcctgggaactggtgaagacccagcgtgaacggattaaggaacggttggaagcattacaaacgggcttttttgccctggatgaagcggccatgcaactagctgtgcgtggggctggtgaggtgattaccgaattagtcgcatttacgcaagcctttcgtgaggcctttttagccgaaaagttgcgtcgtaaggtcctggactttaacgatttggaacactttgcgcttcaaattgtcagccagccggcagtgcagactgagttgcgcgcacgttataacgaagtgatggtcgatgagtatcaagacacgaatcaactacaagaagcgattttaagtttcattgcgagcggtgataatacgttccaagtgggtgatattaaacagtcgatttataagttccgtcaggcggatccaaccttgtttggccataaacttgcgacgtatccacaaacgccaggcaataaggtgattacactgcaagaaaacttccgctcgcaaccgaacgtcacgaatttcatcaactttatttttgcgcaaatcatgagtgacgggttaggcgatgttgactatacgggcgaagcagaattggtcgctggggccgattattatccggctgacttgcccaaagaagcagaattgatggtgtacctagatgatgggacaacaacggatgacgctgatgacggtccggaggtcgcgaatgagtttggctttacgaaagcaacaggtcaaattcggatgatggcgttgaaaattagggagttaatcgacaccaagtttgaaatatttgatcgtaaagctggtgaaaagcgtccggtgacatacagtgatatgacggttttggtgccaactaagaatcaaaatttggatgtcttggatgtgttccgtgaaatggacattccgatcgttgttaacggggcggagagttatttccaaacgactgaaatttcagtcatgatgagcttgttgcaggtgattgataacccgcaccaagatattccgttggcagcagtattgcgttcaccactgtataacgttgatgaaaatgggttagcgttaattcgaacgcaagccatgacggaagatttctatacggcggttcaagccttagcgaataatgcgttaacaattgccgttgccggcgtttctgagacaaaggtcaatgagacgattgcggcggtgcaacgtttcctagcggatttggagcgtttccgggcgttggctgttcaaaaccaaattgtggatttgctgtggcagatttataacacaacggggtggctggattacgtcggtggattgccatctggtccgcaacggcaagctaatctacatgcattgtatgaacgagcagccgcttaccaaaagagcagtttcgtcggtttgtatcagtttattaattatgtgacgcagctacaaagtcaggacaaagacctcggtgaagcggatgcgaatgtggcgagtgatagcgtctcattgatgacgattcaccactcgaaagggttggagtttccgattgtatttgtcctgaatagtacccggcgcatgattagtcagcgagaaacgatgggtgacattctgcttgatgctgaagccggggccggaatggattacattgatttggatcaccacctcaagttaccaacgccacaacgtgaatttgttaaacaagcgcgcgttcgtggtgcgtttgctgaacaattgcgggtgctttatgttgcgttaacgcgtgctgaacaacacttgtttatggtgggggcgtacgacagtgtgaaagccctatgggataagtggtcgttagctgaagctggtacggaatggatgttgccggagtgggcccgccttgaaggaaagtcgttcatggacttgatggggatggccttgatgcgccatcccaaggcgcctgaattggcaagtgtgctaacagcttacgatgataaggatgtcattgatttcagtgagattcggacgaaagcgccgaagcaaccgttcaattttgggctagaaatcgtgaatggggccgatttacgcgcactggttgatgcttatcaagcgatgccactgtctgaagcgacgtcagaaaagaccggtgccacgccggacggcatcatcaatgattggcgttcggtgttgcaatttgattatcagtttgatgaggcgacacgtgccacagcgtaccagtcagtttcagaaattaaacgtctatttgaagatccagatttagcagctggccgtggcttagtggatggacgtattcaagcggatgaatttgcaggattgcggtttacggatgaaacgttaccggagccgacctttatgcaagaagcggaaacgcgtatttcatcggctgcgattggaacggcaacgcacttggttatgcaacgtgttgatctatcggcaggagcgccatctcaggctgacttgcgcgcattggtggccgatttggttgaccaagagttaatcgaggaaaaggtggcccatctgatttcgttgtctaagattgaacgtttattcacgaattcgcccttaggtaagcaaatggttgcccatgcggactctttgcaacgtgaagtgcagttctcactgttgcttgatgcagatcgtctgtacaaagacttccagggatcagaaaaagttttgattcacggtattattgatggctatttccaggtcgatgatgaggtgtggttgttcgattacaagaccgatcgggtaacaccggaaacggcagctgaaacacttacgcaacgttattcaggccaattgaacgtttatgcacaggcgctggtggcgatggggaagccaatgccacgtcggtttatttatgcctttagtgcagagaaaattattgcattagactaacttaaaagaagtgaagcgtccgccatttgggagggcgctttttttgggttccgatttataaaaacgcacaaaaagttcttgattagatttcaagaaagcgcttgcaaaagagagcgactcggttataataatgtttgtgaagaaaagaacaaatagtcattgttaacacgaggagattagacatgaaagcagcagttgttcgtgaaacgccagatggatttgtagatttgattgatgattggcaaccccgtgccttaggatttggtgaggcattggttgatgtagaatacagtggtctttgccacaccgacttgcacgtcgccaatggtgattttggtaatccaaatgagattaacccacgcgaattccgtcgtgtcattgggcacgaaggggttggaatcgtgacgaagcttggtgaaggggcatcagattacttgaagttgggcgatcgcgtgtcaattgcttggttctatgatgcttgtggaaactgtgagtactgcaacacgggaaatgaaacgttctgccgcaaggtgcgcaatgctggtttctcagtcgatggcgcaatggcgcaacaagtggtcgtcaatgctaagtatgcagttaaggtaccggaaggtcttgatccgatggaagcatcatcaattacgtgtgccggcgtaacgatgtacaagtctcttaaggtcggcgaaacaaagccaggtcaatgggtttcagttgttggggctggtggtttgggtaacttggccatccagtacgctcacaatgtgtttggtgcccacgtggtagcggtcgatggtaacccagacaagttggaagcagcgcgtcaaatgggagccgaattgctcatcaaccgtaagacagaagacgtgcctgctattatccaagaaaaggttggcggggtacacaacgcacaggtaacggctgttaacacacaagcgtttgatcaatcaattgcgtcattgcgaccaatgggtaagttggttgccgtggcattgccaaagggtgacatgcagttgaatgttgtgaagacggtcttggatggtattgaagtgaagggctcacttgttggaacacgtgaagacttgaaggaagccttccaatttggtgcagaaggtaaggttaagccaatcgtgacgcgggctgatatccgtgatattaatgatgtgattgatgcgatgcacaacaacaagattactggtcgcatggtctttgatttcaagagtctataaaaagttaaattgcgtgatgtaatctgaataatgggttccacgtgagagggaacattcaaaaggtcatcgcacaattaacaactcctaaaataacgaatctttcgatgacgataaaaaacaacccctgacagcggatacgctgcaggggttgtttttgtgttactgattagcgaggcgtcgtttgcgacgtcttgaagctcggtcgagaatgaaggtgacgactacgaagagcatcatgatgccaaacattgaggcaaacaaggctttgtatgagccaccgtcaatcattaagccaccatatagtgggccgaccgcacgaccaagtgagatggccatcgtcatgaagccttgtgcccgtcctttggcgttggggtcactgatgtgatcaatccaagcaggcatttgtgggctggcaaacatttcaccaatcgtcaaaatcatgaaggtgaagatgaacatcggataggtcttcgcgttcatcaagaataggaatgataccgcgaacaaggcggttccacctaagacggttagtcggaatggtagtttttcgatgatgcgatcgagtagaccttgcccgacgataatcacgataccgttaatcgtccataggaatgagtaatcttgagtggtcatccccaaatcagtcatgtgcgttgcaacaacggtttcccacagaatgtatcccatataaagggaaaaggctaaaccgagcagggcgtaaatcagcacaggcgtcctgaaattgctcttggcggccttagcagcgtctttagtcgcttgggcggcgagtcccttgacgttgaagtagcggaaaaccatgaccgagaaaataagatacatgattgtcgcaccaccgaaaacgaattgcacgccgtggttgaataggaagccgacaatggcggttccaacaacgacaccgacgttcatgaacaggtattgtagattgaaaacctttcgagaatcaatcgactgaatcgtagccgcgtatgaatttaagagggtatagataatcccatctgcaaaaccaagaattagcatgaaaattgcaaagactggccaggaatgccaaaaagtcagggccgccaacatagctgttgctaaggcgacagcgcctaagattgatttgtaagggttccaacgatcaaataggtgtcccccaacccaactaccaatcatcatcataatcgagagtcccatcacgaccatgccagccatggtcatggtctcatgtaagacattgtgcatgtacaatgtcgcgatgggccaaatgagtgaggcgccggttgattggaataatgtggtgatatagagtattggcgctttaatctcaacgtgttgcggtttgagcgcttcgccatcttgttgtgatgactggattgccataaaatcctccattgtgtcagctgacacaactaattgtaattaacgttattccatagtgggtaaccactatatataacgtcgcgcacggtactgtaaccgtgcctgtccgtttattctatgcagaaaagtgtagcacattctcacatcttgatatactaatagggagtgaaaaaattttaaacgaaataaaatcggggaacgcattatggctattacacgaccagaatatattttggcaattgatcagggaacaacggggacgcgtgcggtgatttttaatcataatgcacgacgcgtgacgtcgactgcaattccgatgacatcaatcgtcccacatacggggtggttggaacaacgtccgcttgatatctggcggacggcacagaccgcgattgcggatgcactcattaatgcgggtattcgtggggatgagattaaagcaattggtattgccaatcagcgcgagacgacattaatttggaaccgccacactggccaaccgatttataacgccattggttggtcatcaacacagtcacagagtattgcggatgcctggcataatgctggtcacgatgagttaatccgtggcaagacaggcctgccggttagtgcgtacttctcggcaaccaaaatccgttggatattggatcatgtcccgggtgctcaggcacaagctgaagctggcgacctggtatttggcacggtcgacacgtggctggtgtggcagcttacggacggtgaagttcatgcaactgatgcgtcaaatgcagcccgaacaatgctatataacattcatacgcaagcatgggatgttgaattgttagcgttgtttaatattccagcagccatgttgccacaggttcacacgagtagcgatgtgattgcgcacacgaatccgatgcaatttttcggtggtcgggtgccgattgccagtgtgattggcgaccaaaatgcctcattagttggtcaattagcgctcgaaccaggcacgattaagaatacttatggcgcgggtgcctttttattgatgaatactggacatgaaccagtgatgtccgacaatcaattggtcacgaccattgcctatcaagtgggggaccgccccacatatgcgttggaagggtcaattttctcagccggttccgctgttcaatggctccatgaccggttggggttgattgaaacacagctggatgcctggcaagcagcagaagcatcagaaaacgctgatgaagtgtatgttgtaccggcttttaacgggttaggggcaccgtattgggatcctcaagtacgtggggcagtcttcggtatgacgcgaggtacgggtaaaaatgatttcataaaagcgacattgcaatccatcgcgtatcagacggcggacattttagcgattatgaaagctgagtcgaaatatgatgtcattaaaatgaaggctgatggaacggtttcacgtaatccgtacttgatgcaattccaggcagatgtcgctgatattcaagtagagcgctcaatggatgaagatacgacaccacttggggccgcgttcttagccggtctaacagttggttattggcaagacttgtcagacttagagcagtatgtgccacagggacgtcaatttacagcaagtttgacggcggaacggcgggcaacgttgttaaatggctggcgaaatgcagtcagggcaacgcaattcttctcatctgagtccgaataatcagaaaaatcacaatgtaagcgttttacatttttgtagcatatttgtgtaaaaaagtttataatgtttgtaaaaggtaccggtagtgagatgctggtattatgaaatacgaaatgaaactgattttttgagagtaaaggagcattcatcgtgcctgcagaaattacaacattgttgacattcttcggtggaactggagatttggctaagcgtaagttgtacccatcaacatacaacttgttcaagaagggcttcttgcaagaacacttcgccgttattggaacggctcgtcaagaattgacgacagaagagttccacgagatggttcgcgaatcaattgctgacttcgtcgaagaccaagcgaatgctgaagagttcatttcacacttctactacatccaacaagatattacggattcagctgcttatgcagatatgttgacgttgaacaacgaattggatgctaagtacggcttgaagggtaaccgcattttctacatgtcagttgccccacgtttctttggaacggttgccaagtatttgaagtcagaaggtttgattactgagaacggtgagtataaccgtttgatgattgaaaagccatttggaacatcatttggaactgctgaagatttgcaaaatgaattgtcagaagcttttgatgatgcccaaatcttccgtatcgaccactaccttggtaaggaaatggttcaaaacattgcggctgtccgttttggaaacccattgtttgatgcggcttggaacaaggattacatcgaaaacgtgcaagtcacgttgtcagaggttttgggtgttgaagagcgtgctggttactacgatacagccggtgctttgcgtgatatgatccaaaaccacacgatgcaaatcattggttggttggcaatggagaagccagcatcatttaaggacacagatattcgtgccgctaagaatgctgccttcaactcattgaagatttacaaccgtgaagaagttgctgaaaactttgtgcgtggtcaatacggcgagtctgctgatggtacgcaaaagaagtacttggatgaaatggacgtgccagctgattcacaaaacaacacatttgtggctggtaagttgcaatttgagatgcctcgttgggaaggtgtgccattctacatccgttcaggaaagcgtttggctgctaagtcaacgcgtgtggatgtcgtcttcaagaagggcttgaacatcttcggtggtgacgttgaattggcaaacccagttttgactattttgattgatcctaagggtggtatcgaattcaagattaacgccaaggacgtgacctcagaattcttgacgcgtgttgttaacttgaactggacagtttcagacgaagacaagaagttgacgccagaaccatacgaacgtatgattcacgacgcaatggacggtaacggatctaactttgccgactggaacggtgtggcaattgcttggaagttcgttgatgctattcaagaagcatgggatgcaactcgtgaacaattccctaattacgtttcaggttcaatgggaccagttgcgtcagatgaattgttggccaaggatggcaacgaatgggtcttcaagggctaattcgttagactaaatagagttaaaaaaggtacacactattaacggtgtgtgcctttttgcgataaggagacagttaaatggcagaacggtataccccaattgaattaacgaacatgattatgattgaaaacccggtgacacatgaagtcttggttgaagaccgacaaaatccaaagtggccaggggtgacttttcccggcggacacgttgaagtaggtgaaacggtgacgcaatcggtttttcgtgaagcgcgtgaggaaaccgggttagaaattgaagcgcctcagttaatgggtattaaggaatggcccttagaaaatggcgcgcgctatattgtcttcttgtacaaaacaacgtcgtatagtggtgccattcattcgggccgggaaggtgaaattttttggacgacgcgtgaaaaactgcttgacgggacttacgtgctgccaaatacattcgcagagatgctgccagtatttgatgatccagctattaatgagctcgcattaggtgctcgtgtcgatggtgaagagcgcgcaatttcatggcaataggttaaaacgtttaacttgtaaaagccgaacgtccgaaaaacgctggccaaagaggccgcgttttttgtttgtcttcggttttaaagctgtttttgattttttatatgaacggacgtgttatactaaagctataattataaaaattaccgaacgttcgaggtttagaaatatgaaaacacgtcgtagtgatcgattggtcgatatgacccgttacttgttagaacgaccacgcactttggtctcattgacgcaatttgcagaattatatgaaagtgccaagtcatcaatttcagaagacttgacgattttgaagcgcacatttcacgagcgcggcattggtttgctagaaacaattcctggggcagctggtggcgcacgctttacgccatacatggttgaatctgaagctgctgatttcgtcgcttcattagttaacgcgattgacgatgagacccgtgtcttgcctggtgggtatgtttatctgtctgacttactaggacaaccttggttcttgcaacgcattggtcgtttgattgcgacacaatatttgcgtgaaccaattgatgcggtgatgacagctgctacaaagggtgtgccggttgcgcaggctgttgcggaacaattgaatgtaccatttgtgattgtccgtaatgatactaaggtgacggaaggtcccacgatgtctgttaactatgtgactggacaatcacaacggcttgaaaagatggaattgtcacgacgttcattgccaatgggatcacgtgtccttattgttgatgatttcatgaaggctggtggtacaattcgtggtatggcatccttggttaaggaatttgaaggccaagttgttggtgtcgctgttgttgcggaaggtcgcgttgagcaccgtgtgattgataagtacacgtcattggtgcatgttgataccaacaaggatgacggcatcatcaaggttaaagctggaaactatgctgaagaaatttacggtgaaggctcaccagctgaaatttcatctgcagattaatgaggtaggaagtaaaaaacatgcaacgctttgttattattttggccgctggtaagggaactcgcatgaagtcagacttgccaaaggttttgcacgaagttggtggtaagccaatggttgagctggttttggaaactgctcaaaaggctggcgtagaaaaaattgtgacggttgttggtcacggggctgaacaagttgaagcgacgttggctggacgatcagaatttgctctacaagcagaacagcttgggactggtcatgccattcaaatggcggaaccacaattgggtgatgcagctggaatgacgttgattggttcaggggatgcacctttgtttacggtggacacgtttaacaagttgtttgatttccatgagcaatcaggtaatgccgtaactgttttgacagcgaaggcacctaacccaacaggttatggtcgcattattcgtgatgaaaacggcaatgtggttcgcattgttgaacaaaaggatgccacgcctgaagaggcggctgttgatgaaatcaacactggggtctatgtgtttgataaccaattgttgtttgcgagtctgaagcaagtgacaaatgataacgcccaaggtgagtattacttgcctgatacgttggaaattttgcgtaacgctggtcacacagtaggcgcctttgttatggatgattttgatgaatcaatgggtgttaacgaccgtgtcgctttggcccgggcaaacaaggtattacgtgatcgaactaatgagatgcacatgcgtaacggggtcacattgattgacccggccaacacgtacattgatgttgatgtgacgatcggccacgatacgattattgagccaaatgtctacttgaagggtaagacggttattggttctaatgtcttgattacatcaggttcacgcttggttgattcaattgtggcagatggcgcccaagttgatgcttcacactttgaggaagcggaagttcgcgaacgcgcttcagttgggccatttgcacacttgcgtccggcagcattcttggatgttgaagcccacgctggaaacttcacggaagttaagaaggcgcatttgggtaagggctcaaagatgggtcacttgtcatatcttggtgatgcgacggttggcgaggatgttaatatcggtgccggttcaatcttcgttaactatgacggtttgcacaagtggcactcaaacgttggtgatcgcgcctttatcggctcaaattcaaagattgttggaccggttaatatcggcgcagaagcctttattgcggctggctcaacgattactgacgacgtgccaacgcacgcgatgggtattgcgcgttcgcgtcaaattacaaagtttgatttctggaaccgcacaccattgcatgagaagtttgatgatacggaatcagcaaagcgggcagcaaaagcagcgtttgacgctttcttagctgataagtaaatgagataatcaataggtcgggtcagagtctttctgatccggcttttttgtacacattgctaacgaaattagaagaatatgtgaaaaccttcgggaactgtgatgggatattcgttgaagaatactgaaaaaaactgtacaatgtaactattgaacacttgaggaacacagtgatgtgtctatggagggcaacatggcgacctatgcggatccgcatttgaagattttttcattgagcagcaatcagcctttggcggaaaagattgccgcttcaattggcgtggaattgtcacaaatcaacattgcacgatttagtgacggagaaattcaaattaacattgaagagtcagtacgtggcgataacgtatacgttatccaaccaacgtcagcgcccgttaatgatagcttgatggaattaatgattatgattgatgcattgcgtcgtgcaagcgcaaagtcaatcaacgttgttatgccatactatggttatgcacgacaagatcgtaaggctcgttcacgtgagccaatctcagcgaagttggttgccaacatgcttgagatggttggtgcaacgcgtgtcttggttttggatttgcacgctgcgcaaatccaagggttcttcgacattcctgttgatcacatgatgggtgcaccattgttggctgattacttgattacgtcagggattgccgatgataataccgtcgtcgtgtcaccagaccacggtggtgtgacgcgtgcacgtgctttggctgaattgttgggttcacaagagccaattgccattattgataagcgtcgtccaaaggcgaacgttgcgcaaatcatgaacatcattggtgatgttaaggggaagcgcgccatcatgattgatgacatgattgatactggtggtacgatttcacaaggtgcccaaaagttgaaggacgaaggggctgctgaagtctatgtcgtggcaacgcacgctgtcttctctggtaaggccgttgatacattgcaaaactcagtctttgagaaggtgatcgtaactgactcaattaacttgccagaagagaagaagttccctaagttggtacaagttacgactgctgaattgattggtgaagcgattaagcgaatcaatgagaaccaagcggtttctccattgttcaagaaccgtttccaccgcacggtcgactaatatattttgacagtaacagcattgttctaataatgatttagagcagtgcttttattttataaaggggttatatgatggcaaagaaaaagatgattttggatttggatactggtgtagatgacgccttggctttggcatatgctttggccacgccagattcagatttgattggtgttgtgtcttcgtttggaaatacacaagtgacgacggcaggtgaaaatacactgaagctacttgaactattgggtcgtacggatgttccggtctttatcggggcagcgcattcatcgacaacggatagctttgagacgatgcaagtatcaatggatattcacggtaagaatggtattggggatgtggcactacctgcaccaacgacagctttgtcatcacaaacggcggtcgattttattattgaatcggcacacaagtatgctgatgacttggtaatcgtaccaactggtccattgactaacttggctgaagcttatcaaaaggatcctgaaatcgaaaacttgatcggtaacgtgacactaatgggtggtgctttggtcgtgcctggaaatgtgacgccttatactgaagccaacattaatcaagaccctgaagcagctgattatgtgttcaagcatgctaagcacttggtgatggttggtcttgatgttactttgcaaacactgttaacaaagaaagaaacacaagtttggcgtgatttgggtactgaaaagggtcgtgtcttcgcagatatctttgattactacattgatgcctactacgacttggatatcaacaaagctggggcagctttgcacgacccattggccgttggtgtggccgttgaccctaacttggtaacgttgttgccattgaatatgatggtgacgcatgaagatgggcgtacaattggtgatccaacccgtttgcgtgatccacacaagaataactttgcagctgttgccgttgatgaaccgttctacttggaacgcttcatgaattacacgacggcattgttccgttaattaatatataaaaaagcgatgggaaatcatatcgatttcccatcgcttttttaaacgtaaattatttattgcgacgacgcactgggcgaattacaaaggcgtaaatcgcagcaaatgcaagcatcacaagaccgataattgacacgccgacttgcaagtcttgaccagtttctggcaatagttgtgctagtgctggcttgtcatcagacttagtagctgtggcgttgtcatcagatttaacaggtgtgttatctgatggtgtcgtagcaggagtagccgtggtaggcgttggcgtggcttcgtgcacgtctttaactgcctgggcaattggtgtgttgctctttgtgtccacgtcactgacaggcttcttgtggtaagtgaccttgatatcaccaccaccaacgggtacttcaacattaggcacttcggctgtatagccaggcacagttggtgtcttaacctttgttccaggcttgtcattgtatgaggcgtcaccatcaggctttaatgtcttgccgtctggatcaactgggacaaccttaccaggatagtctgtatttgtaccgacatcttcaccgacgactggattactggtatctggtgtgtactcaacccacaaagttggtgggttagttgaagtgtcgaccttgatgtaatcgccatcgacagttgcataaccgccgtcaacggcaacatcaccacgcgtgtaataagggatgtttggcaagtcggaaaccggtacctttgtttggttatcttcccaaggaacttcaacaacttgggtttgaccagggattgggacacgattaccgtccttatcgcgggtgaatggtacaacggtgaccttcttggtgttctttgtataaacgaacgtgacgtcgccatctttaccaaaggtaacggattgttcgctagcccccttaaccttgtaacccttaattgtgtcataagcttcagcggttgcggtatcgccggtgacaccagtcatggttgtgtcgtcggcaagcttgttaccttgctcgtccacgtggtgcaccttaatcgtttgttcaattggcgtgtaggtaacgatgatgtgcttaggttgatcacctagaatacctgacaaagcatcgccagtcactgtcttggtgtaaccaggcttgtcgggtgcgtcgaaaccataatctgcaccgacacgaccagattgtgcgccaggctcagcagcttgtgacccgtctgcataaacgtactcaatcgttgctgaacccatgacgaagttagggtcgggcgtaatggttgggttctttgttggcgcatcaggcgtctcaggtgtagttggtgttgcaggggtcgtcgtatcaccgccattaccagtgttggtcttgtcaccatcgttgccgttcttgccgtcatcgggcgttgatggcgtaacaggaacggttggtgtaattggctttggcttctcgcggaagtaatacgtcactgtatttgtgtcatccatgtagaccccggttacgatacctgattctggatcgtagtaatacttttcagaatcagaagcttgacctgaaccggcgtacatatactcgtcggcatcggtaccgctcaagacagggataccaaacttatatgatgagttaaaaggaccgctctgctcgattgggtacttgtaggatgaatcaatttgcagatacttaccagttggattaccgttggcatcgataacttcggccttaaccgttgcagtctcagtctttggtgtgtattcgtactcgtaagttggcgtgtcatcatcattcaaaggattgattgttggtgtctttgtcaacgtgtaaccaggtatggtcggtggcgtatatgaaggcgtgtcaccgtagtcgccagtgacagttgtcttgccaagaactgtgccatccggtgtctttaacacgatgttggcagtttcttgatttttcttataaacgtaggtaaccgtgtcgggctcaatgttgtggttcgttaggtacagcgtgccgtatggtgccccataacgtgacaaaccagcaaaagtaccataactaccgggcgcaattgagccaccttctgacggacgtaagacgccgctgattgggttaccgttgcgatctgtgacttgcaatgtttcagtgattgaaccggctggatcagtaattgtcttagttgcgatggcccattggcgaccgttgtcatcgtaaagtggctctgttgttgttgtaccaacaacataagtcgtcttttgatttgaaacggtaccggtcgcattaactggtgtctcggttaaggtatagccaggaattactttagacgttgtggtgtagtcttgcccaacgattgcgttactttgtgccacggcaggtgcgatatccttgccgttaacgtccttgaagtacgttgtttgcgttgtgcgaacagggatatccattgaagcgtttgaaccaccgttatacaaactaacttcaccattcttaacttgcacacgatatgagacgccacggtcgccggttagtgtttgcgtaccgtcgccattgaaggttaattgggtgcgttgaccgtaggcactgatgtaaattgcgtgaacttcagggttggctaacccggcgttaatgtcagcagtattaactgagaagtaccaattaccacttggtactagccagctttgatcttttgaggtttgggaatcaaaggtgaggaatccgtttgccacatcgtaagtagatgagggcgttgtaacggagaaaccatccgttgcagcgacaacggaaattggtgcagatagtgtcacggtacccaatagtgcgacactaaacagtaaacgacgtgttgccgaacgtcgtgaaactttatatgtatccataatatgttactaactctttctttctcttttgtaattactaataataagcaactacgtgtatatattatcgtcagttttgggaacctaaacaacaaaaatggcgtttgaattttttggtgaatttttaaattttttcaaaattgtacatatagaatatttttgtattgtttttgtatgttttaaacttttatttcccattattttagaattgcgttcgctcatttagataatgtgtctcatatgcgggaccattctcgtcgctgtcatgagaaatgcgtggatgattaaccgctaaattcaggaatcatagatatttgcataaatgaatcatgtacgaaaaggcgtagccattctacttgcaaaacgttggtggggcgtgtaaacttagttcttgtgagttatgttgaaatttgtttcaactgctctccttgccggcaggaagtcggccatagaccaaaaggaggaagttattatggcatacgaattgacgtacatcattcgccctgacatggacgccgatgctaagaaggcattggttgagcgtttcgacaagatcttggcggacaacggtgcaacggtggcagagtctaaggactggtcatcacgtcgttttgcatacgaaattgcaggttaccgtgagggtacttaccacatcgttaactttactgcagaagatgacgcagccatcaacgaatttgatcgtttggcaaagatctcacaagatatcttgcgtcacatggttgtaaagcgcgactttgcatcagctgagtaattgttagcttaattgtctaacatttttattgacttagttttattggtcgatggaccattgaaaggagactttccatatgattaatcgtgttgttctggttggtcgcttgacgcgtgacgttgaattgcgttacacgacttcaggtgctgctgtcggaactttctcacttgctgttaaccgtcagtttactaacgctaatggtgagcgtgagaccgactttattaacgccgttatctggcgtaagtcggctgaaaactttgcaaactttacctctaaggggtcattggttgcagttgaaggtcgtttgcaaactcgtaactacgagaaccaacaaggtcaacgtgtatatgtcacagaagttgtcgttgataacttctcgttgttggagagtcgcgctgaaagtgagcaacgccgtgcacaaagcggttcagcaaacaataacttcggcggtggtcaacagggtggcaaccaaggcggctttaatgccgcgccagcacaaaatccattcggtgcacctgcatcaaatggcaatgtgtttggtggtgcgtcaacacctgcacaatcatctaatgatcctttcggtggtggtcaagaggttgatatctctgacgatgatctaccattctaagttgatatatctaattgtctaacgacataagtctatcaggaggaattaatcatggcacaacaacgtcgtggtggcggccctcgccgtcgtcgtaaggttgactttatcgcagccaaccacatcgaatacgtggattacaaggacactgaattgttggagcgtttcatttcagaacgcggtaagatcttgcctcgtcgtgtgacgggtacgtctgctaagaaccaacgcaaggtgacgactgctatcaagcgtgcacgtgttatgggtcttttgccattcgttgcagaagactaatagcataacgcttttagtaacaaccttaaaagagcgactcagcttttgctgagtcgctctttttttatccatagcaagtgtgtttttgccttttggcagatgaacatggctctttggctgagtatgctgatactgaccaattttaagccataatgttttcaattatggggcgtttgtttgtacatatctgcatggtaacgttagtgataatgaagaagggggtgtctgctgatgaagaagtggataattagtgtcgggagtgtggctgttgctttaattgttggtgcggtggggatggcagcttacaacgatcataaggaagaacaatttgaacgtcgatatgaagcgagcttagctaagagttattcagaatcagctaagttagccagcgagtcaacaagttcgtcatctgcaagcgctacgagtgattcaacggccacgagcagtgccacgagtttgccatcgcaaactgcggtagaaacgcgtctgagtgaggatttggacaagtttattgcggatcaaaaggatggtatcattcaaactggttctaaagaggatatacgtgatgcgttcgaagatacctacgtggatacgtaccaagatgagttagaggcgcaacacccaggggaacaaaacgaagatattgttgaaggtatgattgatcgcggattactcaccttgaattttgatggtcgaattgctgcggttaaataaatttttcgcacacgggggagagttttctgcctcgtttttttgatacaaaaaaccactagatcaaatgacctagtggtttataggatgggcagacaggggctcgaacgatcaaaactattgagcgcattctgcataatttcttgtaaccttctcacacttaaatgcagacggtcactaattgcaaaccattgtaacccttctatgtacttcaatataatcactttccgttccatgtcaggcagtacacttaaagcgtcaaccatatccttaatatacatttgcgcttgaacttgccgtgtcatcttatccattgctgtgttttcgttactgtgatgcactggcattgcatccaaactcacactagacaatctaacgtgtgcaagtatttgtagtttgggtaaatcgtccgtaaagaatgcacgtactcgcttaaccgttaccttatcatcaatagataatgctgtacttaccatatactcacctcatcctttttacgtctgcaaactatatctatattattgtacaacgtgttcaataactctaaattctccactcgtggggaaaactgacccagtacgggcataaaaacacctaattcagcacgtcaaaaccttaatacaccagtacatgtttccattgcccccctattaaaaatttttcgaaatcaaacttttctacaagaacacagcaatgtgtgtgcttttcttttgccggtcatggggcggggcatatccaataatggcgatacttccaaccaatcaactagcctaaaacaaagcgcgctcaaacaggcttatatggcttctgacaacgtgtgttcctgctgcgcttgtaagatgtctatctgactatccaaatcaagtatgctgacagcgaaataaccatgtctttttttatcatcagcaagttcaaacttcgttagctgaccaacaccccgcgcggtatttacgcgtgctacttctaaaaaagtgtagcaagtgtagccaaacaacctttagcccttggtatgactagtctcgtgacggctacatatggtgtagctccagtgtagcaaaaacgtagctaagtaatataaatccttgatatgactggctttctactcggctacacaaaaaagcggctaacctaagtcaaccgccctaaaatcatcaattcaacatctgtccaattatccaaacatcacacgcaatcagtccaaccataaaccagtattgcatgttatcccaatctttattattcatgtcctttcatctcccaatcgttataaatgtcatctgcccttgtcatcacctgctggtcattggacttgatacccttacccttgattcgactacggcgcttggtgtcgtaatcatcaaccagttcagcgtctgctggtatagctttcattggctttctggacaactgcaagccgtggttaatcagtgacttgcgtaaatctcgctcattcataacatcattggctggtacaccgtcactcattagaaacgctttaaacaaatcgtgaacataagaaactgttacaccgttagtaccttggatgtccacaaaatactctttcatgaactggcttagcaaatcatcactagtcaaccagtcagccgttcgttgcttagctgcgtctgtaatggtcagcttacggcgctcaatggcttgcttagcctgtgtaatggcgcaatagatgaacttgggtaactctgctactaacttatcttcatgatacttagacatgtacgcttcacgttctgcgtcatccatatcagtaataggcttagcaccagcactcaacaacaccaatcggcgactgtattctttctggtctggaaatgtcggtaaattgaaattagctgaaatcaaaaacttggcatgtaccttaaaactatacgtatctcgtcctttggggtttgctgtcagcgggtcacctgacgcaatctttttaaggatgtctaacccgtcagttgaaatggtgctatctgattcagtcaaaatattggcatacataccagctagttgctccatgtatcgtgaactatccttaccagcaagctgcgagaaactgatagacccaccaaatcgctcaaaaccaaacgcttttaacaagacttttaacagcgtacttttaccgttaccaccttgtccttggataaagacaatatgctgcaagctgtcatcattcaaaaagaacatgtacccaaaccactcaataagcgtctgggcatcatcaccaagcaaataacgcgcgtattcagcaaccagcccaccgtcattactttcaataatcttagccggtaacaatgatgtcagataatcttcttcacggtactcatgtaattgcatagtttttaagtccagcgtaccgttctcaaagctcactagatcttcgctgttaaacacttgataacttggctctggtatcaacgtttgcgccaactcaatcatgtcactgcgtttttgcctagaaactttatcaaatacgcggtacttattcagcaacttaattgaatcacttttaatgacctttaatagcggttgttgcttggtgaacttatcccagtatttaccgttccaatatagcccgtctgggtgtgtgtcattcacaacaataatatggcggcgctccttgatgtcatccacaaacaagttaatgtccggcacccaaacagacaacttacctgacttatcaatatcatgcactaaccaatggggtgacttctcattaagccgtgacttcacatctgccgtcagctcttcccacgtataagaaagttcagggtcaaatggcataccgttataagtggcggtgtcgtcatcaatacgtttaccctttgtctgccaccaacggcgcaatgtcatgtaatcagcaaggcgttccgcttccgtttgcttgcttgtatcatgtttagccacttggtcagctagttcagttgtttcttcgtcatctaataatgtctccattctttcatctccaatctactcaatacgtccaacgattcacccaacttttgtactttgcttttagctcatctgggtcaatcgggtcactacccaatgcgtttacagttgcgacaatatcaccagtcagtttgatgtcaccgtgtgtctgccggtacacccaaccacctacgtctgtcaacatattatcccaaccaccaaatgcttggtaactgttctctgggtcaaacatggctagtaacatctttctagcaacaagtgcatactttggggtgttactaatatcaacaggtgtctgactatgcgcttgtttatccagtggctggtacttgttagggttattgttaaacaactcaatcagcacgtctgtgttcagcccaaccccgtcagtctcaataattggcgtgttagcagcgttctggtcagtcggtacataaataccctgtaactgtgcaaaattactttcagccccccgctggtcagccttaatgcgtgtctgtccagtaacaactagccaagccttgatatagtcgtcttgattcagtggtttatctaactgaataccagcacgcaacctcgtcccgtccttgataccgttgctaatagtcggatagatgacatgattagcgctcatagcgctcaagaaaccagccaagtggttagctacatcttcataggtgccactatcatcaacatcaataaacatcacgctacgttctagcacttcatttttagcgcgctccatattgtcattagcaagtgtcccgtaaagaacataaggggcgttcacctgtttaaaactagccaactgttgctctgtgtgtcggtatgccgttgtcttagggcttgctacgttcccagccaagtgagaaaaatcatcttcatccccaaacaccggcgtgtattctttcttattcagccctttttgctcgtagatcatagttactactccttagttggttagcttcgtcatctgtctctttcaaaatgaacgctgccaaattagtaatacctgcggaacgtgtttctgcgtcatgtaaaatctcgtataatgtcattagtacatctcctttaaaacatccaacatcaaacgcaacacgtacagcttagcttgcttgctaagttcactgtggctcactgtttgactagctaccttgataccagctaagaaaccagcttctaattgcttgctactgttatctaaatcactcatactaaaataggcctctctatttggggatgccgcactggtcttgggtcgccaaactttcaaccagtggacttagtaagtcggttacatgctatgtagccggctttttactttgtcataccaacctaagcaatcaatcgctgtcagtcgttggtcatacctgttagctgacatctgtaagtcactcggtgtcctgattaaaaagaaccgataaccaacacccacggcatagccaactggcacaccaaggtcaataaggtcatttaccgctgtaattacagctttgcgttgctctgtctcactttctgccaacatcaaaccggcatatgtaccaagtgatacccaaccaactggggtactgactgtcccgcgttcaagcgctgcaatcatgctgaccaccgtgtcattatcaagtgtcattaaagttgtttgctccataaattacagtcctttcactgctagatctaactcatctcggttgtatcgttcaaacgcaataccgtacttagccccgctgtgtgccttaaacacacctttgtcagctagtttcttaaacgtcttgtaattcatgtgaacataggcgctcgcttctttttgtgtcatccatggactaggctgaaatgtgtcaagcgattcaatcaccgcctgctttaaaacggtaatcagcttgtcatctgctacaataggtttatccattaaaaagcacttcctttcttttgaatcgcagtgtctgggaggctccgttagttactgaccaaggtaaaggctaacggggctttttgtttgcgctgtgagttgggcgctcatctttatagcaatcagtaagccggcaaaacaaactgacactatgattcaggtatcaaattaagtagtttagtgacttgcttgggtcacattatgtacaccagccaccacatacaaggtgctggcacggtaataactaataaagtttttctttatgtagtttcatgtgtatgtatggggtggctcaaaattgtgctaccccttaaaatcaattcaacccagcttctaacactgtgatgtcagtatttttgttgatgtccaatagtgctgccttaacttctaatagcttgtcactaggcgtcacgtacttatccatgatgttacctaaataagtgtcatggttagcacgggtaactttgctctgctgcattaagatgtcaccgtattccatactgtccaacagttcagcaatcggtaatgattcagctagtaagctaatcactgacaaaatggtttgcttacgccaattttcaccttctctaatcgcgttaggctcatagcgcacgttatccaatgcactacgcaccatatcgactgccgtctgccactgcttgggtgattcagacatggcttcaataaaatcttcattctctgggctttcaaacttacccgtgtacttgttacgcttgatcatctgtcatgctccttaaatcaaatcaacgttgaaaaatgcaccgtgtggcttgctttggtctggcaactcaaccaaaccagcaaatctattgaacttgtaagccgttcctgtaacactggtcagcaccaacttgtacttattagctactgccgtgccgtcatcattcaatactgctgcgtaaacatcaccgttatagtcagttacggtctcaaactcatccccaaatgacttaatcgtttcaatctcgtcatcagtggctagtaccaagccttggcatttattgaatacgtaccagtggttacggctatccaccaagccaagcaaataatctaactgtggttcaacttgataacgcgcccttgggtcactatcaacaaatatgaccattggctgtaagttcgtgtcgctagtcgtctcatcttcaaatggcttgctatcgttccacgggtctaaaccgtcttgtatcatcttcattttttccgtcaattcaagaacttcaccgctcaccatatcaatggctgaaactcgtgacgtgttagcgtcaaaaccagcagcgtctgacaactcttgatatgattcaatcatcaaaccaatagccttgtaacgggcattttctgctgtctctcggtcaatagcttccttatccataatcaatactccttccgccaatcgtggcgtacatctgttataagtggctcgttttttcatccaaaaaaatgcgtcgtgttttacttcgttcaatatctgcaataactagctgttcaatgcgttttaaatcgttctttgtatatgtgtagtcacttgtcaaactatttagaaatgccgtcgtatcgtcaaattcgcttaaacgtccacatataacaccatgctcaattaaaaaagcaccacctcatacttatctgccttaacccgcccttgtgccttaataaattgctcaatctgtacattggcttcggctggtgtgcagtacattgccaaatcttccatgttatattctcctgttaatttaaagaccccaacgcggggcaactgaataaccattagtccaacgggtgcaaccgctgggctatttttttgctgtcatttggctagttctgaaatcagccaatcgttcacagcggtaaacgtcttagcactaaccgttagcggcgtttctgaatctagtaccgttctaaccgtctcccgtgataaaccaagcacatcagataactctgtacgattcaaacgctcttgtccttgctttcgtaacaaggcaatctgttggtctttactaatagtcgctttcataaagccaccgcctttctgtcaaaatgaatgaaacttgcatttttatattctgtcgcattgacagaaaaatgtcaataatctttcttgcaaagtgacagaaatgtgtgttttaattctcctataagcaaagaggggttagttatgaaaaaccgtataaaacaagttcgaaaagaacgaaaagaaacacttcaacaagttgctgacgctgttggtctatccaacggtactattgccaactatgaaaacggaaagcgtgaaccaaacttagaaatatggtcaaaactggccaatcactttggcgttgctgttggttatctacaaggggtagataaaaatttagccaaaccacactatgatgagttccacaaattcatggaatccagtggcgaagatattccaagcgcttttaaactatggcaattacaagaaatcgataacgctcttaatcttgggtatgacccttacaaatttttgaataatgaccaaatctgtgatgctgtacgtactgttgaaagctcctataacatgtggtcaatattgttagatcctgacgaaatcgaaaatattccagattcgtttgacgcaaaacaattagccgcaaactttgcaagactgatagaactgattcacctaacaacaatgtcaaacttaactggtcataaactaagcgacttatccctttcagaacttgatgacatgatagaaaagtttaatgtcgctttatcaagtcacatggaacatgcaagcgtacgtacagaactccgtgaaaacagcacaaaaaaagacgccaaccaatcggatgacgtctgatacacacactactgcgtttatttaattgttacttttattttaacacggctagatttaaccactgattagggatgaaactctgaccatgatgacatctaaccagtgtgacatcccctatttatgtagccaatgctacaccattgctacacttactgtagctaaacaaagctagtcatatcaagggtttataccatttggctacacttgctacacttttttctaacatctataaaaaactttcaagtacatatacactcattggacagccgatacatagaagagttgggcgctcgtcaggtaaaggtattaaacatgagtattaagaaagaatctaatggcacttggttcgtccgtgtgtcataccgtgacagccttggcaagcgtcatgaaaagaaaggacactttccaactaagacactggctagtcagtttgaacgtcaggtaaaggttgctattgataatggtcagtttgaaacggtcaacgtcaacatgacaactaaccaactatttaaccagtggtttgatgactacaagcggtcagtaaagccggtatcatatgccaaggtacagaaactatttgaacatcacatactaacgtcagcatggtttgacggtgtgaaaattaaagacatcaagaaacgtgacattcagcgctgggttaatgcaatggccaaggataacactacctacaagcgacaagtaaactacttcaagaaaatgctggctatggcggtgtctttggaactaatggacagcaacccgtttgacacggtgttatatcccaaggctaaggctaagcccgtttatactgaccgtgtggacttctatgaccgcaaacagttagctgcgttctggtcagctgtacaggataaatacgataaccttgaatcaatgcacaaactggcttatctgcgaactatggcatggactggtatgcgtaacggtgaacttagggctattacatggtcagatgtccacttagacggtgccaacccttatattgatgtcaataagactatgagtgaggttactggccagggtgtggttattgatacacctaagactgacgctggtaagcgtactgtaaagctagatctacgcactgctggttatctaaaaaagtggcgtgctatccaagcacagaaactgatggctaagggacagcaagctgatgttgtctggactaacagaattatgactaagcgtatatcagctaaccaaccacggtcttggctattagctgcaatcaaagggactgacgtgccacctatcaacattcacgggttacggcatacgtacatcacgttatcggtacaggctggtatggacattaaaacgctgcaagcacaggttggtcatgatgatattcagaccacacttaacatctacgcgtctgtcactgatgaaatgcgcgcaaatacggctgaaacgttcacatcattggtaaacttctaacaacaacacaaaacgcccttatacagtctgctatggcttgtacaagggcgtttattattttgagttcagtacaccgctcggtacaccggcaagtacaccagcggttagaactctatgaaatcttatacaatttagtggtgtaccggttggtgtacttcataagaaaaaccctgatatatcaagctcaaacgcccgtatatcaaggtttaacaaatcgtataactgggcatactggattcgaaccagtgcatgacggtaccagaaaccgttgccttaccgcttggctaatgcccaaaaatcaacttctatatgatacaacaaccagccgatgaattcaagcctcaaaaatagcaaaaagccccgcgtatccgcggagcatttaatttcagtggtgagaagccactgtttatttcttaacgtaaattaagataaagagaaaagagttttacgtggtctaatagagagagagaaaccacggttcatctctgaacacttactatcctaccgcaatacttagctaaacaacgaaaagtaccaaaaatgatgcaaaaccacccctttttataaaaaagccggacaaatccccctctgatttgtccggcatctcatgctattactctaagtttcgtgcttttactttcgccttcgtctttgaaactaccttatcgtcgaactgacgaataaacgccaatactttgtgtgctttgtcttccccaaaagactccacccagccatcaaagcgattttcgacgcgtttcgtcacaattcgctcgacatccgcgcccgcttcagttaaatgtagcaacatgcggcgacgatccatttcatcaggttcttgataaatgaattctttcttcaacagcatcttaatttgacgtgatacggctgcccgcgtaacatgtcgtcgttcaacgacatccgttagcgttaacccatcttgatcagcgatgctatgcataatcaaatattgttcgaacgacaacccataatcagctgccggttccgaaacaacttcgtctaaatacttcagcgttgataaatacgcatcgatatactgacttaacagttccatcattaccctccacaaaatatcccaaagttatataacgctaaccattgtacagtaaaccacaagccttgtcagccggaaaaggaacctaattcagaccgtcagaataccaaaaaagcaccttaacaattcagttaaagtgctttttatatacctttaaaattagcgaacaatcatgaccgttacaggggcattatttgccacataactagattgtgagccaaaatacttttccgcgcctcgttgtgagtgtgacccaatcacaaccatatccggcttgactgatggaatgacatccttaacaatcacctcaccaggctcgccttcagcgaataccgtgtcaacatgaccaacaccggcatcaactgccgtttgtcggtaacgtttaagcgcctcttcaacgtcctcacgtgctgcagcgttcttttcctttgaaaagtaatcaaagacgttcatctgttcggcctcaaagacagaaacaatcgtcagttctgaatcatcttcttgcgcttggtgaatagcgttaactaatgcgagttgacccaactttgaatcatcaacagccgccaacactcgtttaaaatgctttgcctctaccatgaactcgtcctccttttaattaaacaatggtgccaacgtcgacacaatcaattggatattcaatcccgtcaagattaccgacacagcataccccagaacagttgcccaacgtgggttaacaaactcgcccatgaacttcttcgatgacgtgaagtaaatcaatgggaacattgagaacggcaaagccactgacaagaatacttgtgagtaaaccaaaagacgatctaaggccccttcagttgcaccgaagataatggcaaaaatcacaattggaaccagcgcaataccacgcgtcaaaattcgttgtagccacattggcatccgccagtgagtataaccttccatgataatttgaccagtcaaggtacccgtaatggttgagttttgacctgacgccaacaacgcaatagcgaacagcatactcaagacaggactcgcaattgcaccaacaatcgctttatcgttaagggcattaaacaaatcaccaaaggcttcaagctctgaaccgtggccgaagaacaaggccgcacccacaatcaacaataatgagttaacaacaaacgcacccgttaattgaatgtttgagtcccacgttgtgaaacgaatcgcttcagcaatgttcttcttctcgctccgatcaacctttcgcgtttgcgaaattgatgagtggagatacaagttgtgcggcataaccgtcgcacccacaattcccaacgccaacatcaattgaccatgcttcagaatatcgtggtgtggtaccaagtttaccgcaacctgccccatatctggctttgctaggaacgccatgtataggaatacaagtagaattacgataatcagggtcaagacaatcccttcaatcttacggaacccgagcttcattaggagcaagagtagcaaaacatccagtgccgtgataatcacaccccacaaaagtggcaaaccgaacagcaagtggatggcaatcgctgcaccgataacttcggccatttcagttgccataatcgccaattccgtcataaaccaaaggatgtatccgatccatttattcgtggaatcacgcgtcatttgggccagatctttctgagccacaatccctagtttagccgccatatattgcaacaacatcgcaattaaactagatactaagatcacagaaatcaataggtatcgatactgtgccccaccgacaattgacgtaatccagttacctgggtccatgtaaccaacggcaaccaatgcccctggtccactccacgccatcaacttccgcaaaaatccgccgccttgtggaacttccactgtgctgttgatttccgccaaacttggaccatcagtcgcttgtgcgtttgcaactgacggatcctttactgaatcttttgccatcagtaaatatgcctccttgttttttggtacgtttaattatcttactttacgtatattttgtaaacaatgaaagcccgtgatatcaacgttcgatcgccatacccaaaataggaaaaaagcgcccgtcacttgacaactatcaaaaaataatgtaatttagaacagttgaaaaaataatcgattattaaacactgcctttcttttctgacacggcggtgtaagggaggataaaaatatggcagttcctgcacgtaagacttcaaagaacgcaaagcgctcacgtcgcggtggtcaaggcggacttaagacgcctgctatccacatgaacgaaaacggtgtttacgtacgtaaccaccacgtggccgctgatggttcatacaagggtaagcaagttgtttcacctaagtaattagaaaagactactaggattcgtcctagtagtctttttttatgcctttcacccactgcttgacgcgttgccaagcaccacttgcgttcggttgcgcatccaactcccgtgtcgcatcctgtaagacgttctccaccatttcatacacctcatggacaccaggaccaatcacaacttgatattgaccaaggagcgcattaaagacctctcccgccacgccatcaatcgcgaccagccgaggcgaatcaaccttgctaggatcaactaaataaaaacgcaatcgtgtcacgcaatgaatcacccgttcaatattcgttgcaccgccaacagcttggataatttgttcggcttgcttccgttccagactaaccaccatcatcaccccctttactcgtattttaccgccaattacgcaaaaaaacagttatctcaaattgagataactgcttttttgtttaactcacattacatgtcttgctcaaaatcagcaggcgtgtacaacttaaagacctttgtaaacaatatgtcgactacgaaaccagcaacagctggcacaatcaaccaagtcaacaaggctgggaaagcaccaatcgtgtgcgttacgatatctcgttcagcaccatcagcaatcattgattgaattggtgaaaccattccaatccaaccgaaaccagctgatgtaggcgttccttgtacgttaaagatggccactgggatagctgagatagctgctgcaaccaagaagctcaaaatcataattggcttcttgaagattgctggcatcatacccttcatcgcacccaggaagatggcaaccgtcgttcccttcttgttaaccttccatgagttgatcaacaagataactgttgtggcaacaacaccagcaccggcagcaccagcacccaaacctgacaaggcgattgccaaagcaattccaaccgttgagataggcgtgatgatgatgaatgagaaggccatcgcaatggcaattgacattggcaatggttgcaagtcagttgccaaacgcacagcatcaccaacccaagtcgtgatgtaagcaacgtatggggcaattgccttaccaaacaacgccacaccaccaccaataacaattgggctcaagataattgctaccgcaccaaagccctttaggtactttgatactaaccagataaccaacacggcaactgcggcgacaatgatagcgttaatcacgtcaccggcaccggctgcgatgtacacgttagcaggtgctgtcaacttaacgcccgtcactgggtttacgaagccagcaggtgccatggcccactttacagaaccagcagatgcaccaaccgcaatcgccatcacacccgcatcaagtgccttcatgcggaattgcatggcaatcgcaagaccaatcagcactggaatgaacgatgagaacatcgtcaaaatcgctgaaaaatcaagcgcccattgcgccgttccgaacatcttcaagatgtacttcattacagcagatggcaaaacaccaatcaagataccttgggcagaacctgaaagcaccttgaagaagaaatccttcaacttcagctcgtatgagccgtcaaaaaattcgctcgtcataatattcaattaacctttcaaaccaaaaactcaattcccaacaaattctcgaaaaccgctgattctcacaacagacggcatttcatttggagaggattataaaaatgaataattacttacaaaaagtaagttatcacaattagtattcaactgcaatagctggagtttcaccattaataaatgccaatgaagcatccattgattggtgaaccatttcaagcacagcctttgttgtgtagaaagccgtgtgaggcgtaaccaagacgttctcacgggcaatcaagtcagcaatcttagcgtctgggaattccttatctgaccagtcgacgttaaacaaaccaacttcttcttcgtaaacgtccattgcaaagtctgaaatcttacctgaatccaaaccagcaataactgcgtcgatatccatcaagttaccgcgtgaaacgttaaccaagacaacgccgtccttcatctttgcaattgactctgcgttgatcatgtggtggttagctggtacacctggtacgtacaatgaaataacgtctgcttgtgcgtacaactcatccaacgtatcaacgtaaatgccttctgcttccaactctgcattgcggtacaaatcgtatgcaattaccttggcgccgaagcccttcaagatgttaatcgcaacacgaccaatgtgaccagtaccgataacaccaaccgtttgcatgcgtacttcacgtccaattgttggtgcccaacgcaagtcatggttcgcaatcttggcgtccaatgcctttgcacgacgcaacaaacgtgacatttgaatcattgagtgctcagcaatggcgtttggtgagtaaacaggcacgtttgaaattgaaaaatcaaattcgcgagcagcatcgaaatcaatgttatccgtgccaacgttacgcaatgacatcttgttgatgcccaattcgtgcaatgccgtcaacgtctcacgtgtgtagtccaattgttggtagacgttaactgcgtcagcaccttctgccaacttagccgtctcaggatccaacaacttgtcagtgtacccaacttcaacttccgggtgagcggcaatccactcgttcaatgatggcttttcgtcttcacgaataccgtatgcaaaaatcttcataactaaaatcctccaaagcgtttcttaacacttattcattataaggtaacttgtgaataagtcaacatactttcccaaactagtttcacatagttttgtcccatttggacaaacttcgggccaaaacacccaccaatgttacagcaacatgtcaaacggcgtatctttagggccctttttcgctgcataaaagttcacaaatttcacgaataattcacatttggccctaaaaaacggtcaaaaaccaccaaaactccaacttatcggaatgcgtggtgttgatctaagaaaaaaacatgccccaaacgacgacattcaggacatgtttatgacaaatattaacgagttacttacgatcgtcagcgttcttcatgatcttatcaaccagaccatattcaagtgattcttccgcatcaaaccagtggtcacgttccgtatcacgttcaagacgctcgtatgggttatctgtgtttgcagccaagatttcgttcaacttcttacgcgtcttcaaaatctcttcagcagcaatcgcgatttcagtttgttgaccttgtgcaccaccagatggttggtgaatcataaactgagagttaggtagcataaagcgcttgccctttgctcctgatgaagccaagactgacgccattgaagcagccaagccgataacaatcgtttgtacgtcggcgtggatgaagttcatagtgtcatagatggccataccggcattaacttctccaccaggagagttaatgtacatgtaaatatccttatctggatcttgtgcatccaagaatagcaattgggcaataattgccgttgccatttgtgattcaattggtccactgaccatgataatacggtcaatcaacaaacgtgagtaaatgtcgtaagaacgttcaccacgtgatgattgctcaataacgtatggaattgggttcattttttaatttcctcctgatgttcaaatcagaacatatctatattttagacatttcgtcaaacatggtcaaacaaaaagaagccttctagttgattcctttaggaagtgcccccgtcgtccgtaaatcatcagccatcttcgagagtttacgcagacggtgattaacccctgacttagaaatttcaccagacggcacgtactgaccaagttccgacaatgggtcttcacgatgggcaagccgcacctcggcaatttcacgtaacttttcaggcagacgagctaagccaatttcttcatctaaaaattcaatatcatcaatctgcttttggctggcgttaaccgtcttatccaaattagcattttctgcattaactaatcgattaacagaattacgcatatcccgtagaatacgcacgtcttccattttaagcatggcattagtagccccaatcaccattaacatatcaccgattttttcagcctcttttagataaacaatgtagcctgaccggcgatcaacgactttagcatttaaatcaaaccgattcatcaagccttccaattggtgagcttgttcttcatacaatgagtaaatctctaagtgataccgacttgtttctggattattaactgatccagccgctaaaaacgccccacgcaaataagaacgtgctttgccttcatcagctagccaatcgtctggtaccgttggcaacaattcaaagtcttcaaaaatgtgcaaatcatctagcaattcattgacaccttgcacaattcgaacgacatacagattattcttcttcagtttcatctgacgtcggaccgaaatttctgaaggcaactggtagaactgttggagcaaccccagaatccgtcgggctgtcgctgcattctctgtttgtacattcagcgtaaaccgcatgtttgctagtcctagcgaaccattcattcgcaacaatgctgacaattcagccttcgcattatctggattgttaatctcaagcattgttaattcttttttcacatcacttgcaaatgacacagtttacacctcctttttatatttcgggcgagttcgcaatttgcatgattaattgggccacaatatcaccattgtgaaaggcgccatcatcccgtaactctaacaaatcgcccaagacaggcaccgcaccttcttgtcgaacctcttccggatcaaacgttacctggtgcgagacctcgttccacttcttccagtcaatataatcttctggcacgacgccagtattcataatcacggcatcgacgacgttatcacccacgtgtcgattaatcgcgcgtaggtgatcagcatctgaaaaatcatcagtttcacccttttgcgtcatgatgttcgcaatgtaaaccacttttgctcgggtcgcctttaatgcttcagcgacattgggaaccattaagtttggcaagacactcgtaaacaagcttcccggtcctaaaacaatcacgtctgcgttcaaaatggcgttaatgacctctgatggcgcttgcgcaacttcattcgtcgaatcatcttgcggtgtcacccaaatactatcaatccgcttgtgggcagctgtaatttcagcttcaccagacaaagttgtgccatctgaaaatgtggcatgtaacaccagtggctcatccgctaccggatacacatgtccctgtacgtccatgacttttgcaagcgtctggacacctgtaaaaatatcacgttccttctctgccatcgccgcaatgatcaagttccccaacgcgtgattcgctagcatttcatcctctttgcgaaaacggtattgaaaaatatcaataatttcttgtggcaaactcgataaaacggccatcacatttcgaatatcaccaggcggtaccatattgagataatcccgcaacgtcccagaagaaccaccatcatcagccaccgtaataacggcagttaaatcagtatcatactgcttcaacccccgcaaaatcaccggttgaccggaaccaccgccaatgacaacaatctttggccgtgttgttactttaaaggcctctgtcatgagcgattactgctttctttacgccgctcaatgtcacggtggtattcgtttaccttccaatcagctgccaaatcctgactcaagcggtgcgcaaacgccactgaccggtgttgaccaccagtgcaaccaaaggcaatcgttagtgtacttttaccttcagccttatactttggtaacaaccacttaatcaaactactttgacgctcataaaactcttcggcatcttcgcttgaccaaacataatcccaaactgctttatccaagcccgtttgttcacgcaaagccgtaatgtagtagggattctttaaaaagcgcacatcaataatcaagtcagcatcgactggtacaccatatttaaagccgaagctcatcacttgcacagaaaaagtgcccgcacgatcagcatccgacccgaaatgttcttgaatatagttacgcaattgacgaggagcgaaatcatctgtatgaatcacttcgctcgccatatcatgaatttctgttagttgttgacgttcagtttgaataccgtacaacgtgccccggtcacctgacaaggggtgcgaacgacgggtttccttatagcgggccaccaattcttcatccgtcgcatcgatatacacaatcttcaaatcatacttatcatgatttgaatccgacataatgcgaatctcgtcatctaggtcagcgaaaaagctttgtgaccgcaagtcaatcatcacggctgcccgctgaatgttttcttcgtcagaaatcatttgccaaaactttggcaacatagcaggtggcaggttttgaacagtaaagtagccaagatcttcaaaggcttgaatagcaactgttttaccagcgccactcatccccgtaacgatgaccaattcttttttaggcatacgcgttccctccgaacatataatgtgtctaggctattataccattgagaggaaacgcccggctatgtggtttttgtgaacccttagcagatataaaaaaactccctagatagctgatttcagctttctagggagtttttacataacgccaagaattacttcttgttgttcgctgccttacgtgcatcgtgcaatgccttcaatgcgcgcttgcgagtcttaatgtttgggctcttcatcttacgacgagctgatgccacatccaacttttcagccatgatgtttacctcactttttagtctttattttctttaaaaatatcacttacaaaaaggaagtatacacgcatcaagctgcgaacgcaactaaaaaggccaactgtaacatgcacttaatctttactttgctgtcgctgcagccgcacgttcgcggtcacgcgtcataattggtccaagatattgacctgtatacgaagctgacacagcagcgatatcctctggcgtaccggttgcaagcaccgttccaccaccttcaccaccttctggccccatatcaatcagccagtcagcggtcttgataacatccaaattgtgttcgataaccaaaacggtgttaccaccatcaactaggcgttgtaacacttcaagcaagcgtgaaatatcatcaacgtgcaaaccagtggttggttcatccaaaatgtagaatgtcttacccgttgacttacgttgcaattctgacgctaacttcatacgttgtgcttcaccaccagacaacgtcgtcgctgattgaccaagcgtcacataacccaacccaacatcaacaatcgtttgcaacttacgacgaatcttaggaattggtgcaaagaagtcaacggcttgtgcggctgtcaaattcaaaacatctgcgattgtcaaaccgcggtatgttacttcaagcgtttctgagttgtaacgagtaccaccacaaacttcacatgtcacgtaaacatcggggaggaagttcatctcaatcttgatgacgccatcacccttacatgcctcacaacgaccgcccttcgtgttaaatgagaaacgacctttgttatagccacgtagcttagcttcatttgtctgcgcaaatagcgtgcgaatatcatcaaagacgcccgtatacgtcgctgggtttgaacgtggcgtacgcccgattggactttgatcaatatcaacaatcttgtcgacattctcaaagccggtcatcttcttgtacttaccaggcttttcagagttgttgtttaactccatcttcaacgctcgcttcaagattgtgttcaccagcgttgattttccggaaccagaaacaccggtcacggcgacaaacttacccaaggggaagtcaaccttcacgtttttcaagttgttttccgatgcaccggtaatcgtaatctttttaccattaccctcacgtcgcgtttcaggaactggaataaacttcttgcctgataggtattgtcccgttagcgagttgtcatttgcttcgatttccgccggggtacccgtcgccatgatctcaccaccgtggtcaccagcccctggccccacgtcgatgatgtagtcggccgctttcatcgtatcttcgtcgtgttcaacgacaatcaacgtgttacctaaatcacgcatctgcttcaacgaattaatcaaacggtcattatcacgttggtgcaacccaattgacggctcgtccaaaacgtacatcacacccgaaaggtttgacccgatttgcgttgccaaacgaattcgttgtgcctcaccacctgataacgttcgcgctgaacgagagagcgttagataatctagcccaacgttcttcaagaagctcaggcgatccgtaatttccttaacgatgggcgctgcaatctgactgtcttgctcaccaaacgtcacgttttcaaagaattctaattccttatcaaccggcatttctgacacttgaccgatgtgcttatcaccgaccttaaccgacaaagcagccgggttcaaacggtatccgccacaagcgttgcaagtcaattcgtccatgtaaccacgcatttgttcacgggtaaaatcagaatttgattcacggtagcgacggtcgatgttattcatcaccccttcgaatgggacgtcaacatcacgtaccccaccaaaatcattctcatagtggaagtggaatggcttcaaacgtgagccatatagcaccatgtcttgttgatcagctgtcaattcttcaaatgggatgtccattggaattccaaattgctcagcaaattggcgcaacatttctgggtagtatgatgatgaaattgggttccaggccacaatggcaccgtcagccaatgactttgacttatcaggaataactcggtcaacatcgacctcaagtgtcatccccaagcccccacagatttcacacgctcccataggtgcgttgaatgaaaagagctgtggttccagcttaccaaccgcaaagtccttcaacggaccggtgtagtgatctgagaacgtaattggttcaccaccaatcacatcaactgtcacgaccccttcggccatgcgcattgctgattcaaatgattcgaacaaacgcgcgcgtgaaccatcccgcaaaataatacgatcaaccacaattgaaatatcgtgatacttgttcttgtccaacgtcagctcatcggtgatttcatgcatctcaccatcaaccatgacacgaacaaaaccttctttttgaatacgttcaaaagccgtcgcatgcgaaccacgcttatgacgaacaattggtgataggatttgcatccgcgccccttcatccaagttctccgtcaaataattcaacatttggtcaattgacgtcttcacgattgtgccatcttcggccgcgtcgggctgtccaacacgagcaaataatagtcgataatagtcgttaatctcggttaccgtccccaccgttgagcggggattttttgaggtcgtcttttgatcgatagagatagcaggacttaatccttcaatggcatctacatccggcttatccatttgtcctaagaattgacgggcataggcagacaagctttcaacataacgtctctgtccttctgcatatagcgtgtcaaaggcaagtgaactcttaccagaaccagagagtccggtcatcaccacgaatttgtcacggggaatcgccacgtccacatttttcaaattgtgagcgcgcgcgccgtgaatattgatccaatcattggccatttcgggcggcctccttcatgtgtttttagttagtgttattatacccctaaacgcaagtgaggtgttagttataacctaacacctcacttgctttcttaaattaaattcaacttagcttattctgaataaggcgcgttatgcttcaaaaagcggttaaaccatacgaaattcagcacacccaatgccaacataaaccaaaagacatgctgggcaccgcgcgctgtttgtgttgcaacggaggcagcactgtcgggattcaccttcattaacaatgacgccaccgttgttccgatggcgccggcaaactgctgcgccgtgttaaaaatcgcgttaccatcggcacgttcgggcaatgataactgcgctagcccagcggtcatcgacgtaccaaaggctagattccggccgagcgtcatcaacaagtaaaagattgtcattgagataactgtgccattcatcgtcatcatcgaccaaaccatcataatcacaacaaacgctgcattacctgccaacaagggcatctttggtccgtacacatcatactcacgcccataaattgggttcaatagcgccccagccaacgaccccggcatcaaggcaaagccggcaatcatcgttgttgctcccaaggatagttggacaaatgtcggtacggcaaaattaaccatcaaattggtaaacatgtatgcaacgtaccccaacatcgcaaaacgcaacgcaggcactttaaaaatacctaagtttaaaaattggcgcgtcgcatgcttagctcggtataagaagccagcaaatgctaaagcagcaacaatcagcaaaccaaagagcatcccactaacatgtccatgttctagctgacttaatgcccacaagaaactggtaaaggcaatggccaacatcgcaaagctcacataatcaaagcggaatgcgtcatttttaatatgctccgttggcactgtcttaattgaaataaccagcgagacaaacgcaactggtaacaccaataagaaaatttcgcgccaacctaagtagtaggccacgacaccaccaaaaatcggtccaaaggctggtgccaacgataaaatcatcgtaccaaagcccatatacttaccaatatgagccatcggaacattttcaagaataatattgaagaccaatggcgtaatgacgcctgtcccaatcccttgaatcacacggccaactaacagaagcgcgaaggaatgcgacataatcgccacgatgtccccaatcaagaacgccacaattgcgatgataaaaatttgccgtggattgaattttgcttttaagaacgctgaagtagtcatcaccaatgacaccattagcaaataggccgtagtcagccattgcaccacactcagcgaaatattaaattgcttcatcaaatccggaaaggtcacgttcatggatgtctctgttaaaatacccgtaaacgctaaaatccccgtccccacaattgcccaaataatctgcggactaaccgtttgatccgtttttgccatacatcactcacccctattatttcaatatccctagtttcccacaaaccaatacccacaacaacactaaattaacgtataatggggactagttattattcacttggaggtcgctattcatgaatcataaggcagcaaaagcctggtcaatcacttggattgcgcaacacgttgcttcattcatcctgcttgccggcgcggtactggccgcggcgattgcattgactgcattgattattgcggtcgaagaaatcgtggcgttgattacgatgcaacacttaatcaatacatacacaaacatttacggtaacgcctgggcaacggtcttctggcactttattgttgtcttctcgttggttgctttctggtcagccctagacacgtttgttcctgaaccaaaaacagaagcttaattaaaaacggtcacaccgcacaattcatcgtgttgggtgtgaccgtttttaattaagctttcttaggcagaataatcgtcgctgctgttaacatcgttgctagtccaagcagtaagccagctagcacatcgcttggatagtgcacacccaagtaaacgcgactaattgggattaagatgatgactgcaaccaaaacgattgttgcaaccccctttacccattgtttacgtgcatatagccaaatcaataccaacaaagccccataaaacgccatagcattaatggaatggcctgatggaaatgaatacccatgttcggtaatcaaccggtttgcggtcggccgtggccgttggacaatgtttttaataatccacattaaaccagcccccgcaaccacactgaagcccacaaacgcccccatacgaaggcgtttggtgataactgtccacacaacaaacagtgccgtcagagtaacccccgtcgctggctgggccaacagcgtaatgccggtcaagaaggcggttttgccaggtgtaaaatcacctcgaatccaagcaataccagtgcgatcaatgtctgaaatccatgttgcatgttgcatgacgccccacgcaaaaaaagcaaacagcagtatcactaagccactaattggcattgttaatcgtttattcaaaatgaccacatcctctaaaaaaatttgggcgatgcagtctgatgttgcattgctgcaacctgtcgtatctgtagctcacgtggtggcacaaattgattacccgccaagatggcttcaccaacttgctgtaatgcaatgcgttgccccaatggcgcaagcgccggtaattgtgccaattctgttgccgtatttaaacggtgaatcaggtaattaccaaattgtcccaacaacccagccggcaaatcaagcggactttgtgtcgttaacatcaaatacaagcccgctttacgtccttcacgtgcaacccgcaaaatgccgtccactacaccagattgttgcaacaaataacggtgtgcttcatcaatcaacaccgttacgggcaactgttgtgtgcctgtttgcttgatacgtagcaacgccgtcatcaatagtgacacaacaaccttacctaaacctaaattatccgctaattctgacaaatcaatgaccagaattttttgttcgctccgttgactgctaaacaaccgcatcaaatacattacatcagtcctcatccccaccgtcgcaattttcttacgacttggcaaattgaataactgctggaaagctggttgacttgtttgacttttaatgcgacgaattagtggcaacagcgtccgaaaaccagcttgatcaattgtctgaccaatcaaatcaaaatcatctgttggcacagcaaattcttgctgcaactgttctggcagcaaatgcatatcggccggttgcggatagtcatacaatcgctgggcatccgcctcaaacgttgcccaaggacggttaaccttttgatagatccctgactgacggacaacgttcttttggattttcaagctttgccaagcatctaccactttctctgtcgccaccgcctccgtgacgccaaatatttgcgcgatttcggcacccgttagttgttcataatcaataaaagcgttgtagcctaatttcgcaacgacggcgtgtggcaactttgtgtactcgccagttggatcgataataatcgtcgtttggttctgcatcatcaagtcatgcaaaattgtcaccgcactcgtcgacttgccactaccagtcgctcctagaattagcagatgttgtcgcaacaaatcatctggcgttaccgcaaaattatcagtcaacgcaatcatcgtgatgaaatcccccattcgttcctatctgttctttagtataccaacaaatggactaagaaatccccattaccacagccgtatatggggccatcgtaatacgatgccctgtcatcgtgacttcacccgattgcgtcagcacctcaccaatttgaatcagactaaatcgtgatgattgcacactcaaattaaccaacacggtaatcagccggtcacctaagcgccgttggtacgcgatgacatcagccggcaagcgtgttaatggatggaaggtgccatcaataatcacatcatgccattgtggctgacgacgcactttggccagaccacggtaatagtttaagaccgacgctgggtcttgctcctcggttgcaacattaatatcagcccgatgctcccccattggcaaccatggttcaacttctgaaaagccaccaaacgcttcaccagtccattgcatcggcgtgcgggcattatcccgtgactttgcatttaaccattgcagtgcttcggcctctgagaaaccatcacgcagtgccatttcatagttattcaaagatgagacatcattgaattctgaaatatgccggcgttcaaaatttttcatccccagttcttgtccctggtaaataaatggcacacctggtaggaaataatacattgtcgctaaacttttagctgcgacagctgtttgataagcgacatttggcactagttttgataagacgcgtggctgatcatggttttccaacacgttgcccaaatacccttcaattgcttgtacttgttgttgcgattcaaagagcaaatcacgtaaatcactggtggtccatgccgaccgaccgcggtaccattcatcaacattttcaacttcaatattcatgtacgaaaaatcgaaaatcattgaaaaataaccatccggtccaatgtactgatgtaagtcttgttgcggtacgccatatgcttcaccaatcgttacggcatcatacttagcgaacgtttccgctttcagctcacttagaaagcgttcaattcctggccgattttgccccttcttcgtcaccgaggccaacccatcgctaccgtcagccggtaaactcgcccaatccaaatccttttttaaatgcgtaatcgcatcaatgcgaaagccggcgacacctaggtctaaccaccagttaaccatgtcatagattgcccggcgcagtgctggattttcccaattcaaatccggttgttccgacgcaaaggtatgaaaataataagtgcctggctcattcggtactggcgtccatgttgagccgccaaaaatactgcgccaattattcggtaccgtgccgtctgttgtggtcttaaaaatataaaactcacgatatggactcgctggatctgctaatgcttgtttgaaccaagtatgttgatccgatgtatgattgaccactaaatccattacgattttaatctgccgttcacttgccgccgttagtagcgccttaaaatctgtcagcgacccaaactgcgggtcgatatcttgataatctgaaatgtcataacccatatcaaccatgggcgacttatagaccggcgatagccaaattgttgtaattcctaacgattggatatagtctagttggctaatcacgccctgaatatcgccaatgccatcatgattactatcttgaaaggaacggggataaatttgatagaccacttcgtcttgccaccagtgtcgttgtgccattactgtgtcctcctcttaactacgcgtgttcttaccgccaatataccgaattgtttcctagtcgtgcaaagaattgctcttgataatgatagcgtttgcataaattgctttttagtgagacagtatggttatcaaatgaaagtgaggttacatcaaatggttaacattccaacactaactttaaatgacggacatccactccctgttatgggattaggaacataccagatacgtggtggcgctggtcgtcaacaaattctggcagctattaaaagcggttaccgtttaatcgattctgcaacaaactacgacaacgaaggtattgttggtgaagccattcgccaatctggcgtaccacgcagtgaattattcatcacctcaaagttgcccggtaaatatcacggttacgatgatgctttgatggccattcaagaatcgctagctcgcatggggttggattactttgacctgttcattattcactggccactcccaaagcgcgataaatacgttgaagcttggcaagcgttggttacagcccagaagcttggtttgattcgttcaatcggggtttcaaacttcgaaccggaacacttggaccgtattattgatgcaaccggcgtcaagccagccgtgaaccaaattgaaattcatccttactgggtgcaaacggataacgtccaagcaaatattgatcgtggcataacggttgaagcttggagtccgcttggtcgtggtggtggcgccatgcgcgaaccagtcgttcaagcaattgctgacaagtacggcaagacgccaagtcaaattatcacccgttggcatatcgaccgcggcattgtcccaattttgcgttcaaccaacccggttcaccaacgcgataatgcgacgatctttgatttcaagctgactgctgaagaaattgacacgattaaccagctaaatcgtgccgatggccgtattgacgggcaggatcctaacgagtacgaagaatttgaatagttaaaaaggccgccaatcatctgattacatcaggagattggcggcctttttcgcacactagtttctataaaattttaaaccagactaagaagccccatgcaattcctaatccggccagaccaccgacaacgctggcaaccgtatcaagcgttgaccacgttttagcagcggttgccggttggctcacggccctggtacgagtcgttgcttgcgtcggctgccgtgttgtcacacggtcagcagcttgagcttgtgacgctacaggcacggtttgaccacgctggattggttgcaccgctgcactcgtcggtaccgttgcctcaatttgtgttggttgcgtccttgacggcgccgccacagcactaaccgcttggctccccgccagacttggcacactagttgcgacgctatttggtgctacggtttgcgatgcgactaccgatggcaaggtttgcgtgattgctggtgtcgtatcaatcacctcactagctgacgttgcctgactagcagccaccaatgtgacgccccgcttgccggctaacgttgagcgttctgctgacgaagccacttcctgtgttgccgcagagtgcttagtccgcgtctgggtcgtcatcgatgagctttggtgtatgagagaagcctggctgctaaactgctgcgacgaatgagactgcttactcgttagcgcctgacttgattttgtatgtgacgtcgcttggctcatacttgatgactgtgaactggcttggctagactggggcgcctgtgagctagccgctaccgaaccgggtaatgtcaccgttggttggctgtccggaatacccgttaccttaaaggcgacatcataacgatgattatagccaatactagcaatattcacatgcatattttccataaagtacggattcgcaacttgcgctggcgttagatgaaactttgtcgtcattaaggttgccacaccaaccgtcttcgttgatagtcgctcaccatccttaaaagtcacactatcatccccataagcacttggcacactgacattgacatacaagtagccaccaccgttaccatcagcttcaaacgtcgcatctggttggacatagttactggcaaccgatgttaattgactgccgtcacctttcagtacggctagtttcactgcaatccgttgtgattctggtgtggttgtctcaactgcctgctcaaacgattgcgtaatcgttccagagaagcgctgactgttccccgttgccgctgcgttatcccacgccaaataaccagtcgcaccagctgtgaccccggtaaatgtgacctggtcatccgttactgttgcgttagtatctgcttgtggggtaattgcgaccgacgtgccgtcaattgctttagcagtaacgggtacggtgacctccgtctgccctgcactaaccgcagccgctggcaacgtgattgactgttgctttgcattcacataggttaaccctgtcatcttagctaaaggcgtcaaatcccgtacatgattacgcagcaagttcacataagtcaaattcgttaagcccgcgattggttgtagcgtggtcacttgcgcatttgagaaattcaaactcgtcaacgacgtcagatgctgcagtggcgttaaatcggcgacttgatctttgctaaagttcaaactcgtcaatttcgttaactgctgcaacgcggtcaaacttgtgatttgatcattaaaatcaattgataaatccgtcaaatctggcattgccgcaaatgttggcatcatcgcatccgttaagcccatctgtgagaacgttccctgttgcaacttcgtcagagtgcttaacatgctgatatcgctgctacgattattaccaattgaaagcgtggtcaaattcgttagtttggcaattggtgtaaaatcagtaatttgattcgaaccaacctttaatgacgttaattgtgtcaaaggtgccaatgcactaacatctgttagtttgttacctgccaaacctaattcacgcagttgatgcaaattgcctagttcgggcacactggttactttcgtattctgcatttcaagtgatgttagcgtcgtcatctgattaagcgccgctaacttttcaggaaccaacccataatcgtctgcaactaagttcaaacttttaatcggtgtactcgttaaaggcgttaaatcaggtaagacggtcgctttattcatccgcaagctaacatcctgcaacttaggcagcttggctaacgcactaatgtctgaaatcgcattccccgttaagtcaatgatgctgagattagtggcgtattccaaaccagttaagtccgtgatgccatcataagtcaaattcaattgctgaatttgagcaacattgcttttagtcattggtacatcggcacccaacgcactttgtagtgcttgacgcagcgctgcatctggtacccagtcagatgcagcatcagttgccatagcaatattgtcagtcgcatatgttggcgtagacataatcgtcatgccacctaacacactactaaatagcaaaccaccaatcattgccgtccgctttatattcataagattctcttacctacacattctaggtcagcacgttcatagctgacattaaattagtcctacttttaggagtgtacaggaatacttaccaataaacaatgttttcacaaacttatttggccaaaatcgtcgccactcgtttttgaagtgccggcacaaccgtggcttcaaaccatggattcttcgccagccaaatattgttcagtggggatgggtgagccaacggaaaatacttagggccaaaatctgcaaagcgtttcacaatcgacgttaaggtttcgctggatttgacgtctaaataatacttttgtgaataaccgccaagcagcaaaatcaggtcaatctttggcatcgtcgccatgatccgttgatgccattcctgcgccacaaatttacgtggtggcaaatcacccgttttcgctttacctggataataaaaatccattggcaaaacaccaattaggcccgaatcataaaatacatcacgatcaatgcccatccactctctcagtcggtcgccactcttatcattgaacgatacccccgtctgttcaaccttcaatcctggcgcttgcccaatgattaaaatccggacatcttgcccgaccatgtaaattggttcaagacctcgctcagtgaatgattgattccgtgggtcagccataatctctgcttttaagtccatttccccgcctccttattactgctatcatagcaaacaaaagcaaaacgctcacaccaattaatttcagtgcgagcgttttattaggcattcaattttactaacacgaccagccaaagtactaacataacgccaaaaagtatatctagcagcgtccaaaactttgtttgctgtttacgtgtcatcatcagcgctatccagaccaccactgtcaccacgaataacgtcacaattgctgacatcgtcccacctcctcatcataaaccgtaccccataaacttatgatacacttggtcgccttgcgcactcaatgcctcgtcgttgtcacttgtaaacgtcacctaaaaataaattgaaaatgaaataagacttcattaaatcaacgttatataatatacgtcatgtatacaatactgtttcatcagattgccacattaacaattcaaggaggtaatcatgcaattcactgactctgacattcaaatttttcaagcattcgctaaagtcgcccaacgtaccgcatcattttctgatattacaatcaaagcgattgctgatgaggtcggcatctcacgccaggccatgtatcaaagccattttcgcaataccgacgagctattaacatcgttgtattactatgttgatcaagatattcaggatgaaattaaagcggttgtcacagatcgggctggtagtccatctatcattcatcacttggtttatgctgtattaccactgatttatgacaaacgtggcttctttcaaatcctttattctgataaaatcaattccacttggaacggctttatggaagaccgttacagtgatttactactaccactgtttcaagatcgcttacatatgggcgtggttgtcccagcgactgtgcaatccaaagtaattatccatgaattcattggccttgtgtcaatctggatgaatcaaactgagccggtcttaccagaggccttcgcgccaattttgatttacgccctgaacaattctgctagcacaatgatcaataattaacaccataagaaaaagcagctaagtgtcgttagctgcttttttgtgtatggttatctaatttaggtgtgtttagaagctaaacttattgccttcgtcagccttaatgtagtttgacgtcaagccttcaccttccaagtattcacggaatggtactaggtcttcagcctcatacttggccttgtagtctgcaacgacatcatcactgtacaagttggtatccaacttcaatgtttcaactggaattggacgatcctttgtaatcttggcatccactaccactacacgaccttgcttgtagtaatcaaccgcttcttgcataacgcgatcaatatcttcaatgcggttaaccgtcaaaccaacagcaccttgcgcctcaccaaccttggcgtaatcaacgtcagtgaaatcaacgccgaagttgtactcgttagtatcctcatacttgttcttaataaagccgtattctgtgttggtaaagacgacattgataactggcatgtcgtaacgaacgttcgtaaccacatcagggtatgtcattgaaaaggcaccatcaccgatgatgttccaaacttgacggtctgggtacgtattctttgccccgattccaccaggcaaagcgattcccatcgtcgcgaacaatggtgatgttcgccacatgttcttaggattcatgtgcaagtgacgcgttgacaattgggtcacgtcaccgacatcagttgagaagatagcatcttcatcagccaacttgttaatcgcattgtagacttggtaagcctgcaatgggccttctgtcttcagctccaacttgttcatgtaatcgcgccagttttgcacgttcttaacgtttgcacgccaccaagcgttttcttcaacaggggccacctttgccaacaacgcttcaagcgtcttacctgcatccgccaaaatggcaacatccgtttcgtgacgcttaccaagcattgctgggttcgcatcaacttgcacaaacttcttaacgttacggaacgtcccttcaacttctgagaatgggaagtttgttcccataaacaatactgtatcagcttccaataccgtttcgttagctggcttccaaccaacacggaaggttgaacccgtcaatgcctcaaaatcccagtcgaaattatcaaaattcttacccgtcgtaatgactggtgccttaatcttacgtgacaactcttggactaaatcaccgtggccttgtgtaccaaatccagcataaatcactggacgctcagattcagccaaaatgtcgacaaccgcatcgatatcagctgcttgtggctcaactggtcggtagttttggaacttaggacctgatgaatacaatggtgatgagtaaattgaagcggcgtcaagctctgcaaacccaaagtcagcagggacttcaagtaccgcaacaccatgttgtgagatagccgtacgaatggcatcatccaccaagtgtggcaattgttcagccgttgcgacacgtcggttataaaccgcaatattttcatacattggattttggtttagctcttggaatgaatccatattcaattcgcgaactggctttgaacctaggatggccaatacggggatgtgatccattgcggcatcatacaacccgttaatcaagtgggtcgcacctggtccccctgaaccaactgttaccgcaattttaccaccgaacttgtattgcataacggcagccatggcaccaatttcttcgtgcttcacttgaataaacttaatgttgttttctggatttcccattgcattcatcaagccgctaagcgtacctgatggaataccgtacatggtgtcaatcccccaaccttccatgactttcaatgctgctaatcctgcagaaatcttcgtatctgacatttcaatgccccccataaatttaaagcaaacgttgtaagcgctttcttgtttacattgtattttaagtaagcatcgattgtcaagtttctgggactattcacgaaccgaaagtgaaacattccgctgtttcatgcggacgaaatgcttcgcgactttactcaactgttagtaggctatcgtagaggtgattaacaagatccacattcgtgtgtgccttggttgtatcttcgttgcttaaccaaataactatgtttttaccatctttgctcatcttaactgacggttcaaagcctaaaataatcccgtgcatccggtaggcattgccatcatcgtacatcccactcgcataggtttcattaggtgccagtcgcatcattgcattaaattgtagctttgaaataatcttgttgcttaactcatctcgcagtaatttatagagattacccgtcgtcatctcgatactaccagtcccaatttctcggttaaagatattcggattatcaaaataagccgtcccatctgccccataatttgctgtcttatatggactgtcaatgaagtcgttgtagtccgtataatcgatatgatgttggcccttgaacgttccctttaataaatcggcataagaacgaccagtaacctggcgcaagatgccaactaacgcgacgtaattaccagctgaatagtaccaagccccacgttgatccatcaccaactgtgataacgcatacttttcatagcctgcttcatcaagcgtggcttccgttttgcctatttgattataaccagctgtcatattcaacaattgctgtacagtaactgtgttggccgccggtaattgtggtaaatattggctcaccttatcagttaacttaatcttccccgctgccacttgttgcatcacgagcaatgccgttagattcttctggagcgatgcaatcccatacaaagattgggttgtcgctggctggttagcctgcttattcgccagaccatatccctgattgagaatgattttaccggctttggccactaataatgtgccacttcgaccagtcgctttgacttgctggtcaatcgatttggccaaaactgactgtggttgcacgggcgcgtttatattttgcttaaccaccggtttatgaattttccgaacctttggtgctgcttcgtggccaattaccccatgcgatagataggtgaacgtacctcctgtgactaaaatcgtcaagattgtcgcaccaagtattttaccaactcccataatttccccctcaactgccgttagctgctccggactaaacataaagtaactaacgctctactatgatgttgtcaattatacaacgacgggcagttttcatttagtcacaattgcccatatttgttaaagattgcaatagacgcaaaaaaagcacttactaccgaagtaataagtgctttttaatgttttttgaatcgttcccaatccagaaagtgaaaatcgaaagattaacgctttgagaattgtgaagccttacgggccttcttcaaacctggcttcttacgctccttcatacgagcgtcacgagtcaacaatccagccttcttcaaagctgcacggaagtcaggatccacttgcaacaaagcacgtgagataccgtgacggatggcaccagattgacctgagaaaccaccaccgtttacgttaaccaaaacatcgtagtttcctagagtttcagtaacgttgaatggttgtaccataacctcacgcaagttagcgaaaggaatgtattgttcagctgaacgaccgttgatcgtgatgttaccgttaccaggtaccaaacgtacgcgggcaacagagttcttacgacggccagttccgtagtattgtacttgagccataattaactattctcctttcgttaaattaaataaggttagtgatatccaacacttcagggttttgtgctgcgtgtgtgtgctctgaaccagcaaacacgtgcaacttcaaaccttgttggcgaccaagagtaccctttggcaacataccgtgaactgaaagctcgatcaaacgttgtgggttcttctctcgcaaatcaccggccttgcgctccttcaatccacctgggtggtttgagtggtggtagtaaatcttgtccgttgccttcttaccagtcaaagcgaccttttcggcgttgataacgataacgttatcacccgtgtcgacgtttggcgtgaaagtaggcttgttcttaccacgcaagattgatgctacgacagttgacaaacgtcccaatgcaatatcagttgcatcgatgacgtaccacttgcgatcgatctcacctggctttgccatataagttgtacgcatggaaatttcctccaatattctgtttgtttactttaccaataattaaaaaagtcgtaccaggacattcccattgcggtgtggtaaacaataccgagatttatcttaccttttttctaccgaaacgtcaacggaaatacgccctagatttgaactatttgcttgttttcgtgctttttaatagtcaaccgacattaaatagaggccctgtgctggcgctgtaaatcgcgcttgttgccgatcttttacggcaaacaatcgctgaatatcatcaaccggccgtgacccgttaccaatttccagcaaaacgccgaccatgatacgaatttgattatacaaaaaaccattcccagtaaattcaaaccaaatttcatcctcttccggtttctcccacatcttagcagaatagaccgtacgcaccgttgttttttgctggaacccagacgcaacaaaactcaaccaatcgtgctctcccacataatcaccaatcgcctgctgcatcaatgacgtatcaatgcgacgatgccaatgccccgtataattacgtttaaagggatcaatgaactctgtcgtcgacaaccgatagcgatacgtcttattgtgtgcactaaattgtgcgtggaacgactcatcaaccttttcaactgacttaatgccaatgtcataaggcaacatggttgataacccttttcgaaccgcttcatttggaatatcaaacggtaagtcaaaatggacaacctgcccttgcgcgtgtactcgcgcatcagttcggcccgagccttgcacccgaatgtggtccgctggatctttagccatcttattgacgactttctccatttctaattgcactgttcgtttcccaggttgcacttgccacccgtaaaattcagtaccatcgtatgaaattgtcgctttatagcgcggcatattcaacacctcttacttcatttttatagccatttagtcgcgatgagtaacaccgtaaacacaatgaacccaattaccgcaatggtatcttgcttttgccaggttaagacacggtacttcgtgcggttatcaccaccacgataaccacgtgcctccatggcatcccccaattcaattgctcgcttgatcgcgttgataaacaaagggattaggaggggcacaaatgccttaatgcgactaataatattaccctcattaaattcaaccccacgggcacgctgtgcgttcataatcgactctgcttcgtccatgagcgttggcacaaagcggagcgcaattgatagcattaacgccaactcagccactgggaagccaaccttcttcaagggttgcaacaaactctccatcgcatcagcgactgccaacggttgcgttgttaacgtcaagatggttgaaaacatgataatcaacataaagcggacgaagaccgcgatactattcgtcacaccatcagtcgtgatggttagaaaagcccaatgccacaggacgtcaccagtttgaacaaagaataattgcaataaggttgtgataaacatcaaaaacatcagtggtcgaacgccacgaataaagacgcccacaccaagtcccgtcaacaaaattgatagtagcgtgaacgcaatcgccacgacataccccgccacattattcgcaaagaatacaacgaaaatgaaggcgacactcaaaatcaattttgtccgagcatctaaacgatgaatccaagaattccctggcatataacggccaataatcatattagtgaacatgtgctgaccctcctaactgctcggccaattgatcagctagtgcatcgatatccaacaccgcatctaacgtgacaccttttgtcgccaacttatcggcgaattgcttggcgattggtacatcaagttgcttctcttgtaaccaggccacgtcatcaaaaatctttgctggtgtgccctctttgacaaccgtaccaccttcaaaaacaaccacatgatccgcatattgggccacatactccatctggtgtgtgattaatacaaccgtcaaatgacgttccttctgcagacgcgcaaacaaggtcattaactcttcttgccccgctggatcaagtccagcagttggttcatctagaatcagcaaatctggctccattgcgagcacgccagcaatggcgactcgccgcatttgaccacctgataattcaaatggcgagcgttcatcgtacttttcggccatcccaaccgtccgaagcgcgcgctttgcggccgcttcagcttcagtagccgtcttaccaaagttctttggcccaaacatcacgtcttttaaaacggtttgttcaaacagttgcgcttctggaaattgaaataccaacccaacgtgcgcacgcatcttattcaactctttgggcttcgtcgttggcacaatccgttgctcggcaattgtaatctcaccagcagttgggataaccaggccatctaaatgttgcaccatcgttgatttacctgagccggtgtgaccaatcacagccgtaaacttaccctctggcatcgtaaaattgacatcatgcaggccttgggtcgcgaatggtgtatttaattgatacgtaaatcctacttggttgaaattgattgccataaccaatccaccatcccttctgtcgtcaaatatgacgcagggacgtcaatgccacgttcccgcaatttttccttaagttgctcagcaaatgggacggctaagccaaactcgcgcagtttatccgcatttgcaaaaacctgtgctggtgcgcccgtctcaatcaaatcaccatcattaatgaccacgacacgatcggcactcgccgcttcttcaatatcgtgtgtaattgataggacagtcaattcatcccccatccgggtcttcagttcgtgcaccagcgcaatcatttcacgacggcccttaggatctaacatggctgtcgcttcatcaagaatcaaaattttgggttgaatagcaagaaccgatgcaattgcaacacgttgcttttgcccacctgataaacgtgaaggttcgcggtcagcaaacgccgccatttggacctcagtcaacgctgcttgcacccgtgtaatcatttcatcacgagcaatgcctcggttttcaagcccgaacgccacatcatcagcaaccgttgcgccaacaaattggttatcagggttttggaataccataccaaccatatcgcgaatggcccacatattctcttctgtcactgacgtccccgcaatcgtgatatctcctgcagtgggcgccaatagataattcagtaattttgctaaggtcgacttacctgacccattatgtccaataattgccacccactcgccctgattaatcgtcaacgataaatctttcaacgctggggtgtcactattaggatatgagtaagtcacgtgtgacaactcaataattggcgtcatgtttgcgcccccttttattttctaatacttacaataataacaaacaaccgcttgcttttgtttagtttgaggatgtttgtttgtttgtcggttacaatagaagacagaggaataccattatgtctgatattgatttaacccggtcagccgattatcgtaacgtgacggacttttacaaaggcaagtccgacgatgaaattcgcgctgaccttgaccaacaccgcggcgaaatgatttcaattatgcaaaatctcagccacgacttcaacaaagcttctgccgtacgtaatagtaacgcctttggtatgcgcaagctcatttttttaaaccctgaaaatccggctattccagacgccccagaagggatcaaaaaatgggaccggcgcgggtctttgggcacacaaaattatgagcacattgaacatcggcgggtaactgattaccaagctgtttttgaccagttgcatgccgacggctataccatttacgccgtcgacaacacaccaggttaccaaccacagtcgttatataacgtgaccttcccggcaaaatcagcctttcttttcggtgaagaacgactcggcttagctgatgacctcatcgcagcagctgatgccatgatttatattccacagtacggtagtgttcgttcaatcaacgtgagtgtcgctcacggaatcattgccgccttctatgcatcacaacatatgtaaaaagctcgtcgacttaacaatcgacgagcttttttagcgacaatttactttttcaaatcgttgtaacgtgactcgtgcttaccgtacaagctacgtcccaatgacttttcaaggaatggcacaacccagtagtccaaaccaaccgtgcgtcccgcaccgttcatcaaggccaatgaggcgaacgtcatcaagatagcagatcctgcaacgctttgaccagcaatcaacataaccaatcccgtcacaaaggcgacaaatgaagccaatgacgtgaacaagccaaatgtaatcaaccaaccaacaagtgaagccaagacaccaacaccaccgttcaaagcagcacccgcttgaatccacaagattccaacaacaatacgaagtggcaatgaccacaaaacgttacccatacgtgacgtccagccaaagaatggcgtacgaccgtttggcgtacggaagaattcatccatcatgtagtggaaaatgtggtaaccactcgtgatttgcgtaaagaagtacaagttaatcacgtgcttgaacatgttggcaaagaatcccgttagtggaataccattcttaccaaacttcatgctaccgaattgttccgcaatacctactgtgtagtgagcaccgattgaaacggcatatccttggtagtgacccttaaaggccttacgtgaacccttaccagtcaagtcatacacaatgttaggtacggccgtgttcgcagctgattcaccaccctcaaccgtttgtggtgtccaacctgaacgtgggttgtctgcaaccgtacgggcaggttcttgataagcagcgacgtcaccaacaacatagatatcttcttcgccctttgcgcgtgagtaatcatccgccatgaagcgaccagcaggtccttgttccaagccccaaagtgagccttgttccttcgccttaacaccagccgtccaaaccaacgtctcagttggaacttctgtgccgtccttcaagacagcagcgctttccttaacttcaacaacaccagcagacttacgtaggttaataccatgattaatcatgtattgctcacccttgtcagccaacttacggtttgcaagcatattcaaaattgttggtgctgcttcgataacatcaatcttaatttctgattcatccaagttgttagcttcggctaattcgcgacgttgttcaatcaactcaccagccaattcaacacccgtgaatccagaaccaaccactgcgatacgcaattttgcttcacgcttggctggatccaattccatggcaccttcacgaataaccttttcaatgtgggcacgaagcttaacagcttcttcaaatgaccacaatgtgaagccgtattcttcaacacctggcgtaccgaacgtgttcgttgtaccaccagttgccaaaaccaacttctcataggcgatatcgccttctgacgtctttacaatcttggcatccttatcaacaccttcaagattagccgtcacaattttaacgtttggttgacgtacgaacaatgtacgcaagtcaagttgaatgtgcttaggctcaacacgcttcgttgcaacttcgtgcaactcggtcatgtacgtaaagaatgagtgacgatcaaccaaaacgatttggtagtcagtacccttcaatcgcttagccaatttacgtgccgtgaagacaccagaataaccagcgccgacgacaacaatgtttttagtagccatacaaaaatctcctcaataataatcccactaataaaaaataaatccattagccattttagacctgaaaattgaatttgtaaacgtgttcacttgttttttgtgcatgttttgtcctataaacaaaaggtttctcgtttcattatagcaatttaggaccgtctgttcgtgcataaacgctcaaccaaaagtgcaatatatcggacttttatatgccccgaaagtgcaacaaaaaagccacgccatggctgaacgtgactttctaaattaattgtgtgttatttaggtcatgtaatcgttcccggtattaatcgactaacattcccgcgtgaatcttatcaatattccacttaaccatatcgtaataggtatccccggttgtccccttcttcgccagtgaatcggtataaatcttttcgtagattggtaacccagtctcctttgataccttttccattgattttggtgatactgaactttcaacaaacaacgactttacattcgatgccgcaatcttggctaatacttgcttcatttgctcaggggttccttgtgactcagtattaatttcccagataaaggctggttgaatgccatatgccttcgagaaatacttaaaggcaccttccgatgtcaccaacaaacgcttttcaactgggacatcagcgaatttgtcttttgcttcgttatgcaacgcacgcaacttcgcaatgtacgcatctgagcgcttttggaaggcttgggcgtgttctgggtccttatccttcaagacgtttgtaatcgtctcaacgtacttaataccattgtttaagtccaagcaggcgtggggatccatttcatcttccttgccctttgacgtcaagaacaatggttccactaaacgtgaagctgaaaatacttcttggttatcccgcttattagctgttttcgtaagctttgagaaccatccgttaccgcccgtttccaagttaagtccattgtggaagatgacattagcttccgttgtcgcagtgatatcggctgtttttggttcatattcgtgcgggtctgttccgcgcttaacgatactgtaaaccgatacatcatcaccaccaacttgttcaaccatatcttcaagaattgaattcgtcgtgacaacacgtagttcaccacttgccgtagccgtttgtgcatcacgattttgcacaaaccaaaccgttcccccaattgcaattgccagcgcacctgctgttaacccaagtttcttaagcatttttaacccccattagttttgtcacaaagccttgctttggtgacacgataaacgaccccaaaaagataagcgctgccaccaacacgatagcaggaccagacgcccaatttaacgtatatgacagatatagcccaatcgtcgaggccaatgccccaagtgccgaggctaagacaaccatcgtggtcaaccggttcgtccaaagaaacgcggtagcagctggcgtaattaacatcgccacaatcaagataatcccgaccgtctgaagtgccgataccgtgactaatgttagtacaatcatcaaaccgtaatggacataccctgtcttcaggccatatgtcttagcaaatgtttcatcaaacgatgtaatcaataattccttgaagaacaacacgataaacaaaatgacaattgctaatacaataatcgtcgtaatcaaatcacggtctgacactgctaacacatttccaaacaaaatatgatgcaaattcgttgatgactcagccatcgaaatcaggatgaatcctaaggcaaagaatgccgagaacacaataccgattgctgtatcattctttagcttactgtttgtcgcaacaaagccgatcaacagtgccgcaatgaccccaaacgccgaggcaccaattagcagattaatccccagcatatacgcaaccgcaactcccggtagcacagagtgagaaatcgcatcacccatcaacgacatgccacgtaaaataatgtaactaccaataatgcctgacataatcccaaccatcacagatgctaacaacgcactctgcaagaagttatagtgtcctaaggccgcgataaattcaccaatactcgtcatgatacatcctccgtttcagtgaacagaactgcgctcaaatccgctgagaaggcttgttggatattgaccttattgtaaacgtccgacacaggtccatgcgcgacaatgccgtggttcataattaataagtcatcaaagtaattcgcaactttgttcaagtcgtggtgaacaacaatgatggtcttaccggctgcacgccagtctcgcagcacatgcataatttcttcttccgacttcatatcaatcccgacgaaaggttcatctaaaatcacaacatctgcttgctgaacaatagcgcgtgctacaaagacacgctgcaattgcccaccggataattcacctatttgacgatttcgaaattccgtcagattaacttgttcgagcgctttcataacatcattacgctctgtttgcccagggcttttgaataatcctagcttgccataagtgccggttagaaccacctcaaaaacactgatcggaaatgttaaatctaacgctgcccgctgttcaacatatgcaattttgcgtcgaacacgccggaccggctgattatccacaaacgattcacccgttcgccgaatcagacccaaggcccctttgattagggtcgacttacccgcgccattcgggccaataatccccgtaatcttgcccggactaaacgcgactgacaaatcgctaaacaccggcgtcgatgtgtaggcgactgtcagttccttaatttttagcatgactgcctcctatgattgttttcggttatgcaaaatattcttttccaaaaccaactcactaagagtaacttatccgcacacactaaacaatagtttttcttagattgaaaaataaatgtaactagataacatttaactgacatgaacgcttgttaatagttaacaggtgcaaataaaaaacacccagctaatgcgattgtttagccaagtgcttcgtctgtattttttattgcgcattcaatgtcgtataagttgccttagccaattgttgtaccaggtcaataccagcatcttcagagacgttttgattgcttaaaatggcaataacatagtctgattgtttactcgtaatatggcccgttgagttaataatccagccatttttatctgccagccaaccattttttagtgcaactgtggcatccggcgttaagccagctgtaatcccccaactctgatctaccgcaatattattcattaagccttgcatatacgttcgtgaactatctgttaacacccgactctgataaaaaatattcttaagcaacgtcagttgatctgttgccgttgttgtcgagtacccccatgattcactatccatgtgactatgggtcatacccaggcgcttaaacaaggcatctggttgcgtattgcccccctctgtttcaagtagggctgtcgccgcatcattatcgctgtcttgaatcattgcgcttgccaattcatcttcataattcgacaaaccagtgccattagtcgcatgctgtcgtaacaagttagcgagaattgcaactttcacaatacttgccgttttaaattgcacatttgcatcgttagataattgggttgtaacacccgttttatgatcatagactgcaatatcaaccggggcattctgcttatctaaaatgccacgccaggccgtttttagattattggattcatcaccgactacggcagccttggtggcttcgaaatcggctattaattgacgcccagcatatttataggccaaggctatgccaaacaccaacacaacgccgacaaacaatacctgcttgtagggtcgctttaaatttgtacgcgatgtcatggcacacagcacttcctttcgtagtaatcgttactaaacgctattaactaattattagtatactcaagaaacttaatcgaatcttttatcacaacagctattggccttgataaggacgactttgtcaaaaaaatgcataaaaaaagacgagataccggagtatctcgtctttttaagaagggacgttaattacttaacagtaacaacggcaccagcttcttccaacttagccttcaattcgttagcttcgtcttctgaaacgccttccttgatagctgaaggagcgttgtctaccaagtccttagcttccttcaagcccaaaccagttgcttcgcgaactgccttgataacttgaaccttagctgaaccagctgaagtcaactcaacgtcaaattcagtcttggctgcttcggcaccaccagctgcaccagcaactgcaacaggggcagcagctgaaacaccaaactcttcttcaatagctgaaaccaagtcagccaagtccaaaatcgtagcttccttcaatgaagcgatgattgaatccttatcaaatgccatgataattaatctcctcgtttatttgcctatacggcgattttaatttgtgggctaagcccgatataaaagtgcgtcgcactaagcaaaagcttaggcttcagcagcttcttcctttgcgtctgacacagccttaactgcgtaagcaaagttgcgaacaggtgcttgcaacgttgacaacaacattgacaacaaaccgtcgcggtctggcaaagctgcgtacttgttgatatcttcaacagatgcaacttgaccgtcaacaacaccacccttgatttccaaggcttcgatgttatcagcaaacttcttcaaaatgcgtgaaggagcgattgcgtcctcgttagagaatgcaacggctgaaggtccgacaaacaagtcgttcaagtcagtcaaatcagcggcttcaacagcacgcgtcaagatcttgttcttgataaccttcaactcaacgccttctgaacgcaattctgaacgcaagttgttggcttgttcaaccgtcaacccacgcacgtcaacaacaactgcagatgcagctgacttaaacttgtcagcaacttctgaaacttgttgtgccttcaaagcaatagttgcttcactcatggtaatgttcctcctgttaagattttgattcgtaccaaaaacccccagcacatactgcaccggggatcaaaagccgcttacgcgtttttcacttcctcggcgggttattaagtcttacgacacctgcgtcttaggtagaatcgatttattactcaaactactctaacaggtagtcgaggaagtgtcaacatgaaaagctaaattataatctagaaaaattctaaaattacaatgaagctagatcgatgttaacagcaggtccgaacgttgaagcgattgatacgtgctttacgtatgcacccttaacagcggcaggacgagccttcaagataacgtctgacaatgacttgatgtttccagcaagcttgtcggcgtcaaatgataccttaccaactggtacagcaacgtttccgtcacgatcagtacggtaagtaaccttacctgacttagcgtcagaaacggcctttgctacgtcaaacgtaacagtacccgtcttagggttaggcatcaatcccttaggacccaatgcacgtccaacacgaccaacttgggccatcatgtcaggcgtagcaatggcaacgtcaaagtccaaccaaccgtcagaaatgcgttgaaccaagtcagcagcaccaacaacgtcagcaccagcttcttcagcttccttagccttatcaccttgagcaaagaccacaacagtttggtccttaccagtaccgttaggcaaaacaacggcaccacgcaattgttggtctgcttgacgagtatcaacgttcaagttgaacgcgatttcaacagttgcatcaaacttggcaaagtcgatgtcctttaccaatgcggcagcttcttcaacagtgtacaacttctcactgtcaaccttttcagcggctgccaaatacttcttaccatacttcttagccatggtagctattcctccttgcaaatgcggtcaaacggtcattgacctcccgcttgatcatgcttagtttcctacgcgatccgtacggaactcgttaaattagccttcaacgttgaagcccattgagcgagcagtaccttcgatcatgcgaacagctgcatcaacgtcagctgcgtttagatcttgcatcttagtttctgcaatttcacgtacttgtgctgcagtaaccgtagcgaccttcttcgtgttaggctcaccagaacccttttcaacaccggctgccttcttcaacaaaactgctgctggaggcgtcttagtgatgaattcgaacgaacgatcttcatatacagtaataactactgggatcaacaaaccaccttggtcggcagtgcgagcgttaaactcctttgcgaatcccatgatgttaacaccagcttgacccaaagcaggtccaactggaggtgcaggggtagccttaccggctggaatctgcaacttaacaatgcttgaaactttcttagccacgattgtttcctccttcgtgtttgtggtgtaatggcgcgtttcgatttacgcctcccacatatgcgtgtcaccacacataccagattataataacaaaacacctgacttttgacaagtcaggtgttcaataaaaattcaattttttatggaaatgactttatagtactgactcaacgtcgttaaatgagatttccgttggcgtttcacgacccaagaagtcaaccaaaacagttacttcttgcttgtcattatcgatagccgttacttcaccttgcataccagagaatgaaccagcgacaatcttcactgattcaccaacttcaacattcaagtcggcaaccttacgttcaacaatgttcatgcgagccaacatgtcatcaacttcatcaggcaacaatgacacgggctttgatccaccaccgtgtgaacccaagaaaccagttacacctggtgtgtttcgcacaacataccatgcttcgtcggtcataatcatctcaaccaaagcataaccagggaagtcgttttccttaacaatcttcgtctcgccatccttttcaacttcaacttcttgctctggcacgataacacggaagatgtagtccgtcatccccatcgtctcaatacgtgactcgaggttcgccttaaccttgttttcgtatcctgcataagtgtgcaagacgtaccattgcttatcatatgactcaactgccatgattgcctccttaggtcgtgcctgtaatttttgtaaattaaaaaccctcaagattgagggtttattagtcgcttttcaatgtccttattatatcgcaataagcttacttagacaaccaagtaaccccttgttcaaagacccagtcagcgccaccaaacaaaatggcgaagaacaaaccggtcatcaaaacaattgatgtgtctcgaacattttcactaaacgtaggccaagtgaccttgcgcatttcagcgacaacgcttgctaaaaacttcatcagtatgtactcctgtttccagagtgggtcgacccaactccgttcttacatcgtctcacggtgcatcgtgtgttgcccgcagaacttgcaaaacttcataacttcaagacgctcaagacggttgggcttcttagttaccatgtagtttcgtgatccgcagacactgcacgctaatgcgactttcttcgctgccataatcgtgtctccgctcttttaaaattctctaatatagtattttcagtttaccacgaatgcctttattcagctacctttcgcctcagcttggtagattttcttcaaattttgtcgcgttgcataacaccaagaacgtgatcgttcgagttggaccgcacattcattgatgtcgtatcccatcgcgagtaacaagacgaatttccgttcctttacacctaaattcgacattaaatcaacaatggtcgccactgctgcactaggcggcgtaatttgtgcactctgcacatacgtcgttacacacgcttcattcaacgaaacgccctccaccgactcgtaccgataggactcccgccacagttggacaattcggtgccgcaacgcttgattatagtaccgcgtcagcgcaccccaatgtgtggcctttagcttgcgtaatgtttggtacaacactaaccgactctcctgttcccaatcgtattgctgcgtctggagactgtgatcacggtataacgtccacaccaatccccgaaacgcctcaaaaatatcctgaaaagcagcttcatcacccgcttgtgccgcctgaattaactgcactgccttttggttcgtcatcttattttaccctcctccggcttgctaacagtgtgccgatgattcggattcaagacgaaaaaatgcacaataaccggcatcaagttaccggttattgtgcattttttcatgtggttaaagcgggttacgactactaaatgcttgataaattaacaagctagctgcaaccgacgcattcaaactttggacgtgaccaaccattggaatcgtcagcgtttcatccaccgtcttcttcaacaacggtgaaatccccttaccctcattaccaatgattagagcagttggaccagcagcatcccaacgacggtaatccttaccatccatgtctgtgccaaagacccacaacccacgttccttaagttgttcaaccgtttgcactaagttcgtcacacgtgcaacaggcacgtgttcaattgcccctgttgacgttttcgcaacaactgatgtcaattgtaccgcccggcgcttaggaataataatgccatgcaccccagccgcatcagccgtacgcaaaattgagcctaagttgtgtggatcttcaattgaatccaacaccaagaaaaatggtgcttctgatttttcagctgccttcgcaaacaaatcgtcaatcgttgcatatgcataggccgcaatcgataacaccacaccttggtgattttgaccattcgtcaattcatctaacttagcttttggcgcatcttgaataatcaagccccgctttttcgctaatgccatcacttcattacgaatcttgtcagccaaaccactttgtagccaaaccttgttaatttctgtttcacccttcaacgcctcaaccgacgcatggtggccaaacacgaactcagtttgtgccgtatcatcgacggcttcagcttctactcgcatttcacgcttctggcgtggttggcgatcgcggtcgttgaaacgacggtcggcaccgcgacgattggttggtcgttcttgacggccaccacgatcacgaccgttacgattatttgtttgttgtgccatttgctctcgttcgcccactttctacttgttcgtatacccaagccacaatctcatctaaacgcgctgtttgattgctagctgccaaaaaaccaatcaatgcttcaaatccagtcgaaatacggtatgtcacaacatctgtattcttcgcctttgtatgtgaattagcattgcgtccacgcttaaagtacaccatttcttcttcagtcaataaatcttccgcttccatcaaggcgtacaaagccgcgtgtgctttagcagacacgtagttctttgattcacgttgcaggcgggccggcttcgtaatccctttagccaacaaatgttgacggatgtacacttcatacaccgcatccccataataggccaaatccaagccatttaattgctcataattaatcttctcattcatgcttactataataacagaaaaaccgggccaatgacccggtttaacaaattatgcttatgcttcaacgacatgacggacaaacggatcatctgacaaaccggcttgcaagataacatctgcccacgcctttgccgaatgtaaactatgatctttaaagttaccgcactctcgaatagtcgtggctgggacatcatcccacgtaatgtcatcacgaatcttgcgcaacacgcgagtaaacgtttcggctagctgcgttggcgtgtacgactgccaactgatgacatgaaaccctgtccgacatccaaatggtgaaatatcaatgataccatctagctcatcgcgaactaagctcgcaaacaaatgttccaatgtatgaatgcccgccgtctcaattgacgtctcattaggttggaccaagcgcaaatcataattagcaatcgtgccaccttgaggcccgtgctcttctgcaatcaaacgcacgtacggtgccttaacttgtgtgtgatctaatgtaaaactttcaacttctgccataattaattgccctccacataactaagtggcttttgtacctcaacctttgtgccgtggtactttgccttaatccatttttgttctgatgcattgtgatacaacttgaccaacttttgataggtcttatttttagcctctgattgacgcgtcgccaagatattaatatttgccttcgtgctggtgttaattgactcgcgataaatcgaatcatgtaacacgttcaacccaccggcttgtgagactgaattagaaatcaacaccgccgcgaccgctttatctttcaacacggcaaccccagtcgtgtcatcaatttccttgaattgaaaatgatggggattggttgcgatatcggcaacccctgaaagggctgagaaatcagacttcaaggtgattaatcccgccctggccaataatttcaacccacgggccgcgtccgcattgtcacgtgcaatggcaatcgttgcgccattcggaatgtctgccaccttcttgtatcgatgtgaatacacacccattggctcaatatacgtcgtgcctaacgcagccagcttcgcggtattagtttccttattaaaggcttgaaaatagctatacgattggaacgcattgacatcaacttcacctgaagcagtcgctcgattcaaggttgcgccgtcggtaaattctttcactttaatttgcaaatctgcctttttcgccgctggtgacttcgcaatatgacgccaaatatctgcatcagaggtgacggatccaaccgttaccttttcagccgcatgtgctgcggttgtgcctgccaggacgcctaaactaactgctgctaaacctgccacgatggttaacccaactttattcgtcatcggcctatccccacacttcttcggcaatttgcttgataaaccctaacttcgcccattgctcatctggcgtcagtgcattaccttcttcggttgaggcaaacccacattgcgtagaaagcgccaaattttcaagtggtacaaattgcgtggcctcctgaattctcgccttaatatccgtcgctgcttccagttctggtgacttactcgtgaccaggcctaacactagcgtcacatcaggtcgattagcccaaatcgccgttaacggtgtgaaatcaccagaacgtacgtcatcgtactccaagaagtacgtgtcgtaatgtaattgacccaggtagtccgctactggcgcatacccaccctcgaacaagtacgttgacttaaaattaccgcgacaaatgtgcgtcgaaattttgaaatcatcaggcaagccatctaacgccttgttaatgacatacacgctgtcgtctgcaatcttttcatactttgcccgttcagttggattggtggcaaattcgttcaatttactaatcaaaaacgcccaggttgtatcatctaattgcacataacgtgaacctaaatcgtagtaatgttgcaacgtttcatgataggccaacgccaaatcatccaagtagtcatcccaagtatcataaaatgacaaggcattatctgaacggccatcacggaataacaacgttggtgctggaatggttgacttcggctcagttcctgccggtgcgactgattgtaaatacgcaaaatcagcaaagaatggatgatctggattaaaggcaattttgccagtcaaccggacattatccgtacgagtcttctcgccgtggaacttataggaatcttcttgtacatatcgttcaacaccggtcaaaccccacagaaagtccaagtgccaccatgaccgtgcaaattcaccatccgttacatctttcaaaccaacttcatgctggtgaataaccaaatcgtgaatttcgtcatgttgaatctttaccaaagcctcctgtgtgatttcaccagctgcaaaggctgctcgcgcttgctttagcgttgctggtcgcaaatatgaacccacttgatcaaaatggtaacgttgcttagttgctgttgtcataattattcttctcctaaatatgaaaaggcattcgccaaatcggcaatgatatctgtaatgctttcgagtcccactgaatagcgcaataagcctggtgtaataccactagctacttgttcagctgccgataattccgcatgggacatttttggcggatagctgataatgctttctacgccacctaaactgactgagtaaattggaatagtgagatgtttaaccaattgtcgggcgttttcaatcgacccaacatcaaatgacaagactgccccaccatttttggcttgcgttaattgcacctgatagttcggatgcgtcggtaagcctgggtaatgcacggcattcacttgcggttggtcagttaaccatgcggccagctgagttgcactggcactcgcctgcgccattcgcacccccagcgttttcattccccgcaatagcagccaactgtctaacacacctagggtggcgccaactgcattttgaatgaaatagatttgctcagctaaatcatcccgttttgtcactgccgcgccagctaaaatatctgaatgtcctgctaaaaacttggtagctgaatgtacgacgacatcaacgccgaaatctagcggcttctgtaaagcaggtgacataaaggtattgtccgcaatcgttaaaagatcatgcgcttttgcaattgcgacaatccctgcaatatcggtcactgacaaggttggattggaaggcgtttcaatataaatcgcctttgtattcggcaaaattgcggccgcgacgtctgctagttcaccacaatcaacaaacgtatgtgtgataccaaatcgtgataacacatccgttaatacacgaaatgtcccaccataaacgtgcgacgtcaccacgatatggtcaccagctgagaaggtcatgagcacactactaatggctgccatccccgaactaaagagataaccatgtgtcgcatgttctaaagccgctaccgccttctccgctgccaagcgggttggattaccgcttctggcgtaatcaaattcacctaagttatcaaaatccgtttgagcaaacgtcgctgataattgaatcggtgtattaaccgctcctgtcagttgatcatgcgtcgtcgttacttgtaaaatctttgtcaaatcatccatgccaatttctccgtctgtttaagctacgagtgtcaatttcgtcgcatcacattcgactttggcctaatccctcaccgacaacaagacatcggtgaaccgtcacgcataatccttgcattgtctgtcctccacatttaagttttgacgtaaaaaaacgtcccgtagctacaattagctacgggacgttgacacgtgttaccacccgggtttagttattcccatacgaaataaccctctttcaatacggtcctatgtcggacgatatctaagcgcaataacgggcgcacccgaatgacgctaacacgttttgctcacgtcattctaactccaagaccattttccaattcttcagttgattagctcgcaccacacgctaactctctgggcaaccgttaaaaagtacttatctcttcttagtcgataccattatcataacacttcattagaaaacgtcaacactttaattagaattagattagataaaaacctaaaaagcaattaattaacaccaatagttaagttataaacgacaattatatcttggcgacgttccatgaacattattaaaaaacgcctatttaaaggcactaaaccttaattcaggcggattaaattctcgaatgcggtacaaccaaacggacagattgttcactttttaacttctaataaagtataataaaagacgtagaattgagctgattcctaaataaatctcacaatcaataactaataatgttctcaacaagcattgtttaaacctttcaaatcatttctacatccaaagctttggcaccccgttctccacggggtgccttttttgtcagtgtcacggcttaccagacaccagccattagtcagcccgtatgctcccaagctttgatagcaacactatcagagaaccacttggctgctgcaacaggcgtggctggtgtccggagcgttcaaaaatcggcaacatgccgcatggccggcgctattcagaaaatcccacacggaccttgaggctttagggggaattatttgccccgctgaatggcgtccgcgccattcggttgccgagtttttgaacaaaggcgcaggacaccagtcacgccggttgctcgtcgcaccgcgacgaccgacgacccctcagtcaaacgcaaaaagaaatccccagaaacaagatcacttgtctctggggatttctattacttattaatcaatcatgtaaaaatgtttgattaggcacgacgccaacgcgttccttgtggcgtatcttctaggataatgccacgtgaagccaattcatcacgaatttcgtctgaacgagcaaagtttgacgtctcacgggcagcatcacgttccttgatcaatgcatcaacatctgcatccaacaaaggcgcttgctccaaaccatcaacaccaaacacgttcatcaagtccttgatttgcttcaaaacaaagttgaccgtgtcagtcttaacttcttcagcttgtgagtacaagttggccaattcaatcaactcataaaccgcagtcatcgcgttttgtgcgttgaagtcatcgtccatagcctcaacaaaggcatcaaccttttcttgcgcctttgcttcgatatcagcatctgaaccggcaactgctgatcccaaacggaattgcaagttacggtaaccagtgcggatacgctccaagttgcgggcagccaagtccatgttcttttgtgagtaggcaattggacgacggtattgtgtcgtagccatgaagaaacgcaaaaccattggatcatcgatttgttgcaacaattcgtgcacagtcgtgaagtttcccaatgactttgacatcttctcgttttcatcaccaaccgtaacgaaaccgttgtgcaaccacttctcaacgaacttttcacccgtgtgagcttcagtttgtgcgatttcatttgtgtggtgtgggaaagccaaatcgattccaccaccgtggatgtccaagtggtttcccaagtacttcgttgacatcactgagcactcaatgtgccaaccaggacgtcccttaccccaaggtgagttccaggcaattgcaccatcgccattctcacccttccagactgcgaagtccattgggtcttccttacgagccaattcgccatcgtccaaacgaccagcagcgtttgattccatttcagccaagtcttggtgggccaaaataccgtaacccttaaacttcttggcacggaagtaaacgtcaccttctgattcgtaggcgtaacccttcttaatcaaatcctcaacgaattcgataatctctgggatgtgctccgttgcacgtggacgaacagtggcaggcttgatgttcaatggtgccgtatcttcgttaaaggcatcaatgtacttatcagccaattctggtacggtgataccttgctcgctagctgcagcaatcatcttgtcgtcaacgtccgtgaagtttgacacatagttcacttcgtatccacgatactcgaagtaacggcggatcgtgtcgaatgcaatcgctgaacgtgcattaccgatgtgaatgtagttataaacagttggtccgcagacatacatattgatcgtcttttcattgatgggcgtaaaagtttccttttccaagctcatcgtgttgaaggtcttcatcatttttgcatgctcctttaatttaataagttaattttagcatatgacttcaaatactctaagcatttacacttgcatccgttattcaggattcatttcgatcaacaagtcaccaccggccacaacttcaccgtcggccacatgcacaaatttaaccgtgccatcaaatggcgcttgtaccgttgtttccatcttcatggcttctgtgacaattagcacatccccttgcttaacagtttggccattctcaacgtgaacagacaaaacattgccagccattgttgcaccaatttcacttgggttcgttggctcagctttacgtcgttgcactgttgtcacttgcgctgattcatcttgcactgaaatttcaaccggtgtgccattcacatcaaagtacatcgtccgacgaccatctgggttaatatcaccgatttgttgcaattggaaaatcaccgtttgacctggcgccaacgcaacgtcaacccgttcacccactcgcatgccttggaagaaagttggggtatccaatacagtcattggaccaaacttaccttggtttgtcacataatccttaaagacttgcggataaatgatgtatgaaatcacttcttccggcgttgcaacgcgtcctaaaataccatctaccgtgacctgcatcgcatcaaaatcagctgctggcgttaatgacccaggtcgaactgtcaaagcaggccggccctttaaaatcacacgttgcaagtctgccgggaaaccaccaactggttgacccaagtttccagcaaagaaatcaacgaccgattgtgggaagtccatcgtcatcccatctgacaacaccttcgccggtgtcaaatcattttgaaccatgaatagcgccatgtcaccgacaacctttgatgatggggttaccttgatgatatccccaaacatttggttaactgtcgcatacatttgcttcacatcatcccaacggtcacctaatcgcaacgcttgcgcttgttgctgcaagtttgaatattgaccacctggcatttcaacttcaaaaatatccgtttgtgccccaaccatcttgctcataaattgactatactgtggtcggatttccgcccagtaactatttacgtgctcaactgctgtcatattcaactcaggttggcgctgattaccgcttaaggcgtaatacgtcgcacccattgacggttgtgacatcgtccctgacaaggctgattgtgccacatcaatcacgtcgacgcccgcatcaacagcccgggcatacgtataaacaccgttacccgttgtatcgtgggtgtgcaaatgaattggcatatcaaccgcgtccttcaacgcacttactagttcataagcagcttccggcttcaacaaacctgccatgtccttaatcgccaacatgtgcgccccagttgcctgaatttccttggcaaattgcacatagtaatcacgggtatacttcgtccggtttggatctaagatatcacctgtgtacgccatggcgacttcggcaatcttgttattgtcgcgcacatattggatactcttctccatttgtggcaaccaattcaaactatcaaaaatacggaacacgtccatcccgttttgggcggccaacttaatgaattcttctaagacattgtccgggtagttttgataaccaactgcatttgaaccacggaatagcatttgcgttaacgtccgtggcatctttttacgcaaagcacgcagacgctcccatgggtcctcacccaagaagcggaacgccgtatcaaacgtggcaccaccccacatctcgttagagaacaagtttggcatggccacctgagtctcatccgcaattgccaacatatctttcgttcgcatccgggtcgcaaacaatgactggtgcgcatcacgcatcgtcgtatccgttagcaataccttatcttgcgtttttacccattcagcaacggcatcaggcccttgtgcatcaagaatatccttcgccgtcaccaaatcagttggcaagaccaaatcagtattcgctttgaattgtagtggttcatgcaacttgggatagtcataatcaacccctgggaagccattgaccgtaatttcactgacatactgaatcaatttgcggtcgtcttgcttttcgattgaaatatcgaaaagttctgggtgttgatcaacgaacgttgttggcgcattggcggctcggaacaaggggtgtgcatagaccttcttcaagaacggaatatttgttttaaccccacgaatctcaaattcatccaacgctcggcgcattttatcaaccgcttctgagaacgtggctgcgtgtgaaatgaccttagttaacaaagaatcaaagtaaggcgtaactaccgaaccaacttccacactacccgagtccagacgaatcccggttccaccaggtgatcgataccattcaatgcgtcctgaatcaggcataaattgattcatcggatcttccgtcgtaatacgtgattgaattgccacacccattgcctgcaaatctgcctgatgcgggatttgcaacggatcgtcgtgtagcccaattccttgggcaatcaacaattgtgacttcacgatatcaacaccggtaatctcttccgtaaccgtgtgctcaacttgaacacgcggattcacttcaataaagtagaaatcatccccatccaccaggaattccaccgtaccggcactttggtaatcaacactctgcatcaaagcgaccgctgcggcctgaattcgcgcacgcatatccttcgaaacagaaactgctggggcgtattcaataatcttttggtgacgtcgttgaattgatgagtcacgctcaaacaagtgcatgacttccccttgttcgtcggccaaaatttgaatttcaacgtgcttgggatcttgcaagtacttctctaggtagacatctgacttaccaaagctggccttggcttctgacgcagcacgttcaaatgcctcacgcaattcttcttcatgattaacgacacgcatcccacggccaccaccaccggctgctgattttacaaagactgggaagccgttttcatgaccgaatgcaattgcttccgcaagcgtttcgactgggtggtcagtgccgggcactgttgggacacccgcagcaatcgcagcctgtttcgcaagaatcttgtcaccaaaaatctccaagtgtttaacctttggcccaacaaacttgatgccggctgcttcaaccttagcagcaaactcagcattttcagataggaacccataacctgggtggattgcatccgctcccgtttccttcgcaattcgcaaaatatcatcaatatctaagtacgctgcaataggtgccttgccctcacccacttgataggcttcatctgctcggaaacggtgcttggcaaactcatcttcctttgcaaagataccaaccgtttgcatgcccaattcactagcagcacgcatcaaacggatagcaatctcaccacgatttgcgactaataattttttcattcaatatccctcaacatcttcacttcatgaagtttgctagtgcgtcagccgtcacggctcgcaggatctcagccgaacgttgcatttgcatctgttcagctggtgataacgctgccatgatgacggtttttgcaccatccccgttaataactgccgggctaccaatgtacatatctgacaagccatactggccactcatccacgcactaactggcaacaccatgctttcatctcgcaatatcgcacggacaatgcgtgccaaggctgtcgcaacgccataaaacgttgcccctttgcggccgataatggccccgcctttctttgttgttgcttccattaattctaccaagtcttgggcagaatttccgtactttttattaaagtcgtttaatgattgtccgccaatttgcgcctcatcaaaatttgcaaacgccgaatcaccatgttcgcctaagactaagacatcaattgcagctggtgccacgccgtactgttcagccaacgcaacttgtaaacgcgcggtatccaaagctgtccccgtcccaatcacacgatgttcagggagacccgaaaattgttggaccgctaacgtgatgatatcaaccgggttcgttgcgaccacaaacatccctgtaaacccttccgccatgacgttatcaacgacctgtttcacaatcgtcaaattcttgtcaatcaactctagccgtgtctgtcctggtttacgtccaacaccagctgtaatcaccacaatatctgcatctgcgaccacttgataattatgaccacccgtcacttgctttggatacgtccaaggcgccgtatcttctaaatctaaggcatcccccgtggcataatccttcgccacatccacaatggctaactcttcagcaaccccttgttgcatcaacgcataactaaaggctgatccaaccatcccgtcgccaactagtacgaccttttgatgatgtttttgcgtcatcttaaaattcctctttaccgaaaagagatgacccaattcttgcgaaccgagtcatctctgctattttttctgtttaactcaaacgaagttgtttaccacataccaagcaacttcatccacaaactaccaacaccaatccaaatgacgatgtaaaccaatcccaagatgaagttcatccgccaccattcaccttgcttgacgtaaccagcgccgaacaagataggtgcaggacctgaagaatagtgcgtcgttgaggccatcaagtttccgaagaatccaagcatcaatgctgccaacaacgctggcacgtgagcagcaatcgccacggccaagaaggcggcgtacatagctgaaacgtgggccgttgatgaggcgaagaagtagtggctgtagaagtatgcgacaagcaaaacaatcaacactacgaaccagttcaaaccacccaagctagccccgatggtctttgacaaccaagggatgaagcctagggcattcaattgactcgccatcatgaccaaaactgagaaccagaacaatgtgttccaagcgccagtttcctttagaatgtcattccatgacaaaacaccagcaatcaacaagaaaccaataaccaagaatccagttgtcgttgagtcaatcccaatgaatgagcccaaaatccacaatgccaaggcaatgacgaaaccaacaatcatcatgatttctggcttcgaaatcttacccatttcgtgcaactcaccggctgcccaatccttggcatctggcgtttccttaacttcaggggcatacatcttgtaaatcaagaatggcacaataatcaatgacaaaataccaggcaccaaagctgccaagaaccagttcatccaagtaatatcaacaccttgcttggccgcgaaggcttgcgcaattgggttaccggccatggccgtcaagaacatggcggccgtaatagcgttagcgtggaattccgtaaaaatcaagaatgaaccaatcttacgttccgtacccttttcaggatctgaaccaaacgtttgggccaatgacttaatgattgggaacatcaccccaccagcacgagccgtatttgatggcgttccaggggcaacaaccaagtcaaccgcagacaaagcataggccaatcctagcgtctttttaccaaacgcgcgtacgaagatcaacgcaatgcgacgccccaaaccagtcttgataaacccacgtgaaatgaagaaggccatcacaatcaaccaaattgagccatttccaaatcccacgatagccgtgtccattgggaccgtacccgtcaacacaaccgcaacgaacccaaccaaagcaacaccaccaagtggcaatggcttagtgaccaacccaacaatcgtggccacgaaaatcgcaaacatgtgccacgcactaattgacataccgtctgggcgcacactggccaagaaccatagcactaacccaactaccaatggcgcaatgaatttcttataatccactttttccaaagaattcatgagaaatttcctatctatattttctatgctattttacaaaccaaggacgtacttagccgcttgcttaccagcttgacgaccaaacaccaccgtttcggcaattgagttaccaccgatacggttgttaccgtgcaaaccacccgttacttcaccggcggcatacaagccagtcactggatcgccagcttccgtcacaacctcagtcaacgtgttgatcttgatgccacccatcgtgtagtggatggctggcttaatgtgaatggcgtagaatggcgccgtggcaatcccacgatccatcgccgtgttacgaccaaactctgcatcttcaccagcagcttggaactcattccacttagcaacggttgcagccaagttgtcagcgtccaagttagccgtttctgccaactcagccaacgttgccccttccatcaccaagcccatggcgtggtagaagttaattgctgggaacgcatcgcgaataccttgatccaaaatcaacgttgccccgtcttcatgcaaatcgttaatcgcagctgtcgccttatcacgcgtcgtcatttcgttcacgaaacgttgaccagcccggttaaccaagatggccccttcaccacgcacaccttcaccaatcaagtacacgtgatctgtatcttgttgcgcagttgggtgaatttgaatcttgctcatatcaaccaacgtaccaccaacggccgtcgccaacttcatcccgtcaccagttgcaccggggtgattcgttgtcttcaagtccaacacttcaggggcgtattcagccaacatctccttgttttgcgcaaagccacccgctgcaatcaagaccgccttggcattgaccgtgcgctcaccaatttcggcgtgcttaatcttcaagcccgtaatcttgtcagccgtcttaaccaactccaagacttcagtgccagcaaacaatggaatttgcttaaaggctaattgcttttgcaaacccttcaccaagtaaccaccaaccgctgacttatcgccaggacggtgtgcacgcttttgcgtcatcccaccagttgacgtcaaatcagttaggttgatgttgtggttgtacaaccaatcaacggctgactcagagtgcgtcacaaagtattgcaacaattccttgtcattggcaccgccaccacctttaagcgtatcttcatagaatgattcttgtgaatcaatcaccccatgatcaagttggacaaacgtttcaaccgcgttcatacctgatgatgcacggttcgagttaccaccaagcgcttccagcttttcaaagatggcaaccttcaaacccaattcttgtgcttgaattgcggccgtcataccagcggcacctgaaccaataacgacgaaatcgtagctatcttgcaagtcagcgatatttgccttagggaaaataaacttagccatgtttttactccttgtttgaacgctcaaggttcgtcattgccatgaagtccatccactcgtcgtattgttcttcagtcaaatcacctgactcaagcgcagcgaccttcaacgtcgtaccattcctgtcagcagcttgtgcaatttcagcagcggcgtggtaaccgatgtgtggtgacaatgccgtcaccgtcatcaatgagttatccaacaactcacgcatgcgagctggcttaacgtccaaaccgtgaatcatacgatcggcaaatcccgtcatcgtaccagccatcaattcagctgactccaggaaggcgtcaatcataacaggcttaaagacgttcaactcgaagttaccttggcttgaggccatcgtaatcgtcgtatcgtttccgaagacgcgcacagcagccatcgtcaatgcttcaacttgggttgggttaaccttacctggcataattgatgaaccaggttcgttagctggaattgacaactcaccataaccaccacgaggacctgacgccaagaagcggatgtcgtttccgatcttcatcaagtcggcagccaatgacttaaaggcaccgtggaccgtgttcatggctgtgtggttagccaaaccgtagaacttgttgctttcggccgtgaatgggaagccgtaaacttctgaaactgtcgcagcaattgccttacccaattccgtgttcgcgttcaagccagttccaactgccgtaccacccattgccaattcgtacaattgtggacgcaaggcatcaatgttagcttggttgtgcttcaaagctgaaatgtaacctgacaattcttgaccaaacgtcaatggtgttgcatcttgcaagtgtgtacgaccaaccttgattgtctcccagaaggcgtcttgcttaacacgcaattcatcaatcaagtgggccaatgacttttcaacgttgtcaacggcttcaaccgccacaatgtgcatcgccgttgggaagatatcgtttgatgattgacccatgttcacgtggtcgttaggcaagatttgcaaaccactttgttcacttgccaagtgggcaaccacttcgttcgtgttcatgtttgtttgcgtacctgaacccgtttggtaaacagatagtgggaagtccttacgcaattccacatcatccaattgcaacaagccgtcaatcgttgccacgatcgcatcggccatatcggcagccaatgaaccgttagccttgttagccattgcagccgcacgcttgatgttcaacaaagcgcggatgattcccaaaggcatccgtgcaccagttggaaagttttgcaatgaacgttgtgtttgggccatccaagcagcctcaacaggcacttgtacttcaccaattgcatctgattcaatacggaattcttgtgacataatatttctcctcattaattagaagttaaggtcattaattgcctcaaccattttctgttttgtgatattttcaaaatctgataattgatgatcacgcttctgaatcaaatagatataaaaatcaatcggatctcggagcggtaccatcgcaatatcgcgacgaccggcaacggccaacttaatcatgatgccaacaccattacccgctgcaatcaatccttgctcagtcatcaactcgttcgtgatatacatattgtcaatttcatcatgcatatcataacgacggagctgatcaacgagaacttggtgttgcgtgaaggcatcccccacggagatgaaccgttcaccacgtaagtcctcaaacgataaataatcgcgagttgctagcggatgatcaactggtaaggccaccacgtaggaactcttcgtaatataggtactgtcgtattgcttgctgcgctctggcgttaagctaccaacaaaccccatatcaactcggtccttatccagtaattcgtacatgtcgctggaaccactttccaccatgtgaatggcatcaatctcgtcagtccccaagcgtcgcataatcgctggaaaaatggttgcaccaataattggtggtacacctagccaaatcttttgttgattactgatatcacttttaatgatttcagtctcacgtaaaatttgtttactgtgtttatataagatttgacccgcttcggttaacacaactgaacgtgtcccccgttggcgaataatcaatgtctcacccaactctttttccaatcgctgtaaggcattggtaatcgagggttgtgagacgtattttttctgggacgcctttgtgaacgtcccttcttcagctagcgtgacaaaataatctaagtcatttaataacacgtgtgctacctccgcaaattataaccttcacaaataatagcatagccctgaatttggcagaacccctgcaacgcaggttaaacgttttgccaattaaaattgcttatttgtctgactttccggcattaaacgcggtccgaataccacggaacccttgaatgcgcgtaatgtcacccgtgaattgcaacgtgcctaagaaagtcccatcaatgtcgcggattgcgtaaaagttaacatagatggtttgctcatttttaggaaaccattgttcgaaatgatcagctgcgcccttgtgcaaatcggccaacatcatcgcaacagcttcttgttcttccttcgcaaaagttgccacgaatggttggccaagttgcttcgttgcgcgtgtattcacacgttgatcattgtctgaaaaataaatcaagttatcgtcagcatctgccaaatccatctcgaatggcagcacgcgcaacacctggcgcaacatgtgcaatgacaattttccagttggcaagttaatcaaaccttgctcatcaatcagcgtcttgttattttctaattcaatttgatctgccatttgttatgactccttaagataaaaatcagggttcgttattttaaaatcatccggtcgaatgttaaccaactgaatggatttatcacgataaataaaaattgcaccaaacgggtactggccatcgattgggccatcattgaagaacaaccgggttgtctcgatttcaccatcaattgattcaggtgaaataaccgtgacactagccaactcattatcatgtggataacctgtttctggatcaatgatatggtgataagtctgtccgtctgcgaccaggtgccgttctgccaccccacttgtcacgaccgaggttgccggtgtggtaagtaaaccaatcgttttgccatgtcggaccaagggatcccggacaccaatgcgccagcgaccgtcagctttatgtggcgcctcgttcatcaacacaatgttgccaccgaaattaataatcgcagccatgtggccctgggatcccagataatcttgcaaccgatccgcaatataccctttcgcaatagcgcccaaatctaattccatccccacatgcggtagatagaccgacaagcgctcatcatccaggacaatctcatcactgccaatcaattcacgacgctggccaatttcgagatcgctagggacccgcgcatcggcaaaaccaatgtgccaaagtttgactaacggtccaatcgcggcattaaacccaaaatgctggttgctaaccgtaaccgcccgtttgaccaactgataaactgctggtggtaccaccaccggtgactgaccagcagcatgattgatgtccatcacggccgatgctgggcgatttaccgtcaacaaatcttcgtaatggttcacaaaacgaatcgcatcatcgagatatcgttcatcatctgtaccaaacaaagtaatttgattggtcgtgcccatcgcccgccatgctttcgatattttaatcaaaacatagaagctcccgtggtggcatcttcttcatcgtcatcaacggccgcccctgctgtaacaagctgactggtaacgacatcatcagtcaatgtcgtcttttcaatccaccaaccatctccttgttcaacaaccgttgcatccacatcaggtgaaatgacggttggtaccgcatccacatcgagtcccgaacccggcatcaccttatcaaggttggcataacccaacttaacagattccaccacgccttcacccgcaactgttggcatagcaccacttgtccggtcgaacgccatggcgcgcattggttgcaatgacttagcaaagaccataaagttttggaaaatcgtttccaaaaatgaaatcgtccgcgcatctgtcatgtcatcggtcttaatatcaatattcgtggccgctggtccaactaaaaattgattacctggtaacacaaacgcatcaattcctggtgcatccataatttgccgtaaatgttcttgcgcattattcgttccctggcggccaagtgacgccccgacaatcatgacgggtaaattcgtgaatgggtgtaagtcaccataactcatccactcaacgaatgatttcaacgctgccgtaatcgagtgatcatactcaggcgttgagatgatagcaccatctgacgcggcaatttgacgtgcaatttcagcaattcgcactggcgtttcagcatcttcgctaaatagcggtaaatctgcaatctccacaatctcaatatttgcttgggcattgaaatgcttcttcataaaccaaagtaaacttcggttatatgacttacgagcattcgtaccaacaatagctacataattcattgctcttcctcaaaaactctcaactagttctttgtttcacatattttatcgatgagttaattaaacgacacaaccaacagattggtcaaaacttcacaaacttgtttttagttaacaaacgcctttatataagcgtttcaaaatgtatatattacaaacgaaaataattataaatttcgcttataattccattttcatgctcatttgtgaactttgtccgtttttaaggtgaagaatttaatagcggtccgaattacttcgccatagcaaaaaagcgcaaatccgttgcctgtgtcagcaacagatttgcgctttaaaaaattagtcgtgcttattaaattaacgccaccactcgtcgaataccgtgactggtgattgacgcttgtgttccgtcgtggtgaagagcttttcaatttggatggcatccttttcagcaacatccttaccctcaaggtaatcatcgacggcatcgtagctaacacccaaagcaacttcatcaggcaaagctggacggtcttcttcaagatccgccgttggcgtcttttggtacaaatgttctggggcacccaagtaggccaaaatttgacgaccttggcgcttattcaaacggtacaacggtgtaatgtctgctgcgccatccccaaacttcgtgtagaacccagccaacgcttcagccgcgtggtccgtgccgacaacaacaccatgcatcgcaccagccacaccatattgggcaatcatgcgttcacgggccttgatgtttcctttgttgaagtcgctgattgcaatacctgcttcagccaattggtttgtcatccccacaacggcatcttcaatgttgacccggaccgtttgatctgcttgttgccaggcgattgaatccaaggcatcttgttcgtcagcttgggcattgtatggcaaacgcatcgccacaaacttgtagctgtcatctccggtttcagcccgcagctcttcagcagcagtttgtgacatcttaccggccaacgttgaatcttgcccacctgaaatacccaaaaccagcgtcttcatgcccgtcttcttaaggtagtccttcaacaattcaactgaacgacggaattccgtttccggatcaatcgtggcttgaacgcctaatgtatcaataatgtgcttttgtaactcacgcatgcgatttactgctccttaatctttatcgtactcttttgcaacttcagaaacgtactcacgcatttccttaattaagttcatcttgtggtcccaagccgcttgtgacaaatcaactgggtattcttgtggattcaaatcacggcggtactctgaccacaatgactcaatatgctcagccgtatagttgcggatgtcgtccaaggctggcaattcatacactaattcaccatcaacgatgatgtcgtgcaaaattggtcgcgccgtataatccacaactgttttattcaaataaggatagcttggatggaacatgtacaaaccttcaggcaaatcacggggattctcatcccacaacgcgatgtaatcgccttgtgacttaccatctgaattacgggtaatgcgccaaacctgcttcttacctgggtttgaaatcttttcagcagtgcccgaaatcttgatggtatcaaccatctcgccggcttcgttttcaatcgacacaaccttataaactccacccaaggctggttgatcataggccgtaatcagcttagtaccaattccccaagtatcaatcttagcaccttgcagtttcaagctcgtaatcgtctcttcatccaaatcatttgaggcgacaatcttagcatctgggaagcccgcttcatccaacattttgcggacgccctttgagacataagccaagtcacctgaatcgatacgcacgccgatgaagttaatcttatcgcccatttccttagccacacgaatggctgaagggacacctgaacgcaacgtatcataagtatcgaccaaaaagaccacatccttgtgggtttcggcataggccttaaacgcttcatagtcattgcgatagacctgcaccaagctgtgcgcgtgcgtccctgaaattggaatgccaaacagcttaccagcccgcacattcgaagtggcattaaagccaccaatataagccgcacgtgtcccccacaaagcagcatccatttcctgcgcacggcgcgtgccgaattccaagagtggttgatcaccgacgactgagcgaatgcgtgacgccttggtcgcaattaacgtttggtaattaacaatgttaagtagcggtgtttcaacgagttgcgcatcaaaaacgctaccttcaacttgaataattggttcattattgaaaacgacttcaccttcatgaggtgcgcgcaccgtggccttaaattgccaagttgctaggtaatccatgaagtcttcatcaaactcacccgttgaacgcagataagcaatatcactttctgaaaaatgcaagccccgcaaatagtcaacaattcgctccaaaccggcaaaaaccgcgtagccatttttaaatggcatattgcggaaaaacatctcataaacagccttacgctcgtgaatgcccttcttgaagtaagtttgcatcattgataattggtatgcatcagtatggagggccatactatcatctggaaattccagtgtcatgacgttctgtctcctaattttcattcattaactgctattctaccacaaccagttgttaacattggacgcctaaaaaacacctttctttgcgtaagtgttaaactatcagttggaattattttatcatttatataagtagaaagcaggtaaaagtactaatggcagaacaaaaattcgcatataaggagtcattgcgtgtggggatgttgctggccggaaccgctgggtacatcgactcctacacctttgcctttcacgacaatcgattcgctagcttccaaagtggtaacttgttgcaatttgggattaacgttgcatcagggcactggcaccaagcgagcctctttttctggcctgtcatcgccttcttatttggggcgatgctgaaccaattaatcaagaagtattccttccgcacgcagatgcaatgggaagcccgctcggtccttatcgaaatgtttggtgttctcttggtagctatcttggaaatgactcacgtgccaacagaactcgtcctcagtattttggccatctttatggcgatgcaagccgatactttcggtaaattgcgggggatgccctacgccaccgtcttgagtactggtaatttgaagacttttggggccacgctaggcagtggtctgctcaatcacgataagacccaatttgtgaagacgcggaacgtcggcttagtcattgccgcctttctaatcgccgccatcgttgcacactaccttggcttgatcatcggggcttggaccatgtttggtgccccaatcatgctactgttcgtttggttcttcgtacgacaggatgaattaggcacaaagtaaccctaaaagtgttgacatgattatgagaatcgtttaatatacaaatcaagcatttcaagttaacaaacaagttgagcaggaaagtaaattgcttaaagcatctaagagagacaacgttcggtggaagttgttatgtggtgagtaattgaaaatggcctgtgattggcgttggtgagcagcaagtctgtaagcgaacgacgggttggtctacgttacaagacacacgaatcggcaaagcatcatatcgctcactgcccgctcgttgttaaggttcagaagagtaattttctggataaatgtagaatggtaacacgaagactcgtttctatctggctgtcaattggatggcctgacggaaacgggtcttttttgtttcctagccaccgaacgctatgttataacttgaagcaattaacaaataatactaaaaagtttttattgggagacatgacttatgaagaagttctttacttatggggtagccgttgctgctactgctttgacagcctcagttattttgccagccgcagccgtcagtgctgactcaaagaccgtaacggttggtatcgttggtacttcagatgctgacctctggaaggaagtcgccaagactgccaagaagaagtatggcatcacattgaagaccaaggtctttacggactacaaccaacctaacaaagccgttgccgatggcacattggacttgaacgccttccaacactactacttcttggaaaactggaacaagtcaaacaagaacggcgttaaggcaattggtaagacgtttatcacccctattcgtttgtactctgagaagtacaagtctgtgaagaagtttaagaagggtgacgcgattgccgttccaaacgatgcgacaaacgaagcacgtgctttggttttgctacaatcagctggtttgattaccttgaagaagggtgttgatatgccaacggttaaggacattaagtcaaacaagttaaagttggatatcaaggaagtcgcagctgatcaagcaccttcatcattgaagtctgttgaaggcgccgttatcaacacgaactacgcccaacaagctaagttgaagttgagctcagcaatctacgttgagccggttaacaaggattcaaagaagtggatcaacatcatcgctgcttctaagaagaatgctaacaagaagatttacaaggaagttgtgaagtcttaccaaactaaggctacaaagcaatacttgaagaagacttggggtcaagctgaattgccagcttgggatattacgttgaagtaatcatcacccacatagacaatccaactgccaggctattttagtctggcagttatacataacggagatataaggagaagattcatggcagttatttcattaacagacattaacgtcacttttaagcaaaaaaatcgcgaaatcgtggccgtacaaaacgaatcaatcacaattgaaaaaggcgatatttacggtattgttggttactctggagctggtaagtcaacacttgtccgcaccatcaacctgctacaacgaccaacatctggtagcgtccttgttaacgggactgagatgacatcacttaagccagcgcaactacgtgatgagcgcaagaagattgggatgatcttccaacactttaacttgatgagcgagctaaccgtctttgggaacgttgcgcaaccattgaagcacgccaagatgagcaaggccgacaaggcaaagaaggttaatgacctccttgacttggttggcttggcagaccgtgctggtaactaccctgcccaattgtctggtggtcaaaagcaacgtgttgccatcgcccgagccttggcaaacgaccctgaaattttgatttccgatgaagcaacttctgctttggatcctaagacaacaaaccaaatcctagcgctattgaagaagctaaaccaagaactcggcctaacaatcgttttgattacgcacgagatgcaagccgttaaggaaacggccaacaaggtggccgtcatggaaaacggtgtcatcatcgaacgtggctcattgttggaaatcttcacgaacccacagaagcaattgaccaaggactttatcaacacggccacaaaccgtgatgaagcccttgaaaaggtgactgagctgctcgaagaacaacctttggctgatgatgaagaattgttgcaaattaactacgttggtgccgatacagcccaaccactgttgtcaacgatttacgccgattacggtgtcacaaccaacctgttgtactcaaacatggaaatcctaaccaagacaccggttggcttagcaattgctatcttcaagggaacagcgtcacaacgtgcaacggcaaaggcaagctttgctgatcacggtgttcaaattcaagaactacacgtaggaggacaacactaatggctgattggatacaacaaaacttacctaacgtttactcacttggttggggtggtgatttcggttgggggatcgctatctggcaaaccattttcatgacggtcggatctgccatcattggtggtttgattggcttactcttcggaactggtttggtgctaacggcggatgatggtattacgccaaaccgaccactcttccaaattttggataaggttgtctcagttggacgtgccattccatttatcatcatggtggtcgccttctcacctttgacccagttgattgtcggcacaacaatcggaacgacagccgccttggtgccattgtcattgggtgttttccccttctacgcccgtcaagtccaagtcgctttgcttggtgttgatgctggtaaagttgaagccgcgcgttcatttggtgcgacaaactgggacatcattaccgatgtctacctacgtgaaggccgttctgaattaatccgtgtatcaacggtcacattgattagtttggtcggtttgacagccatggccggtgccattggtgctggtggtttgggaacaaccgcaatcgtgactggataccaacgcttccaaaacgacgtgatgtggctagcaacgatcttgattctacttttgatcgtcttgattcaattcattggtgatttctttgccaagcgtgcacaccacggttaattaaccaacaacaaaaagaccttcgcagctaaaaattgctgcgaaggtcttttttattattattcggttagtctgatagcggcttaaccggctgatctactttattagtgcctaacagcgcgccagcgacctttaaatcaccaagtgcgtcaatggccgtattaggtacaataaccgtgttagcggggctcttagccacatcacggaaagcatcaatattttgggcagccaaataattgccatcaacctgactcagaatctcattagccttctgaatacgataagcctcagcatccgcagccaagcgaaccgctttcgcatcggcttcagcggttgcaactagcgcatcattcttagctttcgtcgtgagttcaattgaacgtgcttcaccttgcgctcgtgcaatagcagcctcacgttcacgggttgcattaatttgcttattcatcgactcttggatttctggtgttggttgaattgtatcaatgttaatacgatccacatttaccccataagcatccgtaatcgaccccaattcgcgactcaaagcggcgttaattcgttctgtcccgttcaacacatcattcaaatccatcgtaccaataatcccacgtagatgtgcacgtgattgctgaatcattgacttcacggagtccgcattctcaaatgtaaacttatatggatttgtgacgtggtaattcaatgacagtgaaatgatgacttccgcattatcctgcgaaataacactttgttcacttagtcgaattggtacctgggcaagatcaacacgatcaacgtgcgtaatgactggtacaacgacatgcagtcctggttcaatttgtttttgatatttaccaagcacagaaaccatgccgaccatattttggggaataatacggactccggtaaataaaatcaccccaataattaatacaacgataattgctaaaatactaaatactatcatcacccgtgtctcctttttgaacgattaattggttaccaacaacgtctgccacatagaccacatcaccaatagatactggtacatcactctgaagttgataataaataccattcactcgtaacataccgacatcataattatcatgatctaaaacaaacgtttgatgaagcaaccgctgatcgaaattataactcactatcagtcccccgcgatggtactttttccagaatcaatgtctccccgacaacacgagcaacgcgaactgtatcccccatctgcaccccatccaaacaacggtattgatagctttgcccatttattgtaattttgttgtttgtaaaactacctggcgttaaatgaatcgtcatttgaaaaataatattatccaattgtaatgccataatatggtacccccatctgttttattacactcagtatagactttttataacgaaaaataaataaggatgccttgaacctggatagtggcacactatctagtcacaaggaccacaaaaagcccctgttcagtttaagaacagggcttttgtaaaatatctctagacacaaaaaaacctcacacgttaccggtgcgacatcactgccattcaacctagacttggctactgccatcatcgtaacggtttataccatgtaacatgagagatttcattgttttgtattaattaaccaatgaaattagtcaaccaattccaagataaccattggtgcagcgtctccacgacgttgtaccgtcttcaagatgcgagtgtaaccacctgcacggccctcaaagcgaggtgcaacatcgttgaacaagtgttgcaaagccgtttctaccttgaccttgttatcttcagtcgtttgtacgtcagcaacgacgttacgtacgaaagcagcggccttacggcgtgaagccaagtcaccacgcttacccaacgtaatcatcttttctgcagtacggcgaacttccttagctcgagcttctgtcgtttgaatgcgaccgttgatcaacaaagcagtcgtcaaatcacgcaacatagccttacgttgtgagctagtacgtcccaacttgcggtatcccatgagtatgtcctcctttacttggaattctatcgtttaatctaatcttccttgcggaaccctaaaccgagcactgccagcttttcctggatttcgtcaagtgatttccgaccgaggtttcgtacagacatcatttgagtttctgtacgctccgtcaactcttgtacagagttgatcccggcccttttgagacaattataagaacgaactgacaagtccaactcttcaataggagtgtcggcatgcttgctagttggtgcttcttccttgtctaccatcacttgtgtgttaaccgcacgttctgacaactcaacgaatgagttcaagtggtctgacatgatgcgagctgccaatgaaatagcttcagtagcagtcaatgatccatcagtccagatgtccaaagtcaacttgtcaaagtcatcacggttacccacacgcgtgttctcaacttgatagtttacgcgttcgattggggtaaagattgaatcaattgctagaacgccaattggcatttcatcatgcaattccttattctggtccgcagacacataaccacgtccgcgttctgcagacaaagtcatgtgcaacgtagccccagccgcaacagtggcaatgtgaaggtccttgttcaaaatctccacatcactgtcaccagcgatgtcgccggccgtcacagtagcgggaccggttacgttaacttcgagcgtcttctcttcatcactgtcgatgcgcattgaaaccttcttgaggttcaaaatgatttgcgtaacgtcttcaacgacaccttcgaccgttgaaaactcgtgcaaaacgccatcaatttgtactgaattgattgccgcaccaggcaatgaagacaacaatacacggcgtagggagttacccaaagtagttccgtaaccacgttcaagcggctcaaccacaaacttaccgtaattgctatcctcttcaaccagcgtaatctttgggttttcgaattcaagcatactgtttgttacccctttcaaagcattgtgtgaactagttgcaactggcaattagacacgacgacgctttggtggacgtgaaccgttgtgtggtactggagtaacgtccttaatagacgtaacttccaaaccagcagcggccaacgcacggatagcggcttcgcgacctgaaccaggtcccttaacagtgacctcaacagtcttcatgccgttttccatagcacccttggcagcagcctcagcagccatttgcgcagcaaatggcgttgacttacggctacccttaaatccaagagaaccagctgatgaccaagcaacggcgttaccttgaacgtcggtgatcatcacgatcgtgttgttgaacgttgcgtggatgtgtgcaacacctgactcaatattcttctttacacgacgcttacgattagtacgacctgccataatcaagtaatctcctttccttaaaaattaattacttcttcttacctgcaattgcaacagctgggcccttacgcgtacgggcattgttcttcgtgttttgaccacgaacaggcaagcccttacggtgacggataccacggtatgatgcaatttcttgcaatgccttaatgttcaatgagacttcacgacgcaagtcaccttccaccttaataccgtctacgacggcacggatggcgtcctcttggtcgggagtcaaatcacgaacacgaacgtcttcagaaaccttagcttcttccaacaccttcttggcagttgcgttaccgattccatatacatatgtcaatgcgatcacgacacgcttgtcgcgaggcaaatcaacaccagcaatacgagccattacgattacctcctatacaaagatttaataagttttacgaccaaaatgcaaattatgcaccttgacgttgcttgtgcttagggtttgcagagcaaatcaccatcacacgaccgttacgcttgataaccttgcagttatcgcacataggcttaacagatggacgaaccttcatggtatttacctcccttggatatttttatggttgactacttaaagcggtacgtaatacgtcccttagtcaaatcatatggcgacatttcaaccgtcacacgatcaccaggcaaaatgcgaataaagttcttacgaatcttccctgacacgtgagctagaatggcggcgccgttttccaattcaacggtaaacatggcatttggcaaagtttcctttaccacaccagaaatttcaataacatcgttggccacgttgctgcctccttagttgtgacaatggagaacgtaacaagttattataacatgcttacttgtaattaaacaataaaagcttcgttaaataattaagcgttcttcaaattatcaagtaacgtctttacatcagcgaacactacatcaagctcgcgagcaccatcgatcttgttcaagatacccttttcggcatagaactcagcgattggctcagtaagctttccgttaacgtccaagcgattcttaatcacttcaggcgtatcgtctgcacggccacgggccatcatacgatcaaccaaaacatcagtatcagctgtgaagtaaagaacaccgtccaatgaacgaccgtcctttgccaacatctcatccaatgcctttgcttggtccaagttacgagggaatccatcaaggatgaatccaaccttcgtatcctcttctgccaaacgttcggcaacgataccattcgtaacttcgtcagggaccaagttaccggcatccatgaatgactttgccttcaacccaagttcagtttcgttagccatagccgcacggaacatgtcgcccgtactgatgtgcggcaagttgtactcttccacaatcttggcagcttgggtacccttaccaacacctggcaagcccaatagcatgatattcaaactcattttgcttcgactccttcttgaataaatccaacatattgccgcttcatcatcaatccttcaagttggcgaatcagatcaattgccacaccaatgacaatcaatactgatgttcctgacattccaaggttactatccaacccgaagatgtgtgttgctaggataggtgccaaagcaacgaatcctaggaacaaagcgccgactactgacaaacgcatcagcagacctgacaaccacttctcagtggcgcggccaggccagacgcccacgatgtaactaccttgcttttgtaggttctcagcaaccttttcagggttaacctgaacaaaggcatagaagaacgtaaacaagacaatcaacaacgtgtatacaataccaccttgcattgtctgcattgataggtattgcatcaaagtgttgtaccaacctgcatccgcaaacttagttgcaaaagcttgcaaaatcgtttgtggcgttaccagcaatgatgaagcgaagataacagggataacacccgcaacattaatcttcaacggcaagtaagatgagttacctgaacccgttgaacgacgtgtatattgcattggaatcttgcgaatcgcttggttaaaccacgtaacaaacgcgataaccaagataaagatcaacaagataccagccaagaatgcccacccacgcgctgggtcgtcaccttggagaacgtgttccttgaacagttggtatacacctgctggcacacgcgcaatgataccagcaaaaatcaacattgagacaccttgaccgagtccgcgctcagtaatcatctcacccaaccaaacggcaaacattgttcccgcagttaagatgaaaccgatcaacaagtacgtttccaaatttggcgtctctaccaatttaacttgactcagttgattgaatccagcggtgattccaatagattggacaaacgctagaacaatggtcaaatagcgggtcacttggttcaacttgcgtcgaccaacttcaccttgtttcgaccattcaacaaatcgtggcacaatatccatttgtaggagctgtaccacgatttgtgcagtaacgtatggtgaaactcccattgcgaacaatgagtagtttgtaagaccaccaccgctaaacatattcaaaatgctgccgagcccagaatttgctacctcagtaagtgcggccgtgttaatacccggcacagtaatgtaagcacccaatcggtaaacaatcagaatccacaaagtaaagaacaacttcttgcgaatgtccttttccttcagtgaattgagcacggttttcagcattagatcacctcagtcttaccaccggcagcttcaatagccgtaacagcagcggctgagaacttgttagccttaacagtcaatgacttttccaattgaccgtttgccaagatcttaatgccactcaattcgttcttaacgataccagcttcgaccaacaatgctggtgaaacttcagttccgttatcgaattggttcaatacgtcaaggtttacaacagcgtattccttgcggttgatgttcgtgaaaccacgctttggcttacgacggaacaaaggcatttgtccaccttcaaagcccaaacgtaccttaccacgagccttttgacccttttgaccacgtccagcagtcttaccgttacctgatgactcaccacgtccaacacggttgcggacgttgcgtgaaccttcagcaacttggagttcattaagcttcattaggttgtacctccttcaaagcaatctatttatatgcttacttaactacttcaacagtaaccaagtgagcaatcttaaacactgcaccacgcgttgctgcgttgtcaggcaacacgactgatgatgacaccttgttcaaaccaagggccttaacaatcgcacgttgctttggcaaacggtgggcagcactcttaacaagagtaatcttaacttgttcagccattttctgcctccttaatctgccaagtgctcaagtgagacctgacgcaattcagcaacttcttcagcgttcttcaatgagttgattgcatcgaaagttgcgcgcacaacgttaattggagttgatgatcccaatgactttgcagtcacgtcggcaacaccagccaattccaaaacggcacgagcagcaccaccggctgccactccagatccttcaacggctggcttaagcaagatgcgaccaccgccaaagacaccatttgcagagtgaggaagggtcgtaccaacagttggaactgcaacgatgttgcgctttgcagcttcaacggccttgcgaatagcttcaggcacttcttgtgccttaccagtaccaaaaccaacgtgtccgttacggtcaccaacaactaccaaagcagcgaaacgcaagcggcgtccacccttaacaaccttggtaacacggttgatggcaacaacgttttcttcaagctcgccgagcttgtttgcatcgataaaagccatgttaaatttcctccttcccttagaacttcaaaccagcttcacgcgcagcttcagccaaagcttgcacacgaccgtggtacaagtaaccaccacggtcaaatacaacaacttcgatgttagcagccttggcgcgttctgcgatcaaagctccaacctttgctgcttgttcagtctttggagcagtctcaactgacttgtccaaagttgaggcactagcaagcgtcacacccgctacgtcatcaattaattgcgcgtagatgttcttgttagaacggtaaacgttcaagcgtgggcgctcagcagtaccagaaatctttccacgaacgcgcgtgtgtcggcgttgacgcaccttgttcttgtctgacttcgtaatcatgttcgtaacctcttttatatatattcgaaagatatactaacaagtaaatcccgagacgttgcgcccgggccttaagctataagcttaagattacttaccagtcttaccttccttacgtgcaacgtattcgttctcgtaacggatacccttacccttatatggctcaggtgcgcgtacggcacggatttcagcggccaagtcaccaacaaattgcttgttgattccttcaaccgtgatcgtagttgaatcaggaacttcaacggtcaaaccttcacgggcctcaaactcaacagggtgtgagtaaccaacgttcaagacaagcttgtcgccttgcttagcagcacggtatccgacaccgaccaacttcaaagtcttcttgaagccatcagttacaccttcaaccatgtttgcaacgttagcgcgagtagttccgtgaagtgccttgatacgtccttcatctgaaggacgagtgaacgttacttccgtaccgtccacagtgaactcgatttgtgaagcgacttcgcgtgaaagttcacccttaggtcccttaacagtaacgacgttaccttcgcgtgacaattcaacgccagcaggcaaagtcaaaaccttgttaccaatacgactcatcggtagacacctccttattagattttatttattaccagacgtaagccaatacctcgccaccaatcttcttggcgcgagcttccttatcggtgatgacaccttcagaagttgagatgatagcgatacccaagccgttcaaaaccttaggtacagcatctgccttgacgtatgaacgcaatcctggctttgaaatacgcttcaaaccagtgataacgcgagtcttgtcagtaccgtacttaaggaagacacggatgacaccttgcttgtcatcttcaatgtattcaacgtcgcgaacaaagccttcgttcttcaagatctcggcgatgtccttcttgatctttgatgcaggaacttcaactgaatcgtggcgaaccatgttcgcgttacgaatgcgagtcaaaaaatctgcaattgggtcagtcattgacattgatgtttgcctcctattattaattactgtaaatcagtgaatgattactttgcgaaaggcatacccaattgagtaagcaattcacgaccttcttcgtcagtgttggcagtcgtaacaacgacaatatccaaaccacggacacggttaacttgatcgtaatcaatttctgggaaaataagttgttcacgaattcccaacgtgtagtttccacgaccatcaaaggcctttggtgaaactccacggaagtcacgaacacgtggcaatgaaacgttgatcaacttatccaagaagtcgtacatacgctcaccacgcaaagtaaccttagtaccgattgccataccctcacgcaaacggaagccagcgattgacttcttagcgcgagtgataactggcttttgaccagcaatcaattccaattcagcaacagcttcatccaagttctttgagtttgatacagcgtcaccaacacccatgttaagcacgatcttttcgatcttaggtgcttgcatgattgatgagtactcaaacttttcgatcaatgaaggcgttacttcattgacgtacttttccttcaagcgatttgccatgataatgatttcctcctttcacctagaaattatgccaaagtcgttccagacttcttagcaaaacgtaccttcttaccatcttcaaccttgtaaccaaccttagttggttcgttagtagaagggtcaagcaattgtacgtttgaaacgtggattggagcttcaagctcaacaattccaccttgtgggtattggttgtttggcttttggtgcttctttacaatgttcacaccttcgacaacaacacggtccttggcggccaaagtctttacgactacaccttccttgcccttgtccttgccggcgataaccttaaccttgtcaccagtcttcacaaacatgcgaggcttcctccttgatttaatgatggtaattacaatacttcaggtgccaatgacacaatacgcatgtaatcattgtcacgcaattcacgcgcaacaggtccgaagatacgagtacctacagggctcttgtcatcctttacgatgactgcagcgttctcatcgaacttgatgtatgaaccatcagcacggtgaactcctgaaacagtacgaacgataacagccttaacgacgtcacccttctttacagtaccaccaggaatagcttgcttaacagttgcgacgatcatgtcaccgataccggcgaacttacgacctgatccacccaaaaccttgatagtcaagatctcacgtgcaccagaattgtcagcaaccttcaaacgactctcttgttgaatcacgattttgtcctccttccgttattggtaagattcgagattaaacgattagataataacggccttctcgacgatttctaccaaacggaagcgctttgtagctgacgttggacgcgtctccatgatgcgtacaatgtcaccttgcttagcttcgttgttttcatcgtgagccttaaacttcttcgtgtacttaacacgcttaccataaactgggtggttcttgtaagtttcgatggcaacagtgattgtcttgtccatcttatctgaaaccacgcggccttggtaaaccttacgtgcgttacgagcttcagtcatatcggtctcctctcttagtctacttgttcaattcttgttgacgaatgaccgtcttgatacgtgcgatttgcttacgtacttctgacaatcgagccgtgttctcaagttgaccagtagctaattggaaacgcaagttgaacaattcttccttgtagctcttttccttggcaaccaactcagcttggctgagacccttgatttcgttttgtagatccttgatcttcattattcaccctccacttggcgagtcaagatcttagtcttgactggcaacttgttagatgcaagacgcaaggcttcgcgggcaacctcttcaggaacaccggcaacttcaaacattaccttgccgcgcttaacaggtgcaacccatccgtctggagtacccttaccgttacccatacgaacaccaacacccttagaagtgtatgacaagtgtgggaaaatcttgatccaaacttgaccaccacgcttcatgtgacgcgtcatagcaatacgagcagcctcgatttgacggtttgagatccagtgtgattcagtggcttgcaaaccaaactcaccaaatgtaactgtcttaccacccttggcctcaccgcgcatctttccacggtgtggacggcggtactttacacgctttggtactagcatgttactcgcctccttgcttctttacagacttcttctctggcaaaatgtcaccacggtaaatccaagtcttaacacccaattgaccgtaagtagttgttgcctcatcccatgagtagtcgatgtcagcacgcaatgtgtgcaaaggcaccgtaccctcagtgtattgctctactcgagcaatgtcagctccgttgatacgtccagaaacttgcgtcttgatacccttggcaccagcacgcatagcacgttggatagcaccacgcattgcacgacggaatgccacacggcgctccaagtcagatgcaatttgtgaacctaccaagtgggcgtccaaatcaggcttcttaatctcaatgatgttgatgtggacacgctcgcccttagcaaccaactttgaaagttcgttacgcaatgcatcaacttcagaaccacccttaccaataaccatacctggcttagcagtgtggattgagatgttcacgcggttagcagtacgctcaatttcgatacgtgaaactgatgcgtcagccaacttagtctcgatgtacttacgcaacttcaaatcttcgtgcaaagccgttgcgtagtccttcttgtttgcgtaccacttagcatcccagtcgcggatgatgccgacacgcataccagttgggttaatcttttgacccatgactcaatcctccttacttttcttttaccacaatcgtgatgtggcttgtacgcttgttgattggtgaagctgaacccttggcacgtggacggaaacgctttagcgttggtccttcgttagcaaaggcttctgcaactaccaaatcttcgcgatctagtgagaagttgttctcagcgttagcaactgctgagttcaacaccttgtatacatcttctgagctgtggtttggcaagaattgcaaaattgcaaatgcctcagccacagacttaccacgaacttggtcaagcactaggcggaccttacgtggagcgacacgaacgatcttcgctgtggcgcgtgctgacgtgatttgttcagccattgtattgtcctcctatattacttgcgcttagtcttcttatcgtctgctgcgtgtccgcggaacgtacgcgtagggacgaactcaccaagcttgtgaccgaccatgtcttcttgtaccaaaactggcacgtgcttacgtccatcgtaaacagcaaaagtcaatccaataaagctagggaaaatcgttgaacgacgtgaccatgtcttgatgacagcttgcttttctgaagcgttggcttcttcaaccttcttcaacaagtgagcgtcagcaaatggtcccttcttcaggctacgacccattttaaggtcctcctctcgtttgctaaaaacttattaattacggagtgtaagtgattacttgcccttacgaccgcgaacaatgaacttcgttgaacgagccttcttgttacgcgtcttcttaccggcagtcttcttaccccatggtgacattggtgatggacgtccaactggagcctttccttcaccaccaccgtgtgggtgatcgttagggttcataactgatccacgaacgtgtggacgttgacccttccaacgacgacgaccagccttaccccagttgatcaatgagtgttgttcgttaccaacaactccaactgtggcacggttaacggccaagatcatacgtacttcacctgattgcaagcgaacaagtacgtactttccttccttacccaacaattgtgctgatgcaccagcagaacgggccaattgaccacccttaccaggcttcaactcgatgttgtggatttgtgttccgtcagggatgtttgccaatggcaaagcgtttccgaccttgatgtcggcttcaggccctgattgaacagtcattccaacttccaagcccttaggcgccaagatatatgccttagtaccgtcagtgtattgcaacaaagcgatgttagcagtacggtttggatcgtattcgatcgctacaaccttagctggaacatcatcctttgtacgcttgaagtcgataatacggtattggcgcttgtgtccaccaccacggtggcgcacagtcatgtgaccgtatgagttacgagcaccagtgtttgactttgattccaacaagctcttttcaggcgtcgtcttagtgatttcagcaaaatctgaagacgtcatgttacgacgaccgttagaggttggcttgtacttcttgatagccacgctaatttcctcctaattagttttcgttgaacaattgaatgtccttagaagcggcagtcaacttaacagttgccttcttacgcttcttagtgtaaccagcgaaacgtccttgacgcttcaacttaccacgtacgttcgccgtgttgatcttttcgatcttaacatcgaaaatctcttcaatagcgcgcttaatttgtggcttagtggcgcgaacatcaacttcaaacgtgtagcgcttttcatccaaaacgctcatcgtttgttcagtgatgaccgggcgcaaaatgatatcgcgtgcgtccattatgccaaaacctcctcaacttgtgccaaagctgattgaactacaaccaacttatcgttgttgattacgtcaagcacgttaacaccctttgcagtcataacagtaacgttttccaagttacgtgctgccaatgctgcgttagcgttatcatcgtccaagacaaccaacgtcttttcatttacgttcaagttgttcaaaactgccttgaattccttagtcttaggagcgtcgaatgacaatgcatcgacaacaaccaaagctgagtccaaaaccttttgtgacaacactgacttcaatgccaaacggtaaaccttctttggcaacttgtaggcgtatgaacgtggagtaggtccgaagacaataccaccaccacgccattgtggagaacggattgaaccttgacgggcacgtccagttcccttttgacgccaaggcttcttaccaccacctgaaaccgctgaacggttcttaacggcgtgagtaccttgacgcattgatgcgcgttgcatcaaaacagcgtcagtaacaacgttgttgtttggctcgattccgaagattgagtcgttcaactcgatctcaccggcgtttgagccgtcttgcttaaacaaagcaaccttagtcatgttagtttcctcccttcgtccttattacttagccttaacagagtacttaacagtaacaagtgacttgttggcaccaggaacattacccttaaccaagatcacgttgttttctacgtcaacgcgaactacttgcaagttttgtacagtgcgcttgtggttacccatgcgtccaggcaacttcttacccttgaagacgcggttgatgatggcacccaatgaaccaggacgacggtggtaacgagaaccgtgcgccataggaccacgtgattggccatccttcttgatgttaccttggtaaccatgaccctttgtgattccagttacgtcaacagcttcgccagcagcgaagatatcaaccttaacttcatccccaacattgaattctccctcagcgtcgcggatttcacgaatgtagcgcttaggggccgtgtttgccttggcaacgtgaccttgctcaggcttgttgctcaaaacggcacgcttgtcttggtaacccaattgaactgcgttgtaaccgtcgttttccaaagtcttaacttggagaactacgtttggcgtagcttcaattaccgttacggggataagctcaccgttctcagtgaatacctgagtcatgccgactttgcggcctaagatacccttagtagtcatgactatctcctttgaatagtaaatctaaatttttgatcagttaaatgcttaatcaggcaagttgttgtttgttgttgcgttgtaaaaattacaacttgatttcgatgtcaacaccacttggcaattcaagctttgacaaagcatcaactgtcttagcagttgggttcacgatatcgatcaaacgcttgtgagtgcgcatttcgaattgctcacgtgaatccttgtgcttgtgtggtgaacgcaaaaccgtgtacaacgtacgctcagtaggcaatggaataggacctgaaatttcagcacctgtacgctttgccgtctcaacaatcttttctgctgaagcatccaagatcttgtgctcgtacgccttcaaacggatacgaatcttcttacttgccatgatataaattctcccttcgtccatattggaatatgaaactaactccgtggaaactaccgacgcaccccaaagagctccatggcaatgggccccgtggcaatgctgccgggtgtgtcgcaacctcccacatcatcgcttgtcgatggcacgctaatatacccggggcgaataccccgtccgtatttaacgtactagaatataatacagcatactaaatgcattagcaagctttttcgccaactttgttgtgacaaatgtatcaccttttttcacgctggcttcataattaattccgaaaactataataactaatttcctaactaattaccaccctttaggcttacgaatttcttttcgattcttgtgcgttgaaattatcgtgtttattcatgatgattcctatataatagtacttagtttacacatacagttatgttgattagagttgtttgccactttggccactttatttcaactatacatatagtagtaattaaggagtttcccgatcttatgacgcattcacaaacaacattacatccaatatgggatgagttccctgctattcgtaaggagctgcaaggggtattagatcgtatcgaagctaacctagacgccaatgacgctgacgtcgaagccgcccttatagatatgttctcgcatggtggcaaattgctacgccctgcattcacgattttgattggtcgtttctttccagcagagcgtgaaccattattgaacctggctgcaacggtagaaatgttacatacagcctcacttgtccatgacgacatcatcgacgactcacccaagcgacgtcacgccgaatctgttcagtcacgattcggtaaggatgttgctgcctatacgggggactatctcttcgccgtaaccttccgtacgctggccgacaacacaaacgacattaacgtcgttcggatggcaacgcgttacctagaacgcatcctatctggtgagttaacccaacgaacaaatcactataagcgtgatatgaccatcgcaaattatgaagatcaaatcgccggtaagacagctgccctctttgtgctagctgctaacttagggatcgctgccagtcatgcacccaaagactttgcggacctcgcaaccgacttcgcttacaacgttggtatggctttccaaattcttgatgacttactcgattacagtgctgatagtacaaccttaggaaagcccacactgaatgacgtccgtgaaggggtctactcagcgcctttgattattgccatgcaagataacgaggagatccaaacgctactcgccaaaggggctacaattagcgatgatgaggccgttcacctgggtgaattggtccgagcctctggtgcactagccatcgctgaagacatggcagtcgcctatacaaatacagccctagaacgactatctgacatgcctgaacacgaatcaaagcgcatcttactcagcatcagtcaaacgctacttacacgtaacgattaattctgcattattatatagaagaaaagcacgtaacagctgaaaaaagttgttacgtgctttttatattagtcttcttctaaataatcaaattcaagggctggattagcatttaatgaccaatcaccacgcttaccatgccgataagcgatatccccagctgcaccaatcatcgctgcattgtcgccagccaacttaattggcactggaataaatgtggtctctggaaaatcagccatcattgccgttaatccatcgcgtagaccacgattggcagcaaccccaccagctacgataaatgatttcacgggataattttgtagtgcccgtcgtgtcttagtaaccaagacctcaaccacggctgcttggaaggaagccgctaagttaacatggtcaaccgtttcgccacgttgatccgcattgtgcattaagttaatcaccgcgctcttcaagcccgagaaagaaaaatcatagcggtcatcattcatgagtgcgcgtggcaagtcgtatgttggttcaccttggtgcgccatctcatcaattgtcttacccgatggatattgtagtcccatcgttcggccgaccttatcgtagctttcaccagcagcatcatcgcgcgtatcaccaattacaaggtaatcgtattcctcacgcatcaacaccaactccgtatgaccacctgaaaccatcaatgctaaggccgggtattggatgggggccacaaagtttgctgcactgatgtgacctgctaagtgaataactggcactaacggtaattgatgcgcccaagcaattgtcttagctgccgtcaccccaatcaacaacgccccaaccaagccaggtccttgagtaactgcgattgccgtcaaatcttggtatgttaatccggcatcctgcaaagctgcatcagctaataccgttacctgttcaatgtggtgacgactagcaacttccggcacaatgccgccaaaacgttgatgacttttaatctgagtagctgtctccaagctcacgatttcaacaccatctttaacaatggccacacctgtttcgtcggcacttgattcaaatgccattatgtatcgcgccatcttgtcctcctattccgctgctaatggtaacgtgacatccattagatatgcatcttctttcggatcacggtaataatcctcacgaatgttataaataataaagcctagtcgctcatataatttgattgcccgtttattaccttggcgcacttcaagtaaaatgcgtgtgcccgcatcaaagccaactaaccattggcgtaagaggcgttcacctaagtgttggccctgaaccccaggcacgatggcaacgttggtaatttcaagttcctcacccaaatgtgtgccaccaacaaatccaattggttcgccatcagcttcaataatcatgtatcgggcaaatttgcttttcaaatcattggcaaaggtttgttttgaccaaggtgatcctttatacgccgctttggcaattgcataaagttcctcagttgtcgtttcatttctgaacgtaaaatccatctgtttttctcccgagaatctgcgccatgtccagtgcatcttccccgttgtcttcataataatgtgctttgcgtcggactacctggaaccctaagcgttcatagagccgttgggcacttgtgttagacacacgcacttccagtgacatccgattaaagcggatttgcttagcaaccgtcatcatatacatcaataggaacgtcccaatgcctcgtccctgccagtgcggtgcaacggtcacattggtaatgtgcacctcgtggatacctggacggaaagctgccccaatataggccaccatcgcgccggtctcaggttcgcgcacaacgacatacaaccgttctcgtgaacgatgtaactcgttatggaaaatatcagcagaccacggctcttccccatggtaagcttcccgttccaattccaccatttcatcaacatcttgatactgcgccggcaccaattcaaaatcgaaccctttgacgctgattgtctgcttaaattctcgtaagctctgtggtagcggatgcatttgccagtgtaaccagtttttaaaccttttccacataaatgccatcacctgcgtcagggtgtgcctttgcccaatctgcctcagcttgtgaaaggcggtagtaatttggcacaaattgatgaatatcagctatctccgttagtaccggcgcatccgttgttaacatcatcatattagccgcatgtggtaaattgtcttcagcaaatgtcacctctggcagtgccatttggagctcctctgcgaagcgagcccattcaccaactagtacgactggtcgttgttcttcacgaagcgttgcaatcaacttcgtcacattagtatgccggtctggcgcaacctggacgaggcgatcgttgtcgcggacatagccgccagcatacaagttgtcattccgggcatccataatcggtacaatcaccgcatcagaccgcaccacattcgttgccaagactgccaagctcgaaaccccttgcaacgcaatctgcaatgtaaaggccaacgttttcgctgtcgtcactgcaatccgtaagcctgtatatgaccctggtccttggctcacaattacccgatctaggtctgatggttgccaaccagcttcatgcactagttcgtcaataaaaggcaacaattgtactgagtgatttttggcaacatttgtctcgcgttgcccgattagtttgtcatcctcaaacaacgccacactaagtggttgattgcttgtatcaaaggcaatagtcttcatgattacctttctcccatcattttttacacgtaaatgtctaactgctattttaccgcattttttctggattaacacaaaaaccccagagtggtaaactctagggttcatttattgattattaacgatcttcgtaaccgtgtgggtgttgttggtgccaagtccatgccgtcttgataatttccttaacgtcatcgtactttggcgcccagcccaacacttcgcgggccttagctgaagaagccaccaatgagtctgggtctccggcacgacgtggaccaacttcggcaggaatttccttacccgttgcttcgcgtgctgcttcaaccatttgctttactgagaagccgttggctgaacccaagttaaattggtttgactcgttaccctttgccaagtaatccaaagccaaaacgtgcgcgttagccaaatccataacgtgcacatagtcacgcacattgaagccgtctggtgtgttgtagtcatccccaaacatcataatcttctcacgttgacccaaagccgtttgcaagataattggcaccaagtgcgtctcaactgggtgatcttcaccgattgaaccatcggccttagcacccgcaacgttgaagtaacgcaaggcaacccacttcaaaccgtaagcttcatcagcccacttcatgatgtgttccatttgaagctttgactcaccatatgggttgattgggttttgtggcgtcgtttccttaattgggttttcttcaggaataccgtaagttgcagccgttgatgagaagacaatttgcttcacgtcaaactccaacattacttccaacaaagcaatcattccagccgtgttgttatcgaagtactttagcggatcagccattgattctgggacaattgaagaagcggcaaagtgcacaacttgttcaatattttccttttcaaaaacctcacgcaaagctgccttatcacgaatatctacttcgtaaaaaggaactcctgcaggaaccgcagcgcggtgaccggtcaacaagttgtcgacaaccaccacgtcacgtccatctgacaacaacgtatcaaccatgtgtgaaccgatgtaaccggctccaccaagtaccaaaatggccatgtttgtatctcctaaatgatttattacttcttagtttagcttaattttcagcgtccgtccattcgattgccgcttcggctgacaaggtatcccctgaccaaatgcggtgaatcgtggcatcttccaacgtttgggcttctgacttaatcgtgtcacccagcaaaacttcgtgctcgtacttaatgttcaagcgcttgggttcatgagtcttcacaaaatcgtgatccaacacgtcttgaatccagtcaaagtactttgaattattcacgtgttggtttgaatcgatatccaaatagcgcaccacatattcttgcgtcacatccactggaatatcagcaatcatatgttgtggctctggttgacgtggaatcttcttcacccgttccggttcataagcatccaccatttcttgcggaatacgggccatgcggcgacgttccatatcaatcatggcatacaacgcatcaatttcaacgagcacattacccgcttcatcaagaatgcggtacatacgcttggcaaagaaggggttaaactccttagccaatgtttgcaacgttaaattctcaccgatttttggtcggcgattaatttcaaccatgtgctgtagaataatccaaccaattccttgcgcgtggacaaaatccggtcccacctcaagatcaacgctttgttgggttgagctcaggacagctagattaaaaatcattggtaagctcaacttacctgttacgtctgcttcgtagtacagcacttggtgttgcatactgtaaatttctgccattgttctaattttctccttggtattccaagtacaaggcttgtcggtccaagtcacgggccttagcaatttgcttcacagccgccgtggctttcatgcctgattcaaccagagcacggaccgcttgcactggtgtcatatcggcgagtgggtcatcatctgcttcggtaaccgggttatcatttcccgccaccatcatcacaaattcccctcgcacttcattttcgtttgcccaatccgccaactcttgcgctgtaccacgcaagaattcctcgtagcgcttcgttagctcacgcgctaagacaacctgacgttcgggaccaaacgccttcacaattgtttgcagcgttttggccaaacgatgcggtgcttcataaaaaatcatcgtttccgtatggctattaagattctgtagttccgctagttgttcctttggcttgcgagctagaaagccataaaacatgaacggttgcggtgcaaggcctgaggcaatcaacgccgtaatacctgcactcgctcctggcaacggtacaaccggaatattttgggccaccactgccttaaccaattcgtgccccggatcagaaatagatggcatcccggcatcagaaacctgcgcaacatcctcaccagcggccaaacgcgccaccaattctggaatacgcgtctccttattgtgttcatggaacgacacttgtttggtttgaatatcaaattgattcaacaattgttgcgtatgacgggtatcttcggccgcaatcaccgcgaccgctttcaacgtgtcaattgaacgcacggtcatgtcacccagatttccaatgggcgttggtactagatacagcgtacccgtggtatgtgtggcaaaactcttttgttgattcatgataaacctgctaacttaaattgactttccaaaaccgttgattcaaccgttgtttggaaattaatgttcttttgtaatcgttgtggtgcagctaagacgatatcaaggacggctaacaacgtggccgtcgtatagcgttggccgtcacgttgccaggtactaccagctgaaaaacgcactggtacatcacccgttcggctcagtagaatgtcacgccaagcttgcgccatcattgcgagcaagacgcgtgcccgatttggttcaccagctaacggcaccaaattcgtttgcaccattgtaaaggcagtatcgtctttcttgagtgtcgctgtcaccaggttacccacggcctgctcagcttgttgaaaccaatcatcaactaaccattcagctgccacctcgctactgtcagtgagcgtccggactaactcagcctgggttgcattgaaaccgaccgccattaatgatgactgcatctgttcggggcctaatgctggaaaatcaactacctgggtacgtgacacaaccgtcggcaaaatttgtgcgcgattttcagcaatcaaaatcgctgtttgttgcccaactggttcctcgataaacttcaataacccgttcgctgcgctgcttgtcatcgtatcagcgccagcgacgataaagactttctggttaccttcaaccgcggtcttggtaaactcatcccgcaagaagcggacctgatcgactttgatactattaccatcaggcgctaattgaatcacatccgggtgttcattagacgcaatgcgttggcactgatcacacatcccatctggttgaccatccgccgtcacgttacgacacatcaggcgcattgctagccaatccgctactagcccttggccacggccacgtggtccagtaaacaaaaaggcgtgggcaagttggtcacttgccaccgcctgtttgaattgcgcaattaattgcggttgttgcgcatttgcctgtgcaattaattctttggcgtccatctgcactccttagaagcggtggaattgttcaatatcttgaacaaacaccgtagccccaccaacttgaacttccatcggcgttgtggccgttgactccattgaaacatccaaactaaccgctggcgtcataaattgcttacgcgtgtgtgacgtctctttgataatctctaacacctcagccacacggtcatcttcaattccgaccataaacgttgtgtttcctgaacggaggaagccacctgaagttgccaaacgcgtggcacgcacattggccttaacaaattctaatcctaacttgttcgcatctttatcttgcacaatcgcgataaccatcttcataagccgaacctcctagtcctttaaaccgagtaccggtgccaatgctgcccatgtgtcagcaatcaccgcatctagattttgttctgcatcaattatcaaaaagcgttctgggtccttcgctgctagcgcatggtaagcttcagaaacccgttggtggaatgataacgcctctacatccaaacgattcacttcgtcttgacgagtcgtttgaatgcgattgagaccgacttccggccggatatctaagtataccgttgccgttggcatcatcccttcgattgcaaagtcgttaatcgccgtaaccgcatcggtaccaatttcgcgaccgccaccttgataggcaatcgaactgtcgacatagcgatccgtaatcacaactttatcagccgcaagtgctggtaaaatcgtctgaaccaagtgttgccgacgtgacgctgcatataacaatgcttccgtcttcttatccatctcggtatttgccgggtctaacaccaaatcacggatagcctctgcaattttgtttcccgtcccaccaggttcacgcgttaacaacagacgctctcccaataccggttgtagccgagcgacgattgcacgcagtacagacgtcttaccagctccatcgggtccctcaaacgaaataaatgttccagccatcgttgtcaccactctcactttttgttttgtactatattatagcaaaaaaaagagcagtttaggtattcaacctaaactgctcaaccaattcaactagattgaccaatcaatattctctggctttacgaacgccaattcaaacaaataattcgcaatacgcttctcagaccacttgctaccgtggtctggcaatagccgtgaattatcaatcaaacgttccttcacccactttgcattggcgtctgaccattgcgtattcttggcaatgattgcaccaaattcagcgtttgaataagtcttatcgctcataactcttctcctcttcccaatcctaactacaactcagggtgtacaaaggccgttgaccaatgccccttcatatcacgatgccgtgctgcccgtaggaggaagaaatacttttgtcgcgctttatctgtttcagctttaatcaatcgtggatcaacatcgctttcaaacatggcaacttctgacattttcgccttttcatagtcaaacttagcacgatcgatagcttgcgatagctgttcatcatatgctttcgtatccaccttagggcgcttaaacaagttaaacattaaagcttcgtccttccttccacggccttgatcaaggtaatctcatccgcatagtcaatgtcactaccaactgatagtccggttgccaaacgtgacaccgtcaacccagctggcttcaacaaacgtgacaagtacatggctgtcgcttcaccttcagcgttagcattcgttgccacaataacttcttgaatgtcttcgtctttttgtaggcgcgtaaccaatgactcaatattaatgtcatcaggtcccttaccagacaaaggtgacaagacaccgtgcagtacgtggtacaaaccgcggtactcacccgtattttcaatggccattaagtcacggacttcttcaactaccaacacttggctttgatcacgcgttggatcagagcaaatggcacatggttgtgtttccgttaaattcccacagattgagcaaaagcttaaatcacgctttgctgaaatcaacgattgggcaaagcctgtcacgtcttcttcctgcatatcaatcgtgtggaaagccaagcgagttgcggtcttgataccaatcccgggcaacttagtgtaactatcaattagtttagcaattggttctggatattgcacgttacacgccttctttctctataagtgcgttgtctcttagaacattccctttggggcatattgccccaaacgcttttgttggtcggcctcgatttgttgcaaggcatcgttaacagccaccaaaatcatatctgacataccatcgacatcgtcagcatcgacaatttctgggttgatttgcaaatccttcaattcgcggttaccgttgaacgttgccaacacaacatctgaaggtgcgtggcccgtatagtccgttgctgcaattgcttcttgctcattttgcatttgctcttgcatcttcttcacttgcttcatcattgattgcatattttgtccaccaaacatatctggtccctcttttctaacttaattaatcatctatttcttcaacaatatcactgccaaacagacgttcagcttccgcaaccactggtgctggtccaacttcagcttccgaggcgacgtccatcgccgttaagctagctaaatcatccgccacagcggtggctgtttgtgtctcaacctgctgttgggtagctgtcgtttgggcagtgcccttacgttgcgccacaaaggccgcacgcatcttaggccactcttcggcattaacaaagaccaattggcgttcatgttgtgcctgggtcaaattttgaatttgtgtcaccatcgtgttcagtagctccgcattacgcatcgcgtttgacttaatgacatcaaaatcaaaaccgacaaccagtccttctggtgacgccgcaattggacgcgccacattcagcatcgcttgttgcggtactggtagcatattcaccatgtctgcccagacggcaaccacccggtctaagtcaccacgcgtcgcggcactcaaaacgctaaacactgctgcctgatcatcactcacacgtggtgccacccgacttggtactggcgctggctgagctaccggcgtttcattaacttccggcgccgtacttgctggttcacctgtcggctccgaaactggcgcctcgctaaccggtgctggcgtcgttgactgagctggcgctggtgtcacggcttgtgggcgttgtggctgtggctcagcgacaacttgagttgctgatacgcgttcaacagtcactggtgccgttgttggcaatggctgactcaacttaaccgtcaacacttccaggtagatacttggtcgatttgtatagcgtagttgttgctgcgtatcattcagcgtatcaatcatccggtaccaaacagttgcaggtgtatcactcgctaatgctttaaaaatatcatccgggacaatactgattaattctggcgcttcagtatgcaacaacaaatcacgtgcatagctaatcagatcttcaacaaaacggctagcatctttaccagctgacaacacttcagataacttcgctaaggccgccttggtgtcttgctgcacaacagcttgtacgtactcacccaataatgtttgggtaactgaacctgtcactaacaacgcattttctagcgtaacatggccatccccaaacgagagcgcctgatctagaatactcaacgcgtcacgcatcccaccatcagcagcgttagcaatcacgcgaatggccgcttcatcgtaagtatcacctcgttgatccaagatgtacgtcatacgatcgtacgctgccttcgcatcaattcgcttaaaatcaaagcgttgcgtacgtgaaatgattgtggctggaattttttgtggttccgtcgtagctaaaatgaaaatgacgttagctggtggttcttccaaagtcttcagcaacgcattaaacgcccctgtcgacaacatgtggacctcatcaatgatgtagaccttgtacttcgcttgcgttggggcgtaattcacatcctcacgaatctcacgaatttcgtcaacaccgttatttgatgcggcgtccaattcaataacatcccccaacgtaccattatccgccgcttggcacatggcacaaacaccatcaggttcaccattaattggattcaaacaattaatggctttggcaaaaatcttggccgctgatgtctttcccgttccacgtgggccgttaaacaagtacgcgtgcgttgtttggcccgtcatgatagcgtttttcaacgtcttggtcacgacttcttgaccgatcatatcgctaaatttttgcggacgccatgtccggtacaacgcctgatacgccattgtgtgtgacccctttcaacactgtcaatttagacagtcaactaagaatatttcctactcttatattaccagaaaaaagtaaaaaaaacgccaaccgattaacatcggttagcgattaaagttcataagaagtgaagcacaatgcacggtctccttagtgctgctgccttccgaccctgacacggttcgaagtgcacacttgccccacaaacaatattatagcaggtgcattacttttctgcaaatgcattagggttttcttgcgcagctaactcagccgcgcggcgcgctttcttttccgccttcttttgcttacgaatctcgcgaaagaaattacgcaacatatccccagattcctgttcacgaatcccttgatgcacatgcacttggtgattcaaacgttcatcttctaagatgtgatacatcgagtgaacagcgccagccttcggatcttcggcaccatagtagacatcactaatccgcgactgttgaataatgccggcgcacataatgcatggttctagtgtgacaaacaattgggcatcaggcagacgccatgacttcaccagccggtttgcttccgtgatggcttgtaactcggcgtgttgactagcatcttctaaccgttcacgcaaattaaagccacggccaataatctcaccgtgttgtacaaccaccgcgccaatcggcacttcacctaatgcaccggccttcttggcttccttgatggcctcacccatgaaataatcaacttgttcaggcgtcagctcgctcatggtatacgctctccaaaatatagtaacccttgttcttcgcgatagttgcggcattaccaaacgtttctgtcatcaatgccttcgctgatggcgcgccttgtttcttctgcaagaccacggtcaacgtaccaccatcaaccagataatcctttgccccagcaatcatatctgacacaatttccttacctgctcgaaccggtggattcgtcaaaatcgcagcaaacttaccatcaaccccagaataacggtctgataacaccacgtcgatgcgatctgaaaccccattcttttgggcattacgctttaccaattcagcggcacgctcattaatttcagccgcaacaaattcacgatcaggcatcaccgttgccaaagcaatcgatactgggccgtaaccagcacccaaatccaaaattttgccagctggaatgtcttgatcaaacgcttctagcattgttcgtgtcccgaaatctacggtagacttagaaaagacacctgcgtcagtcgtaaacgttaaggaatgttcaaaaagcgggaatgtccaagtgtgctcgtcgtgcgcaacacttgggttcgccgtgtaataatgttcagccatgtgaacctctttctatcttcaggtgtcagacatcctgataatcttcaaagttttagtctataaaccattgtaagataaaggcactaattataaaagcaaagtacttgggggagtatgacatgacaacacatacaatcggcgtttttatgggcgctcaatacggtcatctagaagaattccatgaagcggccgcagccatggggcacggtatcgccgaacatggctggtcattagtctatggcggttctaaaagcggtttaatgggcgaagtcgctgttaatgcgattaacgccggggccgacgtgaccggtattcggcctagtagttttctaccagaagaagccggtcatgagttacaaatgacccacattgacgttcctgacatggatactcgcaaacggatgatgtttgagcaagcggatgcattcgtctttttgcctggcggcatggggaccttagaagaattgggccaagtgatgtcctggaccaagctaggatattacgaaaagccaatcatcttagttaacattgccggcttttgggacgatatggtggcctggtttgaaacggccatcgatgcagaatttgtgacacgtgaaggattatcgcatttggctttgatgccaagtgtcgctgaaacgttcacgtatcttgaaggtgaattcgaagaataataaaagagctgcgcatgattatcgtcatacgcagctcttttatttaagcaataatatctgttttttcaaccatccaggcagccaatgccatcaaaataattaacaccattaacacaatcagttgaatcgtccaactatgccatagtccaaaaccgtaaccgaatagcgttggtccaaaggcggccaataggtatccccctgattgggccattcctgacaattccgccgttcgggttggggtcgttgtcttaactgagaacatcgttagcaagtatgggaacagcgccccgccagagaagcccatcaataagttaacaaccaaccaaaacaggaacccatggccattaaagagcatcatacccacaccaataaacgctaatgctgaaaagccgaccatcacccaacgacgggtttggttgccccaacgagtaaacgcggttggcaacacaaacgtcagtggcaatgtaatcagcgtaaagattcctgataagtaaccagctgcttcggccgacaaacccgtttgttgcgccattgttggtaaccaagccatggccgtgtagtaatacaacgattgcaaaccaccataggccaacaaataccaagcacgtttattgcgccaaattgaagtatgcgccccgtcttttggtcgtgcctccaagacgtggttgtgcttaacgttgggtaaccaaaccacaaacgcaatcacaataatcactgacaaaatcataatcagtgtctgccaattcgtggccttaacaattggcaccgctagtgatgacgccaagatagtggcaattgtcatcgctaacgaatacgttgacgtatagcgcccaatttttgttggaaagttggcaacgactgcactaggcaacaacacgttcaacgtcgcaatgccgaccccgatcaacaccgtccccaagaacagcaatggcattgacgcaattcgcatcaatgaaccaattgccatcaacaaaacaaaaatagcaaacgacttctcgattccccatttttgaccaaactttggcgcaaacggtgaaacaatcgcaaagcttaataagggaattgttgttaaaataccaagcgaactgactgatacgccaagtcccttcgcaacatcgctaataactggcggaattgacgtaaagggaattcgtaaaatcatccccatcatcacaattccaggcaccaatagtggtgacttttgctgttcatccataaataatatctcctcacacaatacaccgctctctaaaacggcatttcccagtgtagcgtaacaaaaagcgctacacaacaacgtgtagcgcttcacttacatgattttacttatcatatttagccaggaaatcagcaaccttttgctcatacttcgctggattagtcgcatatgattggacgtgcttagcgcctggcaccaagtacttttcctttggaccatttgacgctttgtacacttggttcaaatacttcgttggcacaaacgtatcattaccaccgtgaataaacaacattggtcgtgtattcttggcaagtaacttaactgagctagcttcaaaataatcataaccagccatcacctttgagtaggttgatacaatcggcactagccccttggccaaccaatttggcatgccgtacatatcaccagcttggtagtaaatttcatccgcaacagacgtataacctgcgtcttcaatgtaagctgaaacttgcttaggtgggttcatcccagatagcatcatggtcgtagccgcccccattgaagcacccataaccgtgatatcgctatcttgaccattcttactaatcacttggttaatccattgcttgtagtccttggcatcaaggtaaccaaaaccaatgtacttcccaccagactttccggccgcacgatcatctggcatcaagacgttgtatcccatgcggtggaacatttcaccgtatggcgccattgccttgtgatcaacaccaaacccgtgaatcacaatcgcggtcttattcgtcttcttcgcagcaggcacatagttaccaactaacttcgtgccatccttagcagtcaagtgccacgtctgagcatccaaatcaaaccaggcttcttgttgtttgtataacggatccttcttcgttaatacgccactaccgacgaaatccttcttcgcacggacttcagcaacgtggaagaagtagccaccagctgctacaacgagcacaatcaaaaccacaatgatgctaactagccatgtgattactttgcgcgatgttgaccagcgcttcttttgctttgccatttcgcaaatctccctatatttattaaacaaataattgcaacctgtccattatagggaagatacatgaaaaataaaaggtataccccgttaatcataataaaaaggcataaccattcgatcatgcctcgccaagaatttacttcaaatattgcaatgtgcaccaacctatcatgccaatcagtgcaaacagcaaccaataataccgagctaaaaattcccacccatttgtgattggactatattgccactgacgccaccggtgattttgatgccaatctttatcggcctcatcttgctgcatatattcactcactttatcgcgaaatgacgttttacccggttcgacctgagtaccaaataataacacttgcaccgatacatccaaaatgtctgcaatttcctgcatacgattcaaatcaggtgaagactctccagtctcccacttcgaaaccgcctgtcgtgtcatgtagagtttatcggccaactgttgttgcgataaccccttctgtttgcgcaggttcgtcaactgttgtgcaaatacaatatccatcatcttgcccccttaacttttggtaactaaattatgacaaatcatcattgatgcacctagcaattcaatgttatttttgcgcaaatttaagttgcatccttgttatgacggcgtttatacatggaatcgcccttgctattccaattaatgatagttacttctgaccgaaccacgcatcccccatacgatcgctataagcttgctcacgctcccaaatcgattgggtttgccagttctccgtcgagtgcgttggtcgctgtacgttttgcgtcgcaatcgatacagtcgcccctaacacccatactgctaccaataaaataccaaacacacgcatactctttcgcatcacatcgtcccccactggtatctacaagctacttatccacttgtttttagtaacttcagtttacgcgtaaattgtcattattctgtctgtgtttcacttaggttttgtaaaggtttgacagcgcaacaactcccacttaaagtacttgccattcttgcaaaattgtatcggcaaaatcgaattcattattttggatgaatttcttagccctcagtaccaagggcgacgaattttctggtgttatatctgcgagttttacaaacagtgccccctttgaatcttggcccggaaattctcgaactttttcagcaacgttaccatacacctgctgaaccagattgaatacggcaatatgattattcatcgtaaacgtttcaaaggtccacggatatcgaaaactagtaatacctagttgctgatagtttatcaactgcataccggtttcttctacgaattcacggcgcagcgtatcatcaagtccctcgccctctgccatgctgccaccaggtaaatctaaccgattcgcatatggcccgcttgttttcgaaataactaataacccttgttcctgtcgatagtagataccatacacaccgaacgcacgatgataaatctcatccttcatcatttcatccccactttgatagctttccaacaatattatcatcaacactcaagattgtgtgctaaactattagaaaacaatgagaaacacaaggagtacctatggcctattcattaaactgggatcttgaccctatttaccctggtggtattacatcacctgagtttgctgccaagctcacgttgcttgacgaacaaatcaaacaattcgctgctgacgttaccgcctatgatcgattcacagatactgatttcagtcagtttattgcgttagttgatgccgctcagacaatccgttctggtttgggaacggttgccctattcgtgaacgcattatactcagctgattacaccaatcctgtgtatcgcccatatcaaactaaggtgtcacaacttgacgtggcttaccaggcacctttaaacgccttcgctaagttattgacatcatttgacgacgacacttttgcgaaggtcctgacattgccaggcgttaatgatgtggcgttccatttgaatgagttacgcgatgacgcgtcacgtttgctcgacgaccgtgctgaggaattgctaaataacttgcggttggatggtttgcaagcctggtctgaacactacgacacgatttcagccggtctaagcatgacgtacactgacgaaaacggggcggaacaagctttgtcagccggtcaagcattgaaccaactggatggttatcctgataacacagttcgagcgaacattatggctaattatgaaaagatgtggggcacggctgaaaacttggccgccgataccattaatcacttggccggttcacgtctaacagagcaacatgcccatgggtatgctgatcatttggaacaaccgcttgagttgaaccgcatgtcacgtgccacgttggatgccatgtggcaaatggttgatgataacaagcacatgttcaaagcctactttgaccgtaagaaagctttacttggtttggatgaaatcggttggcaagatcaagtcgcaccgattaccaacttaggtgattatcagccaaccaccctgacgtatgacgaagcagcagcttttgtgattaaaaactttggtaagtactcaccaaagatggccgccttcgcgcaacatgcctttgaaaatcaatggattgaagccgaagaccgccctggtaagacgcctggtgcttggatggaaagtgtgcctgatattcacgagtcacggattatcacgacgttcacaggatcggttaacgacgcggcgaccatcgcgcacgaaattgggcacggtttccactcttctgtcttgaccgacttacctgtttggcgtgacggttatgcgatgaacgttgctgagacagcctcaacgtttgccgaaatgctgattgcggatgctaatgttcaagcagccaagactgatgcagaaaaggtcgtgttgcttgatgccaagatgaccaacccaatcgcgatgttcttgaacattcacgctcgattcatcttcgaggataacttctacaaagaacgcgctaacggctttgtgccagctgcccgtttgaacgaactgatggataacgcccaacaagttgcctttgatggtattttggataagcgtcacccacacttctgggcatcaaagttgcacttcttcattgatgatgtgccattctataacttcccatacacattcggttacttgttcagccaaagcatttacgcttgggcacaaacgcaagctaattttgaagaagcgtacattgccctgctacgcgatacagctaacatgtcaaccgaagaattagcccaaaagcacctaggtgtcgatttgacaaagccagacttctggcaagccggtgccgatttggttaagaaagacatcgacgaattcttggcgttgtctgaacaatttatctagatatttccaaaaagactcagcgcgattgtgctgagtctttttcatttacgcacaacttagaacatttggcgtaaaggcaataacagccatgagaatcgcaataatcgttaactgccaccaagttcgcaaaattttcaattgccacatcagccatccgaacaccccgattgccaatagtgacaatacgatttcgacactcgttaccctctcttgttggcgcatcaacagtagtacgacgctttcaacaccaaatggcagccacacaagttgattacataacaggacgccactcaacgtcaatttccgttgaggtcgcacaagcatgacggcaccccacaaaataacgcctagcaataaggtcgttaacacatacatcaccagcgccaatccgattaacatgggttgatgttcacgcaagacgccatcatcccccattgtcgccctcatttgcctggtatttatccaaaattggccgaccaatagggccagcagtgtaaggccaccccacttgttgagtccgactttattttcctgatatgcaaacattgaacatcctccccacgatttgatttgagtatagccaaatcggtgacccacgataatatcgcatcgatagcaaattggcgacaaatatcacagtcgaatatcattgttaagggggtacaaaccattcctactacttaacattatgttttatgtaacaaaaaacggaattacatcatcccctgacgtaattccgtttgcctgttattttttcaaaattaacttagacgttgtaatcgccaagacaaccgatagtcccattggcaaaagcgctgagtaatccatatgtgtcacttcgaacatcataaacaatgccatcagtggcgcttgttgcgacgctgacaacaaagccgttgccccaataactgccgcttgatcaatcgatgcgcctggcatcatcatcacgtaggcaaagcccaagatggcaccaaatgatccaccaatgccaattgatggcgccagcgtaccaccataggcacccgccttcagcgtgaagaccgtaatgaccgctttcaaaatcatcccaatcgcgagcatcccaattagctttgtactttcattattaatcgccaattcggctaggccacgcccatttcccataatctgtgggaagaaataggcgacgatacctgtcgcaagagcagctaatggtagttgccacaaaacttgcacttgcttagctttcgccttgccgcctgcccactggaacaccttgcggaagtaggctcccgcaattcccataattgggccaaccacaataacgaatggcaacatcttcaaatcaaaatgccgatcagctacaaaataataggggtggaagcccttgattgacgcaccaactaacatggcaatcaatgacatacctaaactaactgatacggaacgcttcgatacgttcttgtgcagaatctccaccgcaaacagcattcccgtaatcggtgcaatatagattcctgcgaaaccagcgccggcagctgcggcaatcaacaagcgacggtcgtctgctgttaacgtatcaaggtgccacttggccaatagcatttcccagcgttgggcaagcaaggcacccatttcacgtggcgctagttcacgtccaactgaaccaccggttgccacataaaacacctgggtaacagcgtgcaggattgacgcacccaatggcattgtctcaccttcaagtgctttattaatccctactgttggcttcatcttcgtttgcacaatgaaccacaaaccagccgcaataattccaccaattgtgactgacaacaagcgttgcgtcccagctgcatgaatggcaacgggcaccaacgtattctcctcaaatcccaagaagaaatgctcaatcacatctaaaaatagacttagtacgacagaactcagtcccacaattaccccaagtaccacagtagataacgccaagacccccatcttttgacgctcagtataagtctccgattgttccatcgttactacctcatctcaacaataattacaaaaagtcattataacacgttagttaaccctgctccggaattccggcaattgatctgacgcatgtcaattaaaaaaacagttatccaacacctaattggcgttagataactgtcaatatcatcactattcaacaacgtagacacgttcatcaattaaatcaaatgacgtgtggtgagcatttaatgccgccacttcatgcaacgttgcttcttgccaaaagacatccgaatccgttgcaccatctttttcgccgatgaccaataaatcaaaatcaaagcgataccggttatcacggatatactgtaagacttgccagtcagcgtccgtggtatcgggcgcccaactcataaccacggttgccacgttttcgccgtaactatccaacgccgcaatcgcatctaaattttcaacgtcagtaactggcttggcagtcgttggatctggttgcgtacgccagtcctcattgtcagtcgcaataatcgtttgcgctggggaaactgcgcgaagtccagccgaaatataaccatggcccgccataatttctaggacgggtagaccatttgtgtacgctgacagatcttgaataaacgcgttcgacacatacgcatacatactaaagtactcgattaacgcatctcgcaaatgacggagcataaaatcaacgtctgccaacggttccgtcaaagtttgccagagggcattacccttcgtggcgtcgttcggatatgtttttaaaacatattgttctaattctgccaccaccgactctgggatttccatagtcggtaacgcacttggtaagagcccattatttaaatcattaatcgtcgccacggcttgttcaatcaagcgcttgatggtggggatgttttgataacggtccaaatatggcaacagctcactaagataatctatctcagtgagctgtcggccagatccaaaccgaattgtttggttcgttgtcatatcgtttcctctaattggttagaaaagactctcttgatggttacttcgcacatcgtcatctgacgtaaacgaaactgggttcaaatatgaattaacatactggaaaatatcaaaccgttgctggtcagtcaaaggcttaccgttaaaatcgatttccttacctgacaggaacagcaaagacaaatccgtcttctctgacatggcgcgaccaaccaaaaaatccatagatacattaaagaagtccgctaacttgcgtacttcaatgtacgatggtgatcgatcaccacgctcccagtttccgatttgcgcggctgtatttggtttttgccccggctcgagatgcttattcatctcttctgccaaggtttccaatgtgatattgcgtcctttacgcaactcacgcagacgatctggaaacatgtgcgttgtactccgttctcactaaaataatcgtaagccgcgttaaacgccgtttacttctctattttaacgaacattcaactatttttccacacccaaattgtggataaaggcttattttatccacacgctgtgaattactgtttcactgtcaagacaaccacgttaactgtcacagctggcaagggggttgcttccgctgcggcttgggcttctggccgagctccccagtgaagtggcgtcatgtgtaacaggtcaacatacaggtccgctggaatgggccattgataagaaatttctttttgtgtagccgtaggatagttctccataaagcgatcaaccactttttggttactgtaagtatgatttggtgaatcaactggataaagcatttcacgcaattcatgcaagtaacctgacgctggtacgactttgaccaacgttccctcaggcgccaggacacgcttgaattcttcatatgcacttggtgaaaagaattcaacgatactatcgaaactatcgtcattaaatggcaagttcgccaaatctgcaaccgcaaagaacgcgtccgtctcaagctgcgtcgctaggttaacccctgcctttgaaatatcaaacccaatcccagtgtcgatgttgccacgcttcgcaagtaaccgggcaaatggcgttccctcacccgtaccgacatccataatgcgttgggcagtcgttggcaatgcttcattgacagcatcgacaatgccatcaaatagtccagccgttagcacccgacgacgcgctgccaacatggcatcatcgtattccgtgttcaccgcgtggttcaaaaagtagagtgtgcccttcttattgatatcaagccggtggttatgcgcacaaaccaagctgttgccttctacgtgatcatagggttcaccgtcgacggtacaacggaacatgtcgagatgttccgtcacgaactgtgtccctttttcaattttcttcatgtcgttcctctttcatcgctaaccaaagcatggcatatacttggtcaaagtctgcttcattttccgtcgttaaagcccgttgtcggacataagtcacaatcgtgctaaaagccatcgtcataaatacctggactggcatgttgcgcaagtcgccctttgcaacacctgcttgcaacatgtctgcgacaatattttgctgggcatctgccggatcggcaggtgttgtgttaaagactgggctatctggtaattgcttaatttgtgacacagttgttaacgtgtctggtttagttaccgcgatatgatacaacattcgtaaccacgcacgcacttgaccagcagtcgttggctcagcggtaatcatcgttgtgattgattgtcgcataatcgcctgttcatgttcaaacacctgcaacaacatgtctgatttatttttaaaataaatgtagatatttgactgcgaaatgccaacggctttggcaactttagtcgttgatagactggccgcaccttccgtcacaataatcttaatggcagcctgaataatcgtctcatattttgtctcgtcttttttcttcatgctattaatataaacgctttacgttgaaacggcaatgttgacaaaagataagattatcttttatactgattacacattaaagataagtctatctcttaaagagagtgaaggagaattattatgaaaatcgcgatgcttggatccctcggaaacattaaccgggttgcgattcccgaattaattgccgctgggcacgaggttactgtgatgacctcatcagcagaacgagttgcaggtattgcagaattgggtgcccacgcagtcgttggtgacatcactaatttggacagtcttgtagcaactttaaccggtgccgacgttgcttatctcatgttgaccggtcgcgctaacggtagcttagttgctcacggagaaaaagttggccagttgtttaaaaacgctttgctaaagactggtgtgacccgtgtcgttaatttgagtagtgtcggtgctgaccagggtcctgaaatcggtgctttgtacgtttacaatatcatcgagaagatgcttgcaagtttaccaatcgacatcacgttcattcgtccagtagcgttttacggtaacttaatgagcaccattcaaacaatcaaaaatcaacaagccattatcaataattttcctgccagtcaccgcaatgcctacgtctggccagcagatatcgcagcgaccgttgttgacgccattttgcatcccgttgccggtaaaacagttcgttatgtcgtttcagatatgtttactggcgacgaactcgtggccgctttacgtgagaccttggacttgcctgagttgaaatgggttgaaatttctgacgaacaagctttggccaacatgacagctgcggggatgcctgaagctgttgcgactgaatttgttaagttgggcgcatcacaacgttctgaaacggcgtacactgatttgttaacccacctacctgaatttggcgcgttcaaattggctgatttcatgccaatttacaaggctgcctacgaacgctaaaaaagtctgggacacaattctctgtctcagactcaaaagccgccaatctcccgatttaaaatcggaggattggcggcttttaaacgtgttctgaaaggctgaacccttaatataacaccatttgaaccactctatttattttatagttgcatccaaatcaagatcatacgcgacccgatcaccagctaattggccacgataggtaaagccacgtcgcgcgatgattgcctgcatctttttattcttggcatgggtatcaatgcgcagatacgtcagtcctttcgcccgagctgtttcaaataggtgcgtaaatagcgctgtagacagatggtagccttgatgttggaaagataccgccattcgatgaataatggcatatggacgtcttttcgtgggatataaccaccgaccgccctgaaggcgttggtagttcacatccttttcttgccataaggttgcggttgcgacaacttcatcgccaagtaataacacatacgcataaccttttgcgatatctgctttgataatttctggggatgggtaaccattatcccactgtggattctggtcaatcgacatcacggcctttgcatctgcaataatttgccagatggcatcggcgtcagccatggtcgcctgtcggtaagttattgttgccattggtagtcctcacttccgtcgagtagtaccattatacgccggattaatcccataattcccaacagtttcgtcacaactaacgcgcataataacatcagtcataataatgattcgcggtgaatcccatcaccgcgccttctttcaccaccaggtactccttgcctggtggttttttacatgctaaacgccgtggaaatcagcacccaaaggacaattagtaccccaattcctaacagaaatagccccaagtaaaaccaagctgttactataaacagtaacaatgcccatggcagtagcaatatctttttaattatgtcccacataacgaaccttatctcccaattatagaagtccagaccactaatctgttcatatttttaagtctacttcttatcgtgatcagctaataattgcattaaatcgtgatgatcatgtacaaatttcttaatcgccgtgtcatttagttcatcaccccttagtcgatccagggattctttctttccgcgtttcaataaatcgtcatgttcatccattaactgactaactccttattccaataacaatacaatctaacatcaattaaaatcaatcatatatattacaccaattccaaagacatgataagtgcaaaataaaaatgctacacggctagtcatctcgactgccatgtagcatttttaataacaattaatcttcgaaaccatctgtcgtcattgatgcttggtacaaagccacaacatcatcgaccgtcaagttcacgtaaccaccttcttggtccaaacgaccaatcttaacagctgattcagccattgcacggaagttcgtgtcatcagtgatttcgacaccttgcaacgtcattggaatgtccaaagacttaatccagtcatacgttgcttggattgccttttcagcaaccacttgatcgtcatcgtcttgaattgaccaaacgttgcgaccgaaacgggcaaacttagcaaccgtttcagctgacaaagcacgcttcatccaacgtggcgtcaaaattcccaaaccaacaccgtgagtgatgtcgtagtaagctgacaattcgtgctcgatagggtgcactgtccagccgtttacgttacctgaacgaaccaagccgttcaaggccatcgttgacgcccacatcaagttagcacgtgcttcaaagtggtcaggcgttgccaaagcaactggcgcccacttgataactgcacgcatcatgccttcaatcataccgtctgaaatatccgtatcgtttgcacgatcgaaatattgctcagtcaagtgtgagaaaatgtcgaatgagccagcggctgtttgccacttagaaactgagtacgtcaattgtggatccaagaatgacacagcgggtgtgtttggtccgtacgtaccaaccttgacctttagctctgggtttgagataacagaaccagggttcatctcagttcccgttgcagccaatgtcaaaatgtcgacaactggcaattgatcaatgttttgacgtgacttggcaccgcggtcggccaccaaatcccaagcgtcaccatcatagaacttagctgatgcaatgaccttagatgcgtcaataactgatccaccaccaacagccaagataacatcgatatcgtgttccttagccaaacgttgtccttcgcgaactgaatcaatctttgggtttggggcgatacctgtcaattcgacaacgttcaacccttccaaagccttcatcacacgctcatacaaacctgaacgcttaattgacccaccaccgtaagccaacaaaacattttgaccatattgcgcaacagcgtcgtgcaattcctcgtcaatgtggttctttccaaagcgaatatccgtcttatttacaaagcgaaaatcttccatcttaacatacctccgttattcggtagctcaaccaatattgcaagagtatactatacaccttaaaccatggttcaagtcaagtcaccacttttacacggtcgccacatattattcaaatttcgactatatgctaacagtattggaggtacctcatgagtcgcaaagcacgcttattactaaccatactctgggtggccggactactcgccgggttcagcagtggccaactctaccgtattgctcatcctaagcagataactgatgcttcacagctcgttttaacagctggccaagctgatactactattaagagaacacaaaaaaagagcaccggcgctcctgatacacaacagtacatcaagaaggtctatgctcatttacatatcactgattcagttggcatgaccgccattgcctcaccctcagcagacgggccctatggcgctcacagtgttattttatataacgatgcgaatacgacacctgcgcgttattacgtctatccagatggcgacgttcgggctgatgtttaataattcaacgcgacctcagctagattaagtgccaatgacgcaaagaatacaatcgcaagcactgatcccgttgcaatgcttagcgcagctgtccggcgacggagccgggtcaatgtattaccgttaacggtatcaacggtcaatgccatcgtcgcacatctattaaccacgaacgcagcagcaaaagcaataatcaagactgcgaatggcaactggtggacggcccaggtcacatcatttacaaattgttgaaatccaaaagttaagacatcgtgcatcctaaaatccccctctttaacaaatccctcttctaagaatagattaccaaaaagggcccagataacaaataggtgagacaatttaaaatttattatttcacaaaataatatacagtgacagatttgctgaccaacacaaaaaagcactttaacgagattcgcatcacgttaaagtgctttttgttttgaactacaaccagcgattaaccgaaattagtcgttgtgcaagttcattgaattctcaatatcagcgattgaaggaatcttcgtaccctcttcagttgataccacaacaggatctgcaacgaccttgtcttcgatagcttggtattgcttcataccagtaccggctggaatcaacttaccgatgataacgttctccttcaaaccaaccaatggatcgttctttccacggatagcagcgtcagtcaagacacgagtcgtctcttggaatgatgcagctgacaagaatgagttcgtctccaatgatgccttggtaataccaagcaaaactggacgtgctgtggctggcaagccacccttcaacaacgtctcttcgttagcatcacggaattgcgcgatatccatcaacgtacctggcaacaagtccgtctcacccggatccatgacacgaaccttacgaagcatttggcgagccataacttcgatgtgcttgtcagagatctcaacaccttgcatacggtaaaccttttgcacttcacgcacaatgtagttttcagtagccaatgtgtctcgaacttggatgatttccttaggatcagctgaaccttcgttcaacgtctcaccacggtggatttgatcaccttcagccacacgcatgcgtgcagtcataggcaacgtgtaagtacgcgtatccgtctcaccttgaacagtaacttccttagtgcgttctgctgggttttcttcaattgaagtaatctcaccagtaacttcagtaatcattgcacgacccttagggttacgtgcttcaaagatttcttgcacacgaggaagtccttgcgtgatatcgtttccggcaacaccaccggtgtggaacgtacgcatagtcaattgcgtacctggctcaccgattgattgtgcggcaacagtaccaacagcttcaccaacttcaacaacgtcaccagtagccatgttacgaccgtagtcgtatacgcagacaccgtgttccgtgttgcaagtaaaggctgagcgaatgttaacagtcgtaacgccggcttcaacaatggccttagccttgtcttcgtcgatcatttcgttgtgggcaacaataacttcaccagtcgttgggttaataacggccttttgtgcgtaacgtcccaaaatacgctcatacaatgactcaatgacttcgttaccgttcatgatggctgaaacatccaaaccacgatcagtaccacagtcaagctcacgaatgataacgtcttgcgcaacgtcaaccaaacgacgagtcatgtaacctgagtcggccgtcttcaaggccgtatcagtcatacccttacgagcaccgtgagttgagaagaacatttccaaaactgacaatccttcacggaagttggcaatgataggcaactccatgatacgtccgttaggcgcagccatcaaaccacgcataccagccaattgcgtaaagttagaaatgttaccacgagctcctgaatccgacatcataaagatgttgttatcaggttcgaagtgctcaatcagctttgacgtgatgtcatccttcgcttggttccagatggcaataacacgctcataacgctcatcgtcagtaatcaatccacgacggaattgcttagaaacagtagcgacttgcttgtgagcttcttcgatgattcctggcttttccttcaagtcagtaacgtcggccacaccaaccgtcaaaccagacttagttgactcatcgtaacccaagtccttcatgcggtccaatagcaatgacgtttccgtaaccttgtaaatcttgtagacttcggcaacgatgtctgacaagtaacccttcttgaatggaggcaagattggcgtctcggcaaagtgtgccttgatgtcagttcctggctccatgaagaagcgatcgtcaatggcgtgcaagttagcctcagttggctcgttcaagtatgggaagtcgactggcaagatgtcgttaaagaacaacttaccaacagtcgtcgtcatgatacgtgaacgttgctcgtcagtgaatggcttctctgcagggaatgaagacgtttggattccaatacgcgtgtgcaagtgcacatacttgttttggaaggccgtacgcgcttcgttaatatccttgaagatcataccttcaccttcacgaccagcttcttcagtcgtcaagtagtagttaccgataaccatgtcctgtgatggggccacgataggcttaccatccttaggtgccaagatgtgtccagcggcaagcatcaacaaacgagcttcggcttgggcttcatctgacaaaggaacgtggatggccatttggtcaccgtcaaagtcggcgttataagcttcagtaaccaatgggtgcaaacgcatcgctttacctgaaaccaagacaggctcaaacgcttgaattcccaaacggtgaagcgttggtgcacggttcaaaagaactgggtgctccttgataacgtcttccaagacgtccataacaacttcgtcacgacggtcgatcatacgcttagcggcacgaatgttaccagccaagtcacgagcaaccaattccttcatgatgaatgggcggaacaattccatagccattggacgtggcaatcccatttggttcatcttcaagaaaggaccaacgtcgataactgaacgtcctgagtagtcgacacgcttaccaagcaagttttgacggaaacgtccttgcttacccttaagcatgtgtgacaatgacttcaatggacggttaccaggacccgttacaggacgtccgcgacgaccgttgtcaaccaacgcatcgacggcttcttgcaacatacgcttttcgttttgaacgataatgccaggtgcgttcaactccaacaaacgcttcaaacggttgttacggttgataacacgacggtacaaatcgttcaagtcagacgttgcaaaacgtccaccttccaattgcaccattggacgcaagtcaggtgggataacaggaataacatccataaccatccactctggcttgttaccagacttaacgaaagcttcgatgatgtccaaacgacgaacggcgcgaacacgcttttgaccagtggcctcacgcaattctgccttcaacgtttcaacttcagcttcaagatcagcatttgccaacaacgtttgtacagcttcagcacccatacccgcttcaaaagcgtttccgtattcggccttcaactcacggtactcacgttctgacaacaattgcttctcagtcaaaggtgtatcaccggccttagtaaccacgtatgatgcgaagtagataatctcttccaatgaacgtggtgacatatccaagaccaatcccatacgtgatggaattcccttgaaataccagatgtgtgatacaggagcggccaactcaatgtgacccatacgctcacgacggacctttgatgacgttacttcaacgccacaacggtcacaaacgattcccttataacgaatacgcttgtactttccgcaagcacattcataatccttggtaggtccaaagatacgctcgtcgaaaagtccatccttttctggcttgagcgtacgatagttgattgtctcaggcttcttaacttcaccataagaccagctgcgaatcttgtctggactagccaatccgatttgcatgctttcaaacttattgacatcaatcaatggtttgacccctttcgtaggttcctatatacaatccaatccagcacttctctatgtccgtgcttactgcattcgaaccctgtcaaatccagtaagcacgaacctagcgaggtgctaggttggctaacaatctatcataaggcgaccaagcttaacgcttagtcagcatcactcaagtttacgacttcatcagtctttggtgcagcagttgcttcagcaccgtcagcagcaaattcttgtgccaaacgttgtgcttctgcgttcgctgcttcgatgttaacgattgaatcgtcttcatccatgtcgcgcaattcgatctcacgatcatctgcgtccaagaccttcatgtccaaaccaagcgcttgcaattccttaaccaagacacggaatgactccggaacacctggcttagggatttgctcacccttaacgatggcctcgtaagtcttaacacgaccaacaacgtcatctgacttgtacgtcaagatttcttgcaacgtgtgcgcagcaccgtaggcctcaagggcccaaacttccatttcaccgaaacgctgtccaccaaattgcgccttaccaccaagtggttgttgcgtaacaagtgagtaaggtccgattgaacgggcgtgcatcttgtcgtcgaccatgtgggccaacttcatgtagtgcatgataccaactgagacacgcttgtcgaaggcttcaccagtacgtccatcgtacaagatcgtcttaccgtcagctggcaaaccagcttccttaattgcgtcccagatatctgagtcacgggcaccgtcgaagacaggagaagcgatgtggatacccaattcacgggcagccatacccaagtgcaattcaagcacttgtccgatattcatacgtgaaggcacacccattggtgacaacataatgtcgataggtgttccatcaggcatgaatggcatgtcttctgaaggaacgataacagaaaccgttcccttgttaccgtgacgtccggccatcttgtcaccaacttgaatcttacgacgttgagcaatgtagacacgaaccatcatgttaacaccaggtgccaactcgtcaccgttttcacgagtaaagatacgaacgtcttgaacgactccgcctccaccgtgaggaacacgcaatgacgtgtcacggacttcacgagccttctctccgaagatggcgtgcaacaaacgctcttcagctgatagctcagtcacacccttaggcgtaaccttaccaaccaaaagatcaccgtcttcaacttcagcaccgatacggataataccgcgctcgtccaagttcttcaattgctcctcacctgtgttagggatttcgcgagtgaactcttcagggccaagctttgtatcacgtgcctctgattcgtattcttcaatgtgaattgacgtgtaaacatcatcgcggatcaaacgttcgttgatgatgatggcatcttcgaagttatatccttgccaagtcatgaaggcgatcaatgggttttgtcccaaagccaactcaccttgctccattgatggaccatcggccaaaacttcgtcggcatcaactgcatccccaaccttaacgattggacgttggttgtagttcttaccggcgtttgaacgacggaacttcatcaattcgtacttatcaagtgaaccatcttcacgacggatgcggatttcgcgaccgtcaacatactcaaccgtaccagggtactttgcgataatcgcaacacccgcgtcgtgggcagccttgtattcgatacccgtaccaatcaatggtgcgtgtggatcaatcaaaggaaccgcttgacgttgcatgttggcacccatcaaggcacggtttgagtcatcgttttccaagaaaggaattgcggccgtggcaacggcaacaatttgcttaggtgaaacgtccatgtagtcaacttggtcgatagaaacttcgacgttttcatcacccttacgagccaaaacaacgtcagaagcaaatgatccatcttcgttcaaaactgagttaccttgggcaacgatgaagttatcttcttcgtcggccgtcaagtagtcaatcttgtccgtaaccttgtgcgtatcccagtcaacacgacggtatggcgtctcaatgaatccgtaacggttaacacgaccgtacgtagccaatgagttgatcaaaccgatgttaggaccttcaggcgtttcgatagggtccatacgtccgtagtgcgtgtagtgcacgtctcggacttcataaccggcacggtcacgagtcaaaccaccaggtcccaaggctgaaagacgacgcttgttcgtcaattctccaagagggttagtttggtccatgaattgtgacaattgtgatgaaccgaagaactccttaacagctgccacaactgggcggatgttaatcaattgttgtggtgtaaccgtatctgggtcttggatagacatacgctcacgaaccacacgctccatacggctcaaaccgatacggaatgtgttttgcaacaattcacccacacgacggatacgacggttacccaagtggtcaatgtcgtccgttgcgccgatgcccaatggcaagttcaagaagtagttcataccagcgatgatatcagctggttggatcgtacgaattgactcgtcaaattgaccgttaccgatcactggcaaagtcttttctggatcctctgggttttcaaccaagattgtttgcaacgtcataggcgtcgtcacaacaccttcatctgaaggcgtaaatgtcgtcgtcttaaagtcgtcacgatctaggtaaggtgccaagtcggccataaccttcttgtcgattagcgtacccttttcggcgataacttcaccagtttcagggtcagccaacgtttcacccaacgtcaagcccatcaaacgcgtcttcaatgacaacttcttgttgatcttgtaacgaccaactggtgccaaatcgtaacgctttgggtcaaagaagcgcgctgtcaacaacgcacgtgatgaatcagccgtctttggctcacctggacgcagacgctcgtagatgtccttcaatccttcttcgacacgagagtcgttgatatccttgtgaacatccttatccaacgtcaatgagattgaatcatattggtcacccaaaatttgcaaaatctctgagtcagatccgtaacccaaggcacgaaccaattcagtgattggcaacttacgcgtacgatcaatacgtacgtagctcaatcccttggcatctgtttcatattccaaccaagcaccacggcttgggatgaaagtcgttccgtagttaggacgaccattcttatccaattcctcgttgtagtacacaccaggagagcggacaagttgtgagacgataacacgctcagctccgttaatgatgaacgtacctgatggcgtcatcaatgggaaatcaccaaagaacacatcttgtgacttgatttcaccagtttcttggttcgtcaagcgcaacgttacgtgcaatggtgctgagtaattagcatcgtggttacgtgcttcttctactgtgtacttaggctccatgagcttatagtccacaaattccaatgacaacttaccttggaagtcctcgattggcaaaatgtccgtaaacatttcgcgcaatccttcatccaagaaccagttgtatgagtccgtttggatctcaatcaagttaggcaaatcaaggacttccttgattcgtgcgtaactacgacgaacacggtgcttaccgtactttacaagcgttcctaccaagttttccacctcgctttgatttggccaactgcgcacaccagtttctttacagtttgattacaatatctgttttttaccggtttttgagtgcaaaaaagacaacggcattttcattgatgaaaacaccactgcccttgctataaaggcattcagggacaatatttcctgtctgccgttgtctatgcacaattaaactaccttatagtatacaagaaaaagcaagtaatatcaagattttaaacctttgtcaatacttgctttttcaatttgttgtgtttattctgtgaccgcttcttgactgttcgtctttgacttcacattaattgtgatttcgccactcttggcaccaatcgtgacaacatcatttgtcgtcaccttaccagccaatagctcctcagacaaacgatcttcaaccttcgtttgcaacgcacgacggattggacgtgcgccgtactctggatcgaaaccagcctcagcaaccacatcaatggccgctggcgtaatcttcacgtcaaagccttgatcagcgatacgcttcaagactgacttggccatcaacttcacgatttggtgaagttctggcttcgtcaatgagcggaagaccacaatttcatcaatacggttaatgaattccggacggaacgtctcacgcaacgtcttacgaaccgtctcattcatcgcatcgtaatcctttgacttatcaacggcaccaaagccgactgacttttcatcacgaacacgagttgcacccaagttagacgtcatgatgataatcgtgttacggaaatcaaccttacgtcccttggcatccgtcaagtaaccatcgtcaaagacttgcaacatcaagttgtagatatcagggtgcgccttttcagcttcatccaatagcacaactgaatatgggttacgacgaaccttttcagtcaattggccaccttcttcgtaaccaacgtaaccaggtgctgacccgaccaaacggctagctgagtatgcttcacggtattcagacatatcaacacgaatcatgttgtcttctgaaccaaacatagcttcagccaaagccttggccaactcagtcttaccagtacccgtaggtcccaagaacataaacgttccaattggacgttgtggatccttcaagcctgaacgtgcacgacgaattgaacgggcgatggctgataccgcttcatcttgcccaacaacacggttgtgcaaaaccttctccaagttcaacaaacgctcttgttctgacttctccatttgcgttagtggaataccagtttgctctgaaacaacttctgcaatatcatgcgtcgtaacttcaaggtcataactagctgacccttctggttgttcagcatcacgatctgcgatgtacttatcaaccttcttcttctgggtcatttccttcttacgcaattgagctgccaattcgaaatcaagcgcttcgatagcggcatccttttcagcgcggatggtttgcaacttttcctcaagcttagccaacggcgtcttgtgaccagaacggtcaatgcgcaccttggcagctgcttcatccatgatatcgatagccttgtcaggcaagaagcgatccgtcacgtaacgaactgacaacttaacagcatcaactactgcgtcatcagagatggccacttggtggtgttgctcgtaacgactcttcaagcccttcaagatttcaatcgcatcagcttcagatggctcgtcaacttgcacttgggcaaaacgacgttccaaagcagcatcggcttcaatgtacttttggtactcatccaaagtcgtcgcaccaatcgtttgcaattcaccacgggccaaggctggcttcaagatgtttgacgcatcaatcgccccctcagcaccaccggcaccaatcaacgtgtgcaactcatcaatgaacaaaatcacattaccatcgcgttggatttcgtcgataaccttcttcaagcggtcttcaaactcaccacgatactttgttccagcaaccaatgaccccatatctagcatcatcaaacgcttctttgccatgtcagctggcacttcgccagcgacaatcttttgggccaaaccttcagcaatcgccgtcttaccaacacccggctcaccaatcaatactgggttgttctttgtgcgacgtgacaagatttgaataacacgcttcacttcagcagaacggccaatgacagggtccatgtggtgatcacgggcttgttgtgtcaaatcacgggccaatgaatccaacgttggcgtaccttcttgttgaccttgttggttaccacgacggctaccccgggcgtccttcttacgcgctgtatcattaatacccaacttgcgcaaaatgacacgacgcatctcacctgggttagcatccaatgcaatcaagatacgtgatgacaagattgagtcatcggccaacaatgccaacaacatgtgctccgtgccgacacgaccttgttgcatgttacgcgcttcttcaccagctaattgcaacacttcaccagcctttggtgagtatggcaagtaagcttccttttcagcgcgtgatagcgtaccgtaacccgtaaagcgctcaatttcctcacgaatatcatcatcagaaatattaaattgttgcattaccttgctggcaataccctctttttcaatcgccaaggccaaaagcaagtgctctgtcccaacggcttggtgcttaaaatactttgcttgttcttgtgccaaaactaaaacgttctttgcactaggtgtgtattgattatccataattatttacgctcactttcaaaccgtaatcggtttaataattgacgcagcaattgtccgcgtagctgtccggccatccgggcatcccctaccgctaatgcttcctttgataacatcgttaatacaatcttaccttcccgttcagttaacagttcatcccggtataagctttcgatgatgtcggttgcttcgcgtacgctcactacctctgagagactttgaatcaattcttctataaaacgtgggtcagtccgtagcggaatttggacaatccgaatatatccaccgccaccacgttttgactccactagatagccgttttgaatcgtaaaacgtgtcttaatgacataattgatctgcgacggcacgacatcgaaacgttgtgcgagttcagatcgacgaatttcaattttctctgattgccgcaaaatctgtttcagatacgtctcgatagcatctgacatgttttgatcagccatgcgcgtgcccccttgaccaatgttgacattattataaaacgcactgctttgcaatgccaataatttgtcgtggttttcgcacactttctgtaagtttaccattactcacagtttctaaacaaaatttttcacagatttccgcatacccatactgtaacaaataattatatcgattcgacacgtattcattggtaaaaacacgacagaaaaaccaccaagaaatatcttgatggtttttccaatcgatgggcctagcaggactcgaacctgcaatacccggttcgtagccggggtgtttatccaattagcatataagcccaataaatatttaatttgattctaaatctagaatcagaagcgaacaacgggattcgaacccgcgacctctaccatggcaaggtagcgttctaccaactgaactatattcgcatcaaatgccgactactggattcgaaccagcgaccccttcattactagtgaagtgctctgccagctgagctaagtcggcatgtctatcgtaaaccgataatacggatgacaggaatcgaacctgcacgcccgaaggcactggaacctaaatccagcgcgtctgccagttccgccacatccgcaacagacgtcttcaagttattcgcttgaaacaacttttatataataacaagtttcgaattaagtgtcaacacttttttaaaacttgttttatcaagtggaacgcttggcagcggtccggtaggcatgtcgccttaccactcgatatatattactcgcttccgcccagtttggcaatacttttttcataaaaaaataaacgttttgtgtcgacgcgttgcgtcgaggtatggcaggtgattggggtggcggtgctccgtccttcaatataagctggtggcgacggagtcccgttctcactaagtctcagcgaatttcggcgcctgccggcttaaaatccactgctactaagtgattcctggtgctccttccttcgctttatcaccggctaatatcgcaggatctccgcaccaccaccccaaccacccaccataccagcagccgagatattctctatcaatttcgatattcatctctatggaccgcaggcacacactaaggaaccatggatttgctagtaaacattatcgaccattcagctcattggcgattttcgaaccaaagtattgcaaccataaaattcccagtcgaattaacgcattccggttaattcgactgggaattttttcgtctatcgctaactatgtcagttatcaggttcacgcatttaattctcggtggatgattatcacagacagacaagaacatctcggctgctggcatgggagttcagcactatcggagcgttcaaatcggggcaacatgccgcatggccagcgctattcaggtaagcccatataggactaaaggattagggggaattatttgccccgctgaatggcgcctgtgccattcggttgcctcaatttgaactttgccgaagatagcgctgaactcccatgcctcgacgcaacgcgtcgacacaaaccaccaactaaaaagcccaacaaccaaaacctgattgttgagctaaaatagtgtttaattttacaacgtgtcttcaggaacgatcttgtctgcgccaaagtatggacgtagcacttctggaatcgtcactgtaccgtctgcgttttggtagttttccaagattgcggcaactgtacgaccaactgccaaccctgatccgttcaacgtgtgaacgaattgcaacttaccttcttcatcacggtattgaatacgtgcacgacgcgcttggaaggcctctgtgtttgatacagatgaaatctcacggtagatgtcttgttcaggcatccaaacttccaaatcgtatgtcttcgcagctgagaagcccatatctcccgttgacaacgtgatcacgtgatatggcaagttcaacttttgcaagatgttttcagcattggccgtcatatcttccaaagcttggtatgattgctcaggcttcgtaaacttaaccatttcaaccttgttgaattggtgcatacgaatcaatccacgcgtgtcacgaccagctgaaccggcttcttgacggaatgatggtgaaacggccgttacagagtatggcaacttgtcagcatcaatcacttcttcacggaagtagttcgtcaaaggcacttcagccgttggaatcaacgtcatgtcttcgtttgtgccgacacgataagcatcttccataaacttagggtattgacccgtaccaaacatggctgcgtccttaaccatgtaaggcgtaatcatttccttgtagccttccttttggtgctcgtccaacatgaagttgtaaacggcacgctcaagacgggcaccttggccaacgtagtagacgaagcgtgcgccggcaaccttagcaccacgctcccagtccaaaataccaaggtcttcaccaatttcgtagtgcgcctttggcttgaagtcgaatgatggaatttcaccccaaacacgctcttcacggttagcttcttcatccgcaccaactggaatcgttgggtttggcaagttagggaagtgcaacatgcggtcttggatagcttcgtcgaccttagcgacctcttcatccaattccttaatcttggcagacaccgtttgcatttcagcaataacatctgacgcatcttccttgttacgcttcttcaaaccgatttcgtcagacaccgtgttacggcgggccttcaactcttccgtttgtaccaacaactcacgacgcttagcatcatcagctaccaaggcatcaacttccgcagcatcgacaccacgcgtggccaaacgttcctttacgctttccgtttcattacggatcaacttcatatctaacataattcttttctcctaattaatcacgcaaaccgagttcatcaactttttcgtcaatcaaagacaagaccttcttggccgcttcagggtcattaacgaaatcgtacttgtcaccatcaatacttagcttaggcgaacggtcgtaaccttcgaaccaagcaatgtaacgctcattcaacgtcttgtagtaatcatacaaagatgggtcgtgatcaatttgttcgaaatcacggccgcgcttttgaatacgggccaacatcgtatcgaaactgacgtggatataaatcaacaagtctggcgtcttaacgatagcatcatcagaaaaatcaacttgttccatcatgttgttcaacagatcgccgtaaatttggacttctgtttgcgttgcacgttccaaatcggcattcaattggaatagcaacaaatcttcaaaaattgaacgatcaatgacgtttagcttgctgccttgtgcgtccttgatattgtccatgcgcttgttcaagaaataattttgtagcaagaacgcatacttctttggattctcgtagaacaaaggcaaaattgggttatcgtccacggactcatagaatgcgtcacttcccaagtgctcagcgagcatagttgtcaaactggtctttccagctccgatagttcccgataatacgatcatcgtgtcgtcctgctttctaaaatcaatattaagtctattctaccaaatttaagaggtccttaacactccctttatttggtcagacggtctttataagttgcgctgtattcttcgagggctgggatatcagctgactttgacttattgtagtcgccaccagcgttgcctgtgtattgttccaatgacaaatggtacttcgtgatgaccgcagctgcccgcttaccaacataacgcatgtgccattcttcgtggtcatacccggttgaagtcgttaaatcttctggataacggacaatcaagccatacttataggcattatcttgcaaccattgcgcagcatccgggtcagagccaccttcagcaaacaaaccaccggtgctactccgcaaatcaaacgccaagccagtttggtgttctgagtaaccaggtcgggccgaaacggaatcagccgctgcttgaccctgaccagccacataaccatcatacaatgtcttctggtaatcataagcccggtaaccggaaaccgtatccccaacgttaaagccagcggccttcattgcactaatcaattcagcctttgcctgattcgtcttaggactcaaaccaccgttatacgggttgtaatcagctggcaacgggtgctttttgttaacaaccattaacgtcgtcgcctcggttgacccggctttcacctgcacaggatatggcttagtcgttgccgacttcgtttgcttgctcgtgtgttgactagacttggtaatcgacgtggatggatgttgctgatgggcataaactaagcccccggcaaccaatccaattacgacgacgccaataccaacagtcgcacctaatttcatgggttgtctccttcatgctttttctgtctgttactagtttaccacccgaaacaaaaaaggaccccgaacatttctgttcgagatccttaaagttagtcgattgactacttgccagtcgcaacgtggatacggttcacggcacgcaacaaagcgacctgagcacgttctacatcacgaactgagctttcttcagcaaggcgacgctcagcacgttccttagctgactcagcacgtgtcacatcgatgtcagcagcacgctcagcggcgtctgacacaacagtcaacacgtttgaagagaactcagcaaaaccaccgctgacagccaaacgttcttcaacgccattggcctcgtcaacaatcttcacttcgctcaccttcaaagctgaaataattggtgcgtggttcgccatgacacccacttcaccgccagtcgtgctaagcacaactaacgtagcagtctcataatcgaacacgacaccattcggcgttaccaccttaacatgtaggctgtgttcattcatggcgcgccctcactattgagccatcgtagcagccttatcagctacttgttcgatgacaccaacgttacggaaggcatcttcagggtattggtcgtacttaccttccaagatttccttgaagctacgtacagtttcagcaactggtacgtactcacccttcaaaccagtaaacgtctcagcaactgagaatggttgtgacaagaagaattgaatacgacgagcgcggttaacgatcgtcttctcttcatctgacaattcatccatacccaagattgagataatgtcttgcaactcacggtaacgttgcaaagtacgttgtacttcagttgcaacttcgtagtgttcttgaccaacaatctcaggcgtcaatgcagttgacgttgaagccaatggatccacggctgggtagataccttgttgcgtcaatgaacgctccaagttagttgtggcatccaagtgcgcaaatgtcgtagcaggagcagggtcagtatagtcatcggcaggcacataaacggcttggatagatgtaactgaacccttttgcgttgacgtaatacgctcttgcaattgacccatttcagttgccaacgtaggttggtaaccaacggctgatgggatacgtcccaacaaggctgaaacctctgaaccagcttgcgtgaaacggaagatgttgtcgataaacaacaacacgtcttgtccgttaacatcacggaagtgctcagcaattgtcaaaccagtcaaggcaacacgcatacgtgctccaggaggctcgttcatttgaccataaaccatggccgtttgcttcaaaactcctgaatccttcatttcgtggtacatgtcgttaccttcacgggtacgctccccgacaccagtaaagacagaaataccattgtgaccttgtgcgatgttgtgaatcaattcttgaatcaaaacagtcttaccaactccggcaccaccgaacaatccgatctttccaccacggatgtaaggtgccaacaaatcgataaccttgataccagtttcaaggatttcagtagatgtggccaattggtcgtaggcaggcgcgtcacggtggattgggtcacgaggaacatcctcacccaatgcttcaccaccgtcaacggggttacccaaaacgttgaacacacgtcccaacgtagcttcaccgactggaacactaataggtgcattagtatcctctacggccatcccacgttgcaaaccatcagttgagtccatggcaatcgtacgaacgacaccatcacccaaagccaaagatacttcgaccgtcaacgaaccttgctcacccttatcgatgatcaaagcattgttgatgtcaggtacttgagttcctgatggaaaggcaacgtcgacgactgggccaatgacttgaacaacacgtccagtattcattgtcgtttccttccttcatttcaaaggggttacgccgcttggactaatccaaggcagccataccacctgtaatttctgtaatttccgtcgtaatcgcactttgacgcgcacggttgaattgcaactccaacgtgttaatcacttccttggcgttatcagttgccgatgacatggcgttggccgaagccgcgtgctcagccgtcttggcatccaagatagcaccatagaccaaactctcagcatattgtggcaaaaccacacccaagatttgttctggagaaggatccatttcgtaatccgccttcaaaccgccttcttcagttggttccatgtcgtcagtcgtaactggcaacatcttctccaaacgaagatcgttttgaatacgtgatacgaagtgttggtatgcaacagtcaactcatcaaagacttcgttgtcgtacattgtcgtaacggtcttaacgatttcgcgaacctcgttaaaggtaggctcgtcagacacaccacggtactcgtaagcaacattgaagccacgcttcttgaagaagtctgaggcgttaccaccaacggccaaaataaccacttggtcaggcgtcaattgacgctcttcaataactgccatcatacccttcaatagcgttgagttataaccaccaaccaaaccacgatcagaagagatgaccaagaagccaaccttcttcacatcacgttgttcaagcaaagtacctgaaacattgttgatgtgtgcattagctaagtgtgccacaacgtcatgcaaggcgttagcatacgttgtgtatgaaccaccgtgacgttgaatttgactcaacttagccgtagaaaccatttgcatggcactcgtgatttgtcgcgtcttttttgttgaggcaattcggcgttgaatatcttgcaaagaagctgccatttatcgcccctcccttaattagtgggcacttggcgcaaaggttgccttgaactccgtaatagcggcgttcatagcatctgcatcaggcaaatcctttgtgtcaacaatcgtttgcaacaagtcgttgtgtgaagcacgaacagctgcgatcaattctgattcgaagcgttggatatcttcaactgcaacgtcatccataaagccacgagtcaaggcgtacaatgacaaaacttgctcttcaactggcaatggttggtgcaatggttgcttcaacaactcaacagtacgacgaccacgggccaacttagcttgcgttgccgcatccaagtcagaaccgaattgtgcgaatgactccaactccttaaatgaagccaagtccaaacgcaacgttccggcaaccttcttcatggccttaatttgggcgtcaccaccaacacgtgaaacagaagttccggcatcgatggcaggacgtacgccggcgtagaattggtcggcatccaagaagatttgtccgtcggtgattgagataacgttcgttgggatgtacgcagaaacgtcacccgcttgcgtttcgataactggcaaagcagtcatagaaccgccacccaattcgtctgacaacttagccgcacgttctagcaaacgtgagtgcaagtagaagacgtcaccagggtaagcttcacgtccaggaggacgacgaagaatcaatgacagctcacggtaagccgtagcttgctttgacaaatcatcgtacacaatcaagacgtgcttgccgttgtacatgaactcttcacccattgctgctccggcataaggtgccaagtacaacattggggctggttctgaaggaccagctgagacaacaatcgtgtaatccaaagcacccatttgacgcaaagtttcaacttgcgtacgcacagttgagtccttttgtccaatagccacgtagataacgatcatgtcttgatccttttggttcaagatcgtgtcgatggcaacagacgtcttacccgtcttacggtcaccgatgatcaactcacgttgtccacgaccaataggaaccaaggcgtcgacggccttcaaaccagtttgcaatggttcgaaaacagacttacgctccataactcctggggcctttacttcaactggacgagtgctcgtcgagttaattggtcccattccgtcgattggttgacccaatgcgttaacaacacgtccgatcaatccctcaccaacaggcacttccatgatacgaccagtgcgcttaacagtatcgccttcgcgaatctcgtcgtacttacctaggataatgataccaacatcattagactcaaggttttgtgccataccaaatacgccgttctcaaactcgaccaattcaccggcaagagcattctccaaaccggttacacgggcaataccgtcaccaacataagtaacagtacccgtttcttgaacagtcaattcgtcttgatagttggccaattggctcttgatgagtgaactgatttcttcagctttgatgctcatttcagcagttcctctttctttaaagtgtgtctattcatcacacacaacatcaatttctactagattttcagattactagcggatgatactctgacgaatagcagctaacttagttgctaatgacccatccaaaatctggttgttagctcgcacaacaacaccaccaagtaagttttcgtcaacagattgtgtcaacttaacttcctttgcatcaaaacggtttgcaagttgcgccgtcatccgggcagcttgttcgtcactcaatgcaacggccgtcttaacttctgcgtataccacaccttcagccttgttaaccaaagcttcgtatgccgtaataatcgctggtaggttgctgaaacggcggtaatcatacgccatttgaagcaagttagttaccacttggctagtcccatctgatagcgttgctaccatttgcttcttagccgactcaggcacacgcattgattcaatggccttcgtcaattctgggttttccaccaatactgtacgaacttcagctaattcagccaaagtcgcagcatccgtgttctggtcatgggttaattcgaacaaagcaacggcatatcgcttagcaatcgttgcttgatccaatgccattacttgttacctaacccttcgatgtaggcgtcaatcaacgccttttgatcatctaactttagttccttttggataatcttttgtgcgattgatactgacaattcagcaacatcattcttcacgccagccatagcctcggcacgctcttgctcgatttgagctgaagcttgatcctttgtggcttgggcagctgcatgcgcgtcagcaacgatttgatcacgttgcttacctgctgcagtcttagcgtcagcgatgatgccatttgcgtcagtacgtgctgtttgcaattgagctgaacgctcagctgcatcagcttcggcttgcttgcgggcctcttcagcagagtccaaatcgcgagaaaccttatccgcacggctttccatcatctttactactggaccccaagcgaagtgcttaataagaagcatcaacactaggaaagccactagtacaaacaacatgttacccaaagccaacccttcgctagcacctgctagaacaatttgattaatcataattagttggcctccgcgttactattacttgctcaacaacatgaaggcaatggcgatggcgatgataggcacggcctcgaccaatccaacaccgatgaacatgttagaacgcaacttaccttccaattcaggttggcgagccatacctgagatcatgcttgaaataacaataccgttaccaattccggcaccaatagcggcaccagcagcagcaacaccaacaccaatggttgcaacgtccatttttttaatcctccgattagataaaaaacaattactcttcaatctcagtcttttctgatacgtaaaccgtagtcaacgtcacaaagacataagcttgaatacttccgacaaacaaagagaatgcttgccaaatcatcgtcaacaagaatgctggaacgaatgatacgacaccggctgcatttgccaattcccaaagaagagacaagaccatttcaccggcaaaaatgttaccgaacaaacgaagtcccaatgttaagaaacttgtgaattgctcaataatgttaattggcagcaatgcgctaaatggactcaagtaaactgacttgaagtagttcttaaatccgagcttttgaacacccaagaaatgggacattccaattgcaatcaatgccaaggtcatcgttaccaatgggttagccgttggtgaacgcaagtacgttacgtcattgaagttaaccacgaaggcaacacccaattggttcgcaacgaagatgaacatgaacattgagaatgcgaagaactttaaattagttccagttcgatttggtagcgatccatcaacaataccgttggtaaaatcgataatccattctaggaaattttgctttgacttaccagctggctttaaaaccaacttgcgagacatccaaaataccaagaagaaaacaattgcgaatgtcacagttgttgaaatgataatgctccagtcgaacgttagccccgcaatgctaaaggttgcggtcttctcacccacagaaatccacctctttcctttctaaatataattgagcggcgatgcgcagaacacaggaccgttaaacttttacccccctatattacgcttttaggaacgaaattcaacgttttagcattcaacaaatttgtcccaaatgtgcaaccatttaagaaaaggcccatttaccgccgttttaatcattccaattaggaatgaattgatattaatatccagaattgatattttctgacttgccaaacccgcgtcattaagcgtttttgtgccattttttacaaataaaaagcgacgtcgcttttacgcaacgtcgcctattcttgaatatttattacttttcagaagctgccttttgtggcaaaaccaaattcaatacaattcccaaaaccgtcgcaattgctacacctgagaattggataatgtcattaccatgaccaacttgcaagtaggcatttccaattccgataaccaaaactgatgaggcaatcatcaaattgcgcttcaagttgaagtcgatcttgttttcaacgatgatacgcaaaccagaagctgcgatcaccccgaacagcaagaatgagacacccccggtaacagcacccggaattgattgaatcaaagccgacaacttacccacgaatgagaacaaaatggcgaagacggctgcaccaatcaagacgtacactgagtgaaccttggtaatggccataacaccgatattttcaccgtatgacgtcactgacggtccaccgaccaacccagcgaagattgaggctgtaccatcaccagccaacgtccggtgcaaaccagggttacgcatgaagtcacggcctgtcaaatcatccaagaccatcaagtgacccaagtgttcggtaattgtaaccaatgctagcggtgccatcacgataatcgcgccccagtgcatcacaggcttgtaatccacaaatggcacatcaaaatctggcaaggcaaaccatgccgcgtgtgcaactggtgccaaatcaaccaacccaaacaaaatcgcgaagatgtatccacccacgatacccagcaaaatgggaatcaagcccaaaaagcccttaaggaacatgttgaagacgattgtcaaagccaacgtgatcatcgccactgcaaagacccgaatatcatacttgccattcaacaacgttgctgattgtgcagcagatgatgacaatgacagcccgatgaccatgataattggccccaccacaatcggtggcaacaacttttcaatccagttcgtcccgatgaacgccacaatcgcagcgacaatcaagtaaacaataccaaccgagataacaccggttgccacaccggggtagccagttgttttcattaaggccaccatcggaataataaaggcaaaacttgatcccatgtacgctggaatttgacgcttcgtaatcaagatgtgtagcaaagttcccacacctgaactaaacagcgcaattccggggttcaaaccaaccaacaacggtaccaacaccgttgacccaaacattgagaacatgtgttgcaatgacaacccaatccattgcaagaatcccggccgttcattgacgtctaggaccacatcacgtttcgtttccataataacactcctctttcatcgcctttaaaaacaaaagcagccaagatgactcatcatcccagctgctaaatcttgtaacgtgcggttgtgttagtcctactaccccaatagtacgttagtcgatcttgttagtctcgctgggctaacttaaagacgttctttatgtctattagtatatagtagttaaaactcttggtaaacacttccgttcgtgttaaacgttttacttaaaaattgatcacttctggggcttcaacgaatgacgccaacaaagctgatgggaaagtcaactccaaaatgatttcttgtgccggcgttgggtgaccagccatgaagcccttattttcttcgaaatagtgcttcacatcagcccacgtcttctcagagcgtaccagcgttcccttgtttgatgaaatccggcgaccgccctcacccatcatggtattaaacgcaaccttactgtttgcatccaattcagcaaccttggcagaagctgggtcagttaccaagtaccacttgttaggcgcttcagttgattgtgcaaagcccatgatgcgggttgatggttggttatcaaccgccgttgccatcaccaacaattgaccagccgcagccacgtattcgttaaagtttgccatatgtgcaatttctcactttcttttcgttacctacattctaacagaaagaaagttgacttgctggtttaaattgactttaattctcgcaaagcatccggaatggcaacatctccatcgtgcatcgtaataacccgacggtacgtgttctcagcctgcaacaatgctgccaaaacagccgcaacgtttggaatagcattcttacctggctcggttgggtcaagcgcaactaagccagttgccggttcttcaaccaatgaacccggttgcaagatggtgtaatccaacttggtattatccatcaaccatcgatcggcaaagaacttggcaatgttgtagtcacgcaatccttcaccccattcagctggtgacgttgcgttccacgacgacaacatgataaagcgcttaatacccaaggcttcggcagcgttttccaacttaactgctccaaaggcgtcaatttgcaataaattcttaccgcgtgaaccagctacaaaatagatagcatcgactgccaacggacgtaactcaccaattagcgtggcttcatcagccaacaagtcaatgttcttaaccgttacaccggcaccaaaatcttggtcagtatgacgtgtccctgccacaacttcacggccatccgcgaccaattgcttcactagttcctcaccaacacgaccgcttgcaccaacaactaatactttcatgtgtatctccttttcatcacttacaatatctttcatcttaccccaccataacaaaaatagaggctgaatgatattaatcactctgcctctactattaaatttacaattagtgagtaccgaacaaacggtcaccggcatcacccaaacctgggacaatgtaaccgtgctcgttcaaaccttcgtccaaaccagccgtgtacacgtcaacgtcagggtgggccttttgcactgtctcaacaccgattggggctgaaaccaacgtaatcaacttaatcttcgtagcgccacgcttcttcaacgcatcaatcgccataaccgctgaaccaccagtggccaacattggatcaacaaccaacacttcacgttggtcaatatcctctggcaacttaacgaagtattcaactggctccaatgactcttcatcacggtacataccaatgtgaccgatacgagcggctgggatcaacttcataataccgtcgaccatgcccaaaccggcacgcaaaattggcacaatagccaacttcttaccagccaacgtcttttgcgtcgtcttggcaactggtgtttcaacaacaacatcttcaactggcaaatcacgcgttacttcgtacgccatcaatgatgcaatttcatcaacaatttcgcggaactccttcgttccaacgttcttatcacgaataatcgttagcttgtgttgaatcaatgggtgatcaaaaacagtaagcttgctcatgtcatttactccaattcattttcttctattatacaggttatgttattccgcgtgctcaattccgctcaatgggaattgatccgtcaatgcaacaacttccgctgcaatcaaatcaaggacttcttggttatcgtggttctcaaaggcacgcaaaatcatgtgcgccacttgacgcgcctcgtgctccttgaagccgcgggtcgtaattgctggcgttccgatgcgaatacctgacgtaatgaacggactacgtggctcgtttggaatggcttccttattagtcgtgatgtgaatactatccaataagttttgcgcttccttacctgtcaaaccagttgcagtcaaatccaagttaaagaggtggttatctgtgccaccagaaacaacacggaccaaatcagattgctcgaagacttctgccatttccttagcgttggccacgatttgttgaccatacgccttgaaactaggttgcatatcctcgtagaacgcagccgccttccccgcaatcacgtgttccaatggaccaccttgcgtgcctgggaagactgctgaattcaacttcttgcctagttcagccttggccaaaatcataccaccgcgtgggccacgcaacgtcttgtgcgtcgtcgttgtcacaacatctgcaatgccaactggtgatgggtgaacgccggctgcaattaagccggcgatgtgggccatatcaaccatcaaataagcaccaactgaatcggcgatttgacggaaacggtcaaagtcaatgaatcgtgaatatgctgacgcacccgtcacaatcaacttcggttggaattcatcagccaacgcttgcacttgatcgtaatcaatcaactcgttctcatccaatccatatgagtggaattggtaagtcttacctgagaagttaactgatgagccgtgtgtcaagtgaccaccagcgttcaggtccatccccaacacatggtcaccgtgctcaagcaaagccgcataaacagcggcatttgcttgcgaccctgagtgcggttgcacattggcgtattcggcaccaaacaattcctttgcccggtcaatcgccaattgttcaacttggtcaatgtattctgtaccaccgtagtaacgcttacctgggtaaccttcagcgtacttatttgtcaaaacactaccttgtgccgcacggacacctgctgatgcaatattctcagatgcaatcaattcaatgttgtgttcttgacgatcgctttcacgatcaatcgctgcccacaactctggatcaaattcacgataatttgtcattcgcaatgacctcctatatatccccaataactattacagccccaaagttaatccgccaacagttcagttacccagtgaccacctgacgacttgccaagacggttattataagcactattttctggcgtatttggcatagcagccaccaaaaccgttaacacatccttgcgatcatcgaaatgacgcaagccggcaaacaattttgctgctgcggtatctccattatccccgagcgaccagacaaagtccatgccggccaactggtgttgcacaattaaatcgttcgtcaacatcaacccaactggttccaattggctttgtgcccaaataatggcctgcgtccaatcttcaggtgccaccatatagacatccttgtcgggtgcgtaatggcggtacttcatgcccggtgcttttggtgcttcatctgcatcaacgtgcttaatttcagagtccactggcacgcccaaaaccgcttcaatttgggctggcgtaatcttaccagggcgcaacacagctggcgtatctgtcgacaaatcaatcaccgttgactccacgccaatcttagttgcaccatcatccaagatgcctgaaatcttaccatgtaaatcatgataaacgtgttgggcagtggttggtgatggcttccctgacgtgtttgcagatggaccaaccattggcgcatctgcttcacgaatcaaggcccgtgtcacgtcgttgtctggcatccgggcggcaacagtatccaagccacccgttaccgtcgtcgacaccgtaccaggcttgactggcaaaatcatcgtcaatggtcctggccaaaaggcgtccattaacttttctgcccacgcattaaccaccgcaaagcgatcaacttgtgccttgtcagcgacgtggacaatcaacggattatccgatggtcggcccttcgctgcatataccttactaactgctttttcattaaaggcgtcggcacctaagccgtacaccgtttcagtcgggaacgctaccagtgatccgcgcttaatcgcacgaacggctgctggcaattcgtcggccgaccaaatttttgtctctgccatactctttatgcctcccgcgacactttaatcatccgatcatgtccactcatatcttgacgcaacgccactgatacacctggcaactcgccaaagaccgctaacaaagcgggcccttgttgatagccaatttcaaagtacgctgtcccattgggtgccaagtaagtgagcaattgggctgccatttgcttgtacagggctaacccctcatcatcagcaaacaaagccaaatctggttcgtacatgatgactgactcatccatcacatcacgttccgcctcactaatataaggcgggttcgaaataatgatgtcgtattgcccagtcgcttggctaaacaagtcactttcaatgaaattaacctgcttggcaaattggtcagcgttggtttgcgctactactaacgcatctgctgaaatatccgccccagtcacatcccaggttggtcgttcagccccaatggtcaccgcaatcgcccccgaaccagtcccgatgtcgagtacgcgttgcactggcccagttactttatgatcgtttaatacccattcaactaattcctcagtctcctggcgtggaatcaaaacacgtcgatcaacgttgaactcgcggccatagaacgcagcgtgacccagcgcgtactgcactggttgaccacccttgattgcccggacggcaaccatgaaacgtaaccgcttctcgtcctctaagaccgtattcaagttattcgccaattgcgcatagttccaatccatcatccctgttagcagataatcgatttgtgcaagtcgctcttcttggtcgtgaatgtatggctcaagttgccaatcaccccaatcgcgaactgcttgaattgtccattgttcatcaaacatgttatctatccttgcttcaattcttccaacttagccgtttgatcagcgataatcaacgcatcaatcacgtcttccaattcaccgttcataatgcgatccaacttgttcaatgacaaaccgatacggtggtccgtcacacggttttgtgggtagttatatgttcggatacgttctgaacgatcacccgtaccaaccgccgtcttacgttgctcggcgtattcagcttcgttttgtgaggcgtagtagtcgtagacacgcgccttcaaaatttccaacgccttcgcacggttttgttgttgtgaacgctggtcttgcatggctaccacgataccagaaggcaagtgggtcatacgcacggctgatgacgtcttgttaacgtgctgtccaccggcaccagatgaacggtacacatcgacacgcaaatccttgtcttcaatttcgatatcaacgtcttcgtattctggcatcaccccaacagtagccgttgacgtgtgcacacgaccagctgattctgtttcagggacacgttgcacacggtgcgcaccgttctcaaacttcaactttgagtaaacgttgttacccgtaatcatcaaaacgatttccttgtaaccaccgatttcagtcttgttttcatcgataatttcaacgttccaaccttgcttttcagcgtagcgttggtacatgtcgtacaagtcagccgcaaacaaagccccttcgtcaccaccggcagctccgtggatttccatgatgatgttcttgtcatcgtttggatcctttggcaaaagcaaaatcttaatttgctcttcaagggtttccttttctgcctttagttccttcaactcatccttggccatttcttccaattcagcgtcgcccaaaccttcgttcaacatctcttcgttgccttcgatgccatcaataacgtccttgtaacgcttaaacgtctcaaccgtttcacgcaagctaccttcttccttagaaagcgccatgaaacgttgcgtatctgaaatgacatcagggtcagaaatcatttcgctgatttcgtcgtaacggtcaacaaccgcttggaccttctcaaaaatctcatccatgtgatttacaattcctcttctttaagtatgtattagtgcttaacaacacgacgggcaatcgctgccatgtctgggtggttatagtgataacggcaaactggcatataggcttcatccccaccaatttgcacttgtgcgccttcataaacgggccgaccgtcagaaatgcgtaagttcatcgtcgccttacgaccgcagaatgaacaaagcgtcttcatttcctcgattttatccgcataaatcaataaagcttctgatcctgggaacaagttattaaacgcgtcatttttcaacccgaaggccaagaccggaatatgtaactcatccactacccgtgtcagttgtaacacctgggctttggtcatgaattgggcttcgtcgattaagactgctgcaacctcatcttgaccgtgaatcaatgcgaacagatcgtcctgctcagtaatcgctgtggctgagcgctgcatcccaatccgtgatgcaatttcgccaacccctgaacgattgtctagcgcactcgtcaataaaagcacatggcgttgttgtgtttcatagttgtgtgcgacttttaaaatttcgatactcttaccgcttgccatcgcgccgtaacgataaaacagttgcgccatatgcgaccacctttccgtttgccaaaccattttttgcagtttgacactcgtataccagtataacgaaatttcacttataaaaaaagaagagaactcgcaacagttcccttcttgccatttaattcgctagattcttgtaattcaaaatcttcttatacatcgtcttgtactcagcgttcgtcatcgtggccttgtatggtgggatgtagaaaatcttggcatgcttgtcgaggtagtccattgggttcgtcttagcagaagccatagccttcttccacgtatcacgggagataccttgcttatcagcttgccaatcaagaataaatgatgccaatgccccgacgttatacgtttcagcgtatgcaccactgtctaggtaagccaagcggttttgcttaaacaatgtccgcaccgcttgatcgttttgcttcatcgtcttcaccttgtctggatagccagcaaatagtgaggaacgaatctcatagtagtacgccgtcccttccatccgatcgtcctcaaaggttgccttgtagtccttggcgtagttttccttgtaataacggtacgttgccaacgcttgcgccaatgacttttcagacttattcgtgtaagccgccattaattgttcttgtaattgcaatcgaatacggcgcgcatccgtgtgcttcaaatactcgttttgctctggattgtcgtgcttctttggtgacgcccaaccctcttgttccgtaccgtggaacatttcgtgcgcatacgtgatgaacaaatcgtatgttcccaaatgtgggtagcgcaccagtcgcttcgtattcgttagttcatctttattaacggccataaatgcaccactcttatgatgcgctgcgaatgctaaaaaccacccctcatacggttctggctgaaccccataagacaacgcctgcttctccgttaaatctgacaccttacccgttggtgtcaccatccaaaacgtcttattgtcgatgtcgttaatcatggcatattggttaacatccttattatccggccaaagcttcggtgcaattttatggtaaaccttcacctgattcgcaaatgtcttgtggacatatgtcgagacatcttgatctgcccgagctttcgtaatgccaaattcacttgcatgtgttgtcgtgcccaatagcaacaagctgataccgatgacaccagcgcccaaaccaacctgtgcgcccacttgtttcatacccatttcgtaaaccccactattttcaagtttgctttattgcatttagtttacaaaaaatgagtggcgctgtcacaagataaggtttaaaaaacacccgttgaccttaatcaacgggtgtttcgattatcattagaatgcttctggcttgatgtcggccatcttttcagcccagttgacttctgggtactttcgttccaaagccgtttgcaacacgtgcaaggccaagtttccgttacgcgtaaagataggtccgtggaagtacgtgccataaacattacggtacacaagcccttcaccgccgtcttcaccgttgtttcccttaccttgcaagaccttacccaatgggcgctcgccttcacccaagaatgtacgtccttggtggttttcgaaaccgcggtactcgttgccgttaacttcgtccttaatcaagacattaccaataaaacggctgtgttgttggttcaacgtgtagtggtccatgacggaaattccctcaacacgcgtcccatcagccatcaagaagtagtgacccaacaattggaaaccaccgcaaacgcccaacaatgggccatctgattcgatgtagcgcttaatggcatctgccttaaacttcaaatcttctgcaacgatttgctcttcgtagtcttgtccaccaccgaacagcacaaaatcgtacttcttatcatcgaactcatcgcccaatgaaatcaactctacgtcgacatcgacaccgatttgtgatgcatagaaacgcatcgccacaatgttaccgtagtcaccgtaagtgttcatcaaatcaccgtacaagtgtgcggtgtgcaaaacgtactctgctaccatgattttattctcccataccagtcttgataaagccttgttgtgccaattgggcacgtagttgtagcattgccgtataagttgcggcaatgtacacgcgcttcgttggcatctcgtcgattgcctttacaatttgcttgagatcttggtaaaccgggtgttcaccgtatccagccatcttcacacggacatacaagtccttgtaacgctcaccaccagttgcaatggcttgcatgcctgaatcctttagtgattcaaagtcagtatcccaaatccaactcgtatcgataccatccgcataatttgcattcaacaatgcaatcaatgagaatggttggtcatctgtcttcatcatatcgatgacttggtttgccccaactgggttcttaatcaagacaatcgtgacttccttaccgttgacgttaacggcttcttgacgaccaaagatttgcgcatttgattcaaaagcgtggtgaatttgttgtgtggtaacacctaagaaacggccaactgtgtaagcagccagtgcgttatagatgttgtacatcccaccgatttcaatttgatacgtctcgccatcaatatcgaagtttgaataacgaggtgtcatctcattaatcttcgttacggcataatccaactcaggacgcttgaaatcgtcagaaactgagaaataatcaccttgattaccgaacgtcataaagtgatagtgcaacaccgtgtcatccgttggtgatagcacaccgtctgtgttgtgaggggccttcatatcgccatccgctggcaagtgattaaatccataataaacctttggatttggcaaatcgccacgcatgaagattggtgaatcagcgttcgcaatcaccgttgcctcagggaacaaacgaatgcccttcaaaatcttatcgtaggttgtgtaaatctcaccaaaacgatccaattgatcacggaagatattcgtcaatacaaaggccattggcttcaattgacgcgcaacttcttccacgttcgcttcatcaacttccaaaagcgcaattgggcggtgtgacttaccggttactttcgctgtcaacatcgttcccgtgataccttgcatcatattcgaaccagatgggtttgtaatcacatcagggaattgttcgcgcaagacacgcgtggtcaatgttgttgtcaacgtcttaccattcgtacctgtaatcaaaataacgtcatacttctcagccaacgttgtcatgacttcagggtcaatcttcgttgccaacttacctggcaatgatgtaccaccacgacgcaaaatatcatgcagtaccacgtatgaacttttaccaacaaaagttgccaatgcactcttcaagctcatgtcgtcctcctactacatcgtcaccgatgtttatctgtcaaaataactaatctatagtgtaccattttcgcgcataaaaagtcaggccgataggaatataaaataaaagcacgcgcaaataatttgcacatgcttttgctaacaatttacttacattgactttggtcccggcgtcgatgtaatcaacgtcgcctcaccttgtagcgtccacgcttcaacatcgtttggcaagatgaagctttggcccttgtgcaatggataggtcacaccaaagacggttaagtctaatgtcccgtcaatcacagttgccagcaaatatggtgcgcgtgcatctaaggtcgcacgaccgtcaacatcccacttatagacattgaagtaaggtgcttcaaccagcgttgtcaccgtgacaccaccgtacgtagccgtcgacgtttgtggttgttccggtacaaacggtaccgtcgtcacattcttcgcatcggccaaatgtagttcccgcaattcacctgttttcgcatcaacccggtcaaaatcgtaaacccgatacgtcacatccgatgattgctgcgtttccagcgcgagaaccccggcacctaatgcatgaagcgtcccggctggtacgtagaaaaagtcgccagccttaacgggcacctttcggagtaacttatcccagtgaccggcatcgaccgccgcatcaaattctgccttggtttgggccgtgtgcccgtaataaatttcagcgcccggttcagcagccacgatgtaccacgattccgttttaccaagttcactggcgtgttcaccagcatacgcgtcatcagggtgcacttgcactgataagtcctggtgcgcatctagcaatttaaccagcagtggaaatggtcggttcgtatccgtgttaccaaacaactgtggctcttcttgccacaattcagcaattgacttacccgcataacggccatcctcacagaacaccgtgccattcttgtgacccgaaatcagccacgcttcacccgtcgtttccgatgggatatcaaagccaaacacatcacgcaacgccgtgccaccccacatcttttcgtgcaaggctgccgtcaaaatcaatggttctgtcattattcaattcccccaaagtacatgtcgctaattaatcaagatgcaaataaatacttgaaatccaaccgtgttgcaccacgtggtaccacaagataccagatggatcatcaacccgttctgaaatttcaatccgtgaaccgtggacaactcgtccaatttcacgtccgtatggttgtgcatatacggccacgtccccacctggcacataatccacagtcccgcgggccacaaaatgctttggggcccacgtcgttggtcgattccattcagaaattggctttgctgaacggccatcattatccgttaacttcattgtttgcatgttgtaaggtacccagcgtgaatctgatagttgataccagaacttcccctcacgcgttgcaactcgttgggcaaccttcacgtatgaatccgcccaaagcttttggccagtcggttcagcaatctcaatcgctgcaaccggttggacatccgctaacaaatgcaaatacttatcagttaattgctcagtttccgcaatgtcatcgcgacggtaatagaacgttgcggtgtgcatcgtggtttcatcgaaagtcccttttaacgtcccctctgatgaaacaaagcgataccctggcaatgtttgtggatcaactgaaaagctgtcacccacggtaccttcaatcaatcttgcatgcgttaacgccgtctttgtatcaacatccttggcgtatacccaaactggcataccctttagttgaaagtcagccatactcgctgcctcctagtcgtagtttcttacgtctattctaccaaattaaccttaagtaagcccgcgttgattacctgcacttaaccttttgtttagtttaacgtcttaatgacccgtgctgggttaccggcaaccatgacattacttggtacatccttggtcacaaccgcaccggcaccaaccactacgttatctccaatcgtaacacctggtagcacgataacggaaccaccaaaccagcaatcatccccaatcgtgattggcgaatcatattgccaaccctcacgccgcaactccttatcatatggatggtgattcggcgtgtaaagctggcagttcggcccgataaaacagtgcgccccaatcgttacgcgcccagcactcaaaatttgcagaccggcgttaataaaggtggcgtcgccgatggttagacgttggggatgctcaattgacgtgattggaaaatacacatcagcatctgccgccatatttggtaagaactcttgcaacaaacgcgtcgcttcagccaaatccgtcttcgcgacatcattaatgcgttgcaccgtttgggcactttgcttgacgatggcttgtaccttaggctccttcgcgtattggtaccactccccttggtcaaccttgtcaaaaatatccacatcggctaaacgcacgatttctgctggtgttaagtctttcataatccgattcccctcgttattcagtaactccattatacgccaaatttgtacggacaaatgtgaattaatttaaatgagaacaattttaatcaaagtagttgacttctcattttccttactgtatattaatgtcatgccttagcgaaggacataattgctttgtagttcagcggtagaatagctcactgttaatgagaaggtcgctggttcgatcccagccagagcagttgccatcacggcgaattgaatacactaattgctctgtagttcagcggtagaataactcactgttaatgaggaggtcgctggttcgatcccagccagagcagttgccattgcggcaaattgcatatctaattgctctgtagttcagcggtagaataactcactgttaatgaggaggtcgctggttcgatcccagccagagcagttgccggaccccgtttcttaattgaaacggggtctttttcattcacttttttatcccataaagaaaagagcaactgtatcgctacaattgctctcatcaattaatcattaaacttacgcttcaacgtcaatgcacctgctgcaccaaccagaatcaaaccaacaatcacaaagcccataatgcccgttccacccgtaactgggaagattgattgcaacggctcttgcttcttgttttcaaccgtgaacgtcgtcgtaaagatgttcttgttttggtctggcttaatccattccgtcactgccccatccttatcagtcttcacaaacaataccttttcgttcgccaagtccgccggcactgttacaccagtttgcgttgtgaaatccgcttgcttcaaaaccttgaagtaaacatcttctgcgcgttcgtaaccagttggcaccgtcgactcattcaatgtgtacaacttgttgaactcaagtgtttgaccagttggcatcgtgtgcataccagtcgtatcatccttgttcataccagtcttttgcgtcacatccgtgaagtattggaagaccgcaccagccaatggcttgttgtcttgatcaaccttcttcacttggaagactgccttgatatccaattggttaggcacgttagctgtgacgctaccatccttcacgtcaacattcgtcaaaacggctggatttgtcgtttccttaaatgttgatgtgtaagcatcacctgtaccgtccgcgttagctgtcaacttagcgccaacattgaacgtgacgtccgttgccttcacatagccatctggcgccgtttcgatcaattggtattgaccaaccggcaagttgttccacgtccagcttgtctcagttgtcgttgatgcggcgatcgttgttgccgtcgtcaacgtcttgtaagctgagatttcagctgatgcaaaacttgcagccgtccaagctgaaggctcaccgaccttctttagctcaaacttggcacccgccaaagcagccccagcctcgtcaaccttgttgatagtcacgttagtcgttggcaaatcctttagtccaaccgttacggtatttgtcgtactcttatactctgaatcatcactgtgctcagtcttcgtgtaaacgtcagccgtattatgctttgtccactcagcaaaaccttgcgctacttgcgagtcagtctttacgtccaaacgaagtgcgaacatatcagaattaaagtcaatcgcttgaattcccgcatccgtcaatgttgcaacgaccttttgaccagcaatcgttaccgtgtagtcagctccaagcttcagttgcttaccctcggtatcatacagctttaccgaattttgaccatcacgcaacgaaataccatcaggcaaggtatcctcgaaccgaataccgaatggccgaatcaaagaatccgttcccaaatcgtaggttggttgtgttacccagtatgcaaaattaaactttccgtcatcagtagatgtgattgccaagttcttctcgtgcagattacctgacttttcagccttagcatcactaaccgctgttgtatatgttgtatcatccgttgtcactaacttatgcgtttgcgttagctctagcggatgcatcacggctgctgaaattgtctgccatgtattaccgtctcccgtacgtaacgtaaagttatacgcatccccactaactgggaattgcaacgccgccatttggaagtttgtaccacctagagaatcttcaaaattactctcataacccttaatatccaagtagctctcgtacgatgtaccattgacatccgtcaagtcataaacaccgtgcaccgttgaataccagattcccgcggcatccttttgcataaaggtatcatcagagtcggtagttggatcatcatacggttgtgccgccaacgttcctgcaccaccaaaaacagtttcagcatactttgaattattaatgcccgttgatagttgatcccatgagaaatcagcaccaacagatgagccagaatttgctgaacgcccaaagttattcagtgatgagaacgtcacgtgaccatccccttcatcaacatcaattcgttcagcaaacttaccatcaaccaacgtgtagaactgcaacttaatatctaacgactcaataccgtgatacataacacctgagtacaggttattcggtacatcgatgaaatgcatattacctagttgcaagtggtcacctgaagctggcgtcacatttgagatcgtcatcgttgcaccaattggatggtgttccttagtgactgaatcaacgtaactacccacgtggtcataaacaaccgtgaacttcgcgccagtcattgcatcgccgtcctcaaatgagatggtatacgctgactgattatcgccacccgtttgttcatattggttatggtaggttgaccgcacatactgcaggcgagtcgcatcgtcctcattctcagacccaccaatattgccagttgccgtcacatctttcttttgataaatcgtaactggcttctcgtgctcggcatccgccgtcgtataaactggtgcattcattgaactccacaattggaaattattgaagtcagtcttgttatctgaatctggtgtcgttcgaacaccacgctcaatcaagaaaccatcaacaatcccttgctttgtgtcaggcaacttcgcatagacatcagcagggtcgtcagaacttggtgctggcaacgttgtttccggctcatcaggctttgtttcaccctcatcttcaccagtcgcagcatctccctcgtaaccaaacaagttcgcctcaaccatcatcttggcatcatctggcaacaagtttgtctccgccaacttcggcgccttaatcttagcaccttgttgcgcagtacgcgtcaacgctaaaccaaccggcaccgaaacggcacgcttttcatccgttgttgacttagccgtcaaaatcaacgaatgaccagaaccaccattgtagtacaactcgaagccacccagttcaccagttttagcatcccaagactggccattaactttaaagtcagtcaatccttgcttggctgccgcctccttatcgattaagaacgtcacctcatccttatttggataattagcatccttatcgataaactggaacttccaagaaacttcgcgcccgttctcccatttccagtcgttaccatccccagcagtaacggtcagtcgatcagatttatacagcgttttttccgccgcatagactgtcttggctaacaagcccatgttggtcacataaggaacaaccagcgcaatcaaaccgacaaccgcccaccagaaacgcaaccgcttgttgggcagaataccccggtgtgtttccataaacatcactccttttcatgctattttctgtttccagcgtaatggaccaaatatccactactgcactctcatagaatagcgaagcaatgtagttatcttttgccggggtcttaacgaaactttgaagtcttttgaagaattatccgcacccttcaaaccccttgacgattttgtgcattttcaaacaatcttcataaatcaaactaattttcagcaaatcccacaacgaaaaccgtcatatttacaattcataataagtatttgtaagagggttgaacgtaacttacatggggaaaatacatatataggccggtagctatcacatcgatagtcaccggcctattttttatacaatgagattaaatcatcccatttcactaaaaaaagtcgcaccgcataattgcagtacgacttaatcattaactattcaaataccatttggtttgtatacaactcagcgtagaagccgccttgtgccaacaactctgcgtggctaccttgctcaatgacgttaccgtcacgcaagaccacaatcttatccgcattcaaaatcgtcttcaaacggtgcgcgatcacgaaactcgtccgaccggcaatcacgttatccatcgccttttgaatcttagcttctgtcaccgtatcaacgtttgacgtcgcctcatccaaaatcaacaagtcaggtgccgtcaaaatcgtccgcgcgattgacaacaattgcttctgaccagttgagaagactgaattttcatcagacacttcagtatcgtaacccttttccaacgtcataataaagtcgtgaatattggcttgcttagccgcatcaatcacttcatcatcagttgcatcaggcttaccaaacgtgatgttgtcacgaatcgtaccggtgaacaaaacagaatcttgcaacacaatcccgacgttatcacgcaacgattgtagatccatgtcacgaacgtcgatgccgtcaaacttaaccgcaccacccgttacgtcatagaaacggttcaacaaattcatgacagtcgtcttaccagaaccggttggtccaaccaaggctaccatttgccccttatcaacttcgatgttgataccatgcaaaatttcacgatcttcgttatacccaaagtgcacatcgtccaacacaatcttatcttggacaccgttgaacttcaccccattagctgggttaatttcatcatcttgctcgaagacttcgttcaaacggtgcgcacccgtcatcgccaactgcaacatgttgtaagttgacgtgatttgggtgattggctggtagtattgttgtgaaaatgacacgaaggtcacaatcaatcccaaaccagctgcacgggctgacaaatcaccgttcaaggcttgcgtcgcaccgtagaaaataacgatggccaaattgaacaagcccattccttgcatcaatgggaacaaaacacctgaccacgtttgaccaagcgttgacgcacgacgcaccttgtcgttgtgtgccacaaagcccttgattgactcttcttgcaagccgttggtgataatgaccttttcaccattaatctgctcattaatgtaaccgttcaagtggcccacttcagcttgttgcgcatccacaaacttctttgcttgcacaataatcagcgccgccaagataaccgcaactggtgttgaagcaatcgtgacccacgccatcttaggactttcgttgaacatcatccacacaaccccaaccaacatagccacttgtgagaacaattggaagatggcttggttcattgcattaaagatgttatccaaatctgacgtgaaacgtgacaatacttcaccgtcttggtgtgaatcaaagtaacgaaccgtcatccgttgcatcttgccaaacaaacccttacgcatttggttcactgagttagaagcgacgattgattgaatcatggcgttgataaatagtcccaccaacatcaacaaaacaaaggccgcaaacgtccacaacgcatggtggaagtcagccaaactcgcttggctcgctgtcatcgggttcaacttcaccatcaaatacttcgatagctctgtaattgaacgtcccatgtaaactggcgctttaacttgggcccacgttgcaaaaatcgtgaagaccacaatcgcaatcattgccacccagtagcgcttaaaataatgagcaaagaagcggactgattcagtaatattcttcatcgtttatgcctcctgcgccttttgtgtcttataaatttcttgataaattggggatgtttccaccaattcttggtgcgcgccttccgcaaccaatgccccatcttccaaaaccaaaatacgatcagcgttaatcactgaagaaatcttttccgcaatgataaatgtcgtcgtatcttgcaattcgttatcaagggcttccttaaccaacttttctgacttggcatccaacgctgacgttgaatcatccaaaatcaaaatctttggatcaccaatcaccccacgggcaattgacaaacgttgcttttgaccaccagagaagtttgatgagcgctcctcaactacgtgttcatacgtgtcttcatagcgttcaacgaattcagctgcttgtgcaatttgtgctgcacgcttcatatcttgctcttgcgcatccgacttaccttgacgcaagttatctgaaatcttacctgagaacaacgttgcgcgttgcaaaacgaatgacaccgtcttgcgcaatgatgactcgttggcatccttcaaatcaactccgccgaccttaaccgttccttcggttgggtcaaacaaacgtggaatcagttgggccattgatgacttacctgaacctgtcgcaccgacgataccaatcatttcaccaggttgcaccttgaatgaaatgtgcttcaaagttggcttatcatcccctggatacgtgaatgacacgtcatcaaattcgacagctcccgtcaaatcttgtgccggtacatccttataaaccaaatctggcttagtatccatgatttcagaaatacgacccattgacacaaatccacgtgccgcaaaggtcatcatcatcccaccaacaataatggcttgcatgataatcatcagataattcgtaaacccggtaatttgcgccaacatcttaggctcagtccccaccatatttccaacgaaatagatggccacaaccatcaaaccttgcccaataaacatgaaggccggcatgataattgagaataggtacccaatctgcaaattaacgtggttcaattcatcagaaacatcatcaaaacgcttctgttcattaacttcttggttgaatgacttcacgacacgaacaccttggaggttttcctttgccttcgcattcactcggtcaatcaacccctgaatcatcccgaaacgcttacccatgtttcccatgaccagcgctgaaacagcaccaaccaagataaccatgacgacgatgatccaccataacttgggaattgaattaaccgccaagataaagccaccaataaacagaattggcatacgtagcaatggttgcaacatcatcatcaaaatactttgaatttgttgcacatcattagtcaatcgcacaaccaagttaccggctgagaattgttccacgttaccaaatgaaaatgtttgaattttacggtacgctgcttcacggacatcagacgcaattccttgcgatgcacgtgctgcaaaaattgtattcacaatccccgcaatcaaaccaatccccgcaatcaccaacaattgcaacccaatatgacgcaccttgctcatattgtcatctgagattgcttggacaatcttagaaagcaatgtcggttggaatagcatcgccatcgccatgataataaccgtgatgacagcgagtactaaatcgagtttgtaccgcttaaaatacggctttaacaaacgcatagtttcccctccaattaataaattatttctatcgttagtgaaccattctaacattctttttcagttttttgtcaatttagttaacaaaaaatttaaaaccatgaaaaaagcgcaacccatgtgatgtacatcggttgcgctttaaaaatttatttcaatgacgcgaagtttttagcccgttgttcagcgttaacgacactgcgtcgagtcagcaaaatcgttgctacaatcgcaatcgtcaccatccccagtaacccagcaatcaaatgataaaagatgcgaggtactttagccggaatcgccaaccaagctgtcatttgatttgacacgttttgcgaatccaaccaattagatgaatggtctgacacatccgacaaaactgacggcttcaccgtaaagggcaggttttgcaaatcccaaccggtaatgcgttgggtcggtcccaaattacgcggatacataatatcatgctcattggttgtattatgctgcaaccccaaggcgtgaccaagttcgtgttcccaaactgacaccaccaaatcatgacgcttcatgtatgctgtttttgcaaacgcacgttcaatttcacgttgatataacgtaatcacgaccgtccgcttatcaccaagggtcgtcgtctccgttaaccccagcggatcatcggcaccaggtgaagcgacaccatccgtgctccacatcatggtcacattcaccgcctctggatcagtaggattcccgctaaacaaagttggcatttgcagcgtattcgtccaaatcgccatcgcggcttttgcctcagtctgttgttttgccggtaaccccgccatatcaacagcataagttgttgccgcctcagcaaccagcccgtgactacgcaccaataacgcaactaccaacgtggcgataaccagcatcgccccttttaaaaatcgcatcccaaaactctctaatctctcactattaaatccgttctttgtcctctctacttaacaaagaacgtggcaatcatcatcactacagcaaccacaaacgccaaggctgtcactgccatgtgtaaacgacggtgcatgttcaataccgcaatgtattcacgaatgaatgctggaatacggtaatagaatggggtattaccacctcgaccttgggccagcacgtcaaaacggcgcgcctggaggccagcacggaacacgtggtactcactcgtaaagtacacaaattcaggatcaatcttgccagttgccttactaataatatcacgagaaaagcgcatattttcgcgcgtcgttcgactctggtcttccaaaagtgttttatcagcgggatagtttagtgttgcaaccgcgtagtcgcgcatcgcttgggcttctgaaactttttcgtcgccccctttaccaccggaaaagacaatcgttggataaacgcccgttgcgtcaaaacgacgttgcgcagcatcggttgccgccttaattcggttacccaacaacttaccaacggtttcaccattcactagaccagcgcccaagacaacatagtaatcagactcacgcttacgtgtcactgccgcgtagacaatcgctgataccaagaaaatgacgaaaattaacatgaagtaaagttccatcacccgggaaaaaataaacaaggctgccaaccatgccggtgcatgttgcatcatggcgtcaatcatgttgaaaatcatcaagcccaagaacaacaatggcagcaataagtttggtaacgtgtggtgctctttacgccagacttgccatgagtaataaaccacagctaagtcgaagaaaacggataggaacaagaaaatcgccaagaacaaggcaaaaatcatcgcaaaggcgaagattcccgtaccgccaagttgcaccaaaatcatcgtaatcgagatggcggcgaaaaaaagcgtaaataacgtccaaaccccaagccacatcgaccgcggatccgcgttaaccacacgccacaacgcatacccgcttaaaacaaataacaataacgcaattagtgtaacaaatagcataaagcctcccttaatctacgacataggccgcaaatcgggccgcttgcactggtgttagcgtgacatccatcatcgtgccagcttccacataatcaatgctgtgtactgatgcttgttcattcaattcactgaccaattgtccttgttcgaatggaatcaagacctttgtttggacgtggtctgaatagatgtgttgccggataacatcaatcaacatatccaacgatgcatcatcttgtgctgacaacgtcaaagtatccccatcacgatctgggaatgacataccttcaatcttatcagccttgttgtaaatcgtaatcattggaatatcaccaacaccgatttccttcaacgtcttggccgttgtcgacatcatttccttgtagttttcatctgcatagtcgaccacttgaagtagcaaatcagcttgtgcggcttccgccaatgtggcgcggaacgctgccaccaagccgtgcggcagctttgacacgaacccgaccgtatctgacaacaagaagttttgattgtccggcaagttcaacttacgcactgacgtctccaacgtggcaaacaacatgtccgcttggaagaccgtcttatcttggttctcaccatagcgacgcaccaacccgttcataatcgttgacttaccggcgttggtgtacccaaccaaggccacgttcttgatgctttctttttcacgacgggcgcgacgagtttgatcgtcagcttccacatccttcaattcctgacgcaagagtgaaatttggtgttcgatgtgacgacggttggtctcaagcttcgtttcaccggcaccacggctggtaaagctacccccgccaccaccagtttgctgatccaaacggacattcatcgacgtacgcaaacgtggcaactggtattgtaactgggcaatcgcaacttgcaacttggcgaccttcgtcttagcacgtgaggcgaagatatccagaatcaaagcagtgcggtccataatccccgccccagtacctgattccaaattacgaatctgtgaaggtgacaattcatcattcgtcaccaccatatcggcttcgtaatattcaaccgcttccttcagttcttcaactttacccttaccaaagtatgttgcagcatttggacgctcaagcttctgcgtcaccgtacccacaacttccatataatttgcttctgccaaattagccagctcaatcatttcataatcaaactcagcattttgacgatccaagccagcaagaataaccttgcggactggatgtaactcattttctatcatagccatttttcttttaccaattcgttgtcgtgtcgttgtacgccttcaacttcatatcatcatctgagacttcccagactgaaattgaaccgttcaacggctttgtctttgctgtttcgtgagaatcgtacttataaaccaaattgcgaattaacgttccgtgggccacgaccaaaacattttggccatcgcggacgttacgccgtaagatatccaggcccttatcggcacgcgcccagaatgttgccgcatcttcagcgtcgtgggttggatccgcttccttgaaagcatccatgacctcatcttgcgttaattgcgccatcaagtcaccgtacgattcgatgttttctagtccaataatacccgcgatttgctcagcactttgcgcacttggcaatccctcaaagaaaccgaagaattgctcgcggaattgttgcaattgctctggcgtcttcaaatcaccactttgtgtgttacgacctagaataaattcagcggtatgaatagcccgttgtaggtctgatgagtacgcggcgtcaaaccggacattgctgagtcgctcaccagccgcaaagccgtcggaaatacctttatccgtcaaaggggcatttccccaaccttgcatccgttgatatttattgaagtacgtttcaccatgacgtaccaagtacatgttaaatgacattaattgaacctcttttcggtttgttagacgattgttagtctagctgcagcctaataaatgacgataatctaacaggctacgcatccccttactaatacctattattgtaccatttatgtaacaaggaccgcatttttcaaggcagggcgtttaattgaattttgttaggaaaaagtgttgactttggccattgatatctgtatagttatgtattgttgttaagcaacagatgatattcatggcccaatggtcaagtggttaagacgtcgcgttctcagcgcggaatccagggttcgattccctgttgggctatttcagctcaatgctattgatatcatcatggcccaatggtcaagtggttaagacgtcgcgttctcagcgcggaatccagggttcgattccctgttgggctatcacttgtaaaagcacgtaagtttcggcttgcgtgcttttatttttgccattaaaccctttcaaacaaataacccccgcgacacaactgccgcgggggttatttcatttaacttatttaccaaagaacatcgtaataatgacactaaaaatcattagcaacgagatgctaccgttgtaaaccatgtgtgtcatgatgttttgccagatgttgcggccaccccagatgtataccagttgcaaccaaacacccatcacaatgtacatgatcaatgaactccagtgaccgttaacgttgttgatgtgcaccacaccaaacatgatgttggcgaaaattgagatcaacacgtatacccacttcgccttgttgcggaatggttccgtaatggcgtggtggaaaacgatttcctcgtagaacggtgcaaacaaaccaacaattgctgacaagaacgttggtgcaacgtcactaaatgacaacgcgcttgcaccactgtacttaatcgcaaagtcccccgtatccaagaacccagtcaacgccttcgttaatggcactagcacacccatcataataatgccggctagcaatgcccacatgacattcttaacccagtgttgacgccaaatctgccagtcccggcgcaaaataccgtccgaccagtagaaaattgacactaacaacaagatggttgctggcactaacgccgcaatcgaagccgaccacgttgccaatccagtcgttgattgcgcatttcctgtcaactttaacatccagcccccgattggaccgaataccatcagtgggaagataacaatcgcactcacccactttacccaattaaacttctctgacttagccattttaaatctcctaccagttatcccatttctattttcaatattctataacgtatagtattgttctgcaacacatttgtcacatttcttttttgcatgtcagtacgcgtcggtgccactttcacgatacaatagatttatcagataaaaggaacggtgaccgcaatgaaattcatttcatggaacattgatagtgtaaatgctgctgttgagcataaatcagcccgtggcgagatgacttggcaggtactgcaagacatcgctgctgagcaacccgacgtcttggctatccaagaaactaagttaaaagcaactggcttaaccaagaaacaagcaaccgcgctcgatgaacttttcccaggttatcaccgctacctacggatgagcactggtcgttctggctactcaggtacgatgatgctgtcaaaagttgaaccaattgccgttgagatgcccgttatcggtgcccctgatgaaatggacatcgaagggcgtatcattacccttgaattcgaaaacacatatgtttcaacggtttatacgccaaattcaggtagcaatttggatcgactaaccgaccggcaagcctgggatgacgcctaccgcgcctacatcgctgacttggatgctaagaagccggttatcttctcaggtgactttaacgttgcccaccaagaaatcgacttgaagaatcccaagaccaaccacaagagtgccggcttcactgacgaagaacgtgagaagttcggtttgctacttgatgctggcttcaccgataccttccgttacctaaatcctgaccaaaccggtgtttatacctggtgggctcagatttcaaagacctcaaagattaacaattctggttggcgcattgactactacctggcgtcaaaccgattgaacgaccaattggcaaccttcagtgttgtcgacaccggcgcacgtcaagatcacgccccaattaaattggaaatgactgacgatttcacgctttaaactaaaagagacgcagtgcatgctatcaagctaatgcactgtgtctcttttggtttattaacccttaaattcgaaagtatacttccgaaaatgaccgaaaaaccctaaattcagaagtatacttccgaaactgcgttaaaaaacacgttttccggattatacttccgattttatttatcgattaactgtttctgccgtcaacacctcgacgtacgttcgtaaggtgccatctggatttgcataaattgccacacccacatccacattaccgggtgttagcaagcccatcttatgcgatgcgccttgttgatacgatgaggtgccatcataaccggctgcttgcccatcatcgccaaattgcaaaattgcatcttgggccaacgcctgcaattgtgcatcactcgtcaaatcggttacgtgccagacgtctgatgacgtacctgcaacactaccaaacgacaacgtatccttctgatcagcggtgccaccataattcacggctgcaatatgctgaattgtcgaaccatcaccattggtttcttcactaccatggttgtagtagcgtacttgcccattacctaaatcttcaaccggcatcgtgccaaacagattattaaaattggcatgcggattagccgcaaacgcttctggctcacgcaacgcccagcgactctcctgcttcgctaaatttaaggccatttctgacgtttgcgccggcgccacgccataccgtgcgcgataatcgttcaaagctgccaatgcatacggttgtaacttcgccaaggtcgcatcggccaacaattgattaggcccattcgtgacagtgactggcgcagttgcctgacttgcgctacttgctgacactgatgacggcgttgcacttgtaactgatgacgccaccgattgtgaaaccgattcactcacttgtgatgcagctgaagactgacgactcattgctgtcgatgcttcagcgcgatgcaagcgataagtgatggtctcagaccccttcaccgtaatcgtatcacccgggttttggtgatacccctgttgttgatacgtcggcaaaatcaatttagcgccatacgttgaacgatactctcgtactttaacctcattaccagtaatatcatcaagataccgcaccttgattgtgtatgtttcaggcaaatacttaaatgtaatgaccgtcttttggcccaccgtcttttcaattgctttgggcatttggtagcccgtcgcaacgactggcttaaaccgttcatgtgccccaattggtactaatttttccgtttgtggttgaatcgctttatttgtacgaatatcgacatagcgaattttaacttcggtctttttcttttctgaggcgaactccggcaccaatccactcgaactggccaaagcgccacccccaagtactaaggatagtgccgtcaatccgacgacacgccaatttttcaaaacgcccctcctttcggcttgttaacgttgtgtattaagttaagtatagctgggggcgtttcatggtcgcaaacaataaccctcacacattaaaacgccccaggttcatggctgcggacctggggtgttttgtcattatttagatagccctgtaacgtccatatgggcttatatgctaattggataaacaccccggctacgaaccgggtattgcaggttcgagtcctgctaggcccattagtgaatctctgatttactaatgttcatataaaaatgaatattgttcgggacgtagctcagcttggtagagcacctggtttgggaccagggggtcgcaggttcgaatcctgtcgtcccgattatataacgcaagttatagatcgcggtgtagctcagctggctagagcgtccggttcatacccgggaggtcgagggttcgatcccccccgccgcgattgacggaaacgtcagccaataaaatcatgcggatgtagtacaatggctagtgctccagccttccaagctgggaatgcgggttcgattcccgtcgtccgcttcaatgatttacaacagcatcacttcggtggtgctgtttttttacattcaaaccatatgatgtcactagaaactagtgttttcttcaaacgaacagactataatcagagtaattagaacggtaggagggcacgtcatgaacgaaccacaacaaccatttgatgatgaccaatttattccagttgaatatacagaattgattcggcaatcatatgctgaacaaggcgggtatagcatgccagcgattgataaaacggcattgatggtcaatcgggcactggcggtgtcggtaagtgatgatttggtcaaggaataccatgatgacgacacggtagatgataatttcgtccgcatttttgtgcgacaaaccattgactacggttatattttaacggatgaagcgccacgtgaatggacggctgataatctatttcaagcgatggggatgactttaggatatttagaagttgcacctgaatttgctggcatgttaatcaatttgttagagtcaattactaaaaatctagttgcgcgcgggttgatgccggctgatttctttacgcccgatgtccgtgcatggttaatggagactgtgccacagtacttagaggatttagatgaatctatggacgaaccaatggatgaaagcgaaatcgaagtcatggagcgcttgatggatgatttggggttagaaatttcacctgaggacttaatggaaacgaacgtcgatctcgcccaagacacatcggttgatgatgatgatttacgcgtcaagttcttttttgaggttctaaatgcgagcggtattcctgacttatatcagcaacatcgtagtatcaagccagccgttaaaaagcatttagcgtatttaggtacgcatcaggagttacttgtcttaacggtcatgtacgcctcagccatgcgtgaatggcttgaaacgcaaattgaaatgggtgactggtcacacacggatttcgtcgtgcgcgatttctttgatgacgtaaacagcatgttcttacaggatgtcattacgattgaaaatgatgaggaagtcattcactatactgccgaactcaaagcgttgattagcggggtcttagcgcaagaacctgagccgatggcctatgtagctgaacaagggtcatctgaactaccagcaactgaaaacctgcaacgaggctttataactgctttacgtgatcgtgatcagctaacaggcgaagggttggatgttgccgaatctatcttgaagattgtcttggacaccattgcggtgaaaacagatgcggacattgcgacattgccagttgaagctgcaacccaagtgttgattgaaaaattccatacctttgatttattcggtcttgatggctttgaatttgtggatgacgtcatcattgaatttgtgcgctggttggctgaacggggactcgtgtcagataacgtcgttgaacgttggggaaatgcgattgaagtggcgcagttgccacgttatatgtatgcgttagttgccgatgtgcaagattatttgcatctaaatgaagtgggtcaaactgtaagtccaatatattaagaaacactaatccgactcaaggcgagccggattttttcatatatatttgctatggtattagtggaggtttttatgacaaaaatattatttatccttatttttatcggcgacgtcctcgcaactccgctatttgatagtcaccccatttttttgattggcacggctgttttggcggcagctactttgtatgcactatacgatatgcaatctaatcgggtgaactacgcgatgacagcggtactgttgttgcttgcggtcagtttattcgtattacacggtgagtcggattatttaacggttctaaaccgagtaatgatggcccaagtagctgtttcggctattttggcagtcacgtatgctggcgttcggtcgcaaacagcgtagtggtataatcaatatcaggtggttgagcctattaaccaccatgacaaaacagggagtacgattatgaagtcattcatttttgacgtcgacggtacattgctaagtaccgaaagcatgtacatgaagtcattacaacaaacacttgaagaaaacggcattcacaaggcctacgaagaattgtatgcgattttcgggctaccatcactggatgcgttgattaaatttggcatcgaaaacccagaggagatgcaacgccaatggcaagaccactatcacgatttttgggatgaggtgcaattgtttgctggtgtaacggacatgttggctgatttaaaggcaactggtgtgcaattaggtattgtcacctcaaacacgcccgaagaattcgcagatcatgcggatgcgtttggcattaacggttacttcgatgactttgtatttgctggtcaaacaccaaaaatgaagccagctgcggacccaattttgaagtcaatggccgacttgaaggcgacacctgaaacgtcgatttacattggtgattccgtgcacgatatgcacgcggcacataatgccggcattaagttcggtatggctgcgtggggtgtgcgtgaccgcgctgtctttaatgacgaagcagagtttatttttgaaacgcctgctgacattttaaaactagttgattaatcaaatcctggtttcgtgatagacaatcatttgttagtcgtgaaaccaggattttctttcgtttaggtatcggtaaaggaagaatgtcccgctatcttcctttatccaattagtcggtgttataataaagacttaattaaatggaaagaagtgaagataatggataatcgcgctattggttacatcgattctggtatcggtgggttgacggtcgtcaagcaagccttgaagcaaattcctgatgaacaagtctactatgtgggggacacggcacgtatgccttatggtccacgtccacaagaagaagtccttggcttcacttggcaaatggttcgctacctattaaaaaaagacattaagatgttggtggtagcctgcaacacggcaacggcggcagccttaccggacctacaagcaaagctagacatcccagttgttggtgtgatccaacctggtgttgatgccgctttacgcaagtctgcagatggagaaattggtgtgattgccacagctggaacggttaagtccttggcttactataacggtttgttgcaaggaaaccgtgcagcgaacgtggtgcaattagcagcacccgagttcgttgacgtggctgaaaatcacgattacacgtcagaatttgctcgccaggtggttaaggaaaagttgtcatacttcaagaaccaccaagtggacaccctaatcttgggatgcacgcacttcccacttatggagaactttattcaagaagcaatgggacctcaggtgacattggttaactcaggtgccgaaacgatttcaacggttgttgagttcttggacaagttcgatttgcgtcgtgcgagtgcgaacccagctgatcacaatgatgatgagtactttacgacgggtagcgtgaagcgttttgccacgattggtggacgctggttggatgataaggaaatgacagttaagcacttggacattattgatgatacactagtgcttaacgaagatgttactgattaagtctaacgggggatacgcatggctaagttaatttttgcttcaaagaacgaaggcaaggtccgcgagtttcgtgagtttttgacgccgctgggggttgaagttgtctcgttgaacgagctggaaaatgtaccgacaatcatcgaggatggcaataccttccaagaaaatgccacaatcaaggcggaaaccatcgcgaaagcgtttaatgtgccagttgttgcggaagatgccggtttgacggtcgacgcgttagacggcgcacctggcgttcattcagcgcgttacgctggcgatcatgacgatgcggcaaacaatgccaagttgctgcgtgaattggcagatgtggcagatgctgatcgcacggcctcgttccatgctgtgattgtggcgattaagccagatggcaagcgattagtagcctctggtaaggtcgatggccgtattttgcgggcagcacaaggtagtgatggctttggctatgacccactctttttctacgaaccgtttggtaagtcatttggtgaactaacgccggcagaaaagaatgagatttcacatcgtggggctgctttgcaacaatttatgtcagactttaatgcctggtgggaggattaagaaatggattatttgattatttctgatgcacacggcgaccgtcaaattttggttgacgtggtggatcactaccgtggtaaggttaaggcgatgttttacaatggtgactctgaattatcacgttcagacgaattgtttaacgacttgatgccagttatcggcaacatggacactgatccaatgttcccagatgaccgtgattatgcagatgacaacttcacgttgtatcaaacacacggtcacttggtgcacaccgaggtgtcattaaaccaattacgtgaagttgcttcagcaaagggtgttgatgtcgtgacgtcaggtcacacgcacgtccttggggcagaagagattgatggtcgtttgtttatcaatcctggctcaattgcattgccaaagggtcaatatgcttacttgggtggtacgtatgcaatcttgacggtagaaccaacccaatttattgtacagttctacacgcgtgacatgcagcctgttgacgggctacgttttacgtttaagcgttaatagataaatattaaaaggcgttagcgagttgttcgctagcgccttttgtttttagccttcttcaatctccgtgacgtgaccattgtggaggtaaccgtcgtatgtgttaagttgttgactggctgatggtgtaattagcgaacgaagactttcatcagaaaaatcagttgttcgactggcatggttcgcaccgtttgtattgtagacaaccaaggttggaaactgagtaacgcccatttcagcggccatgttgtgatcagcacggtatgcttgaatcgttaagtcactgttacggtcctctaagaagagggttggatcagctgcaatatctgcaacgagtcccatgacgaattcgtcggtataaggttgaccactaaaaatagcggtttgggcggcttctaagaaacgacgggcaactttttttccttggaattgtagtgccttaacgtctaagatgaagcgatacatggtttgcgatagcacttgttcttgctcaggatgcccaagcgctacggcggtttcatggacggattgcatcgtcatcacagggacgacttgcaatgcgattttttctgttgctgttgttacgtatgacgccaatttcttctcggtctctaagctatcaccggaaagtgggttcacgaagtggtacacctctaacataatgagccacgacctccaaaactatttctctaaaatatctgtgataatattaaacgttttacaaggcgattgtctaatcgcaacgcctaaaaatgtgcaacattaccaattcttaaaccagctgcaatagttgtcatattatctatgaacattttgtgactgatttgtgttttttcaacatgactaagaataaatcaaaaccaaaatatttgcttggataatgtcttagaaatgccaaatcgtttggtataatagaaacagtgagaaaaaatcgggggattgacgacatgacacataatgaatgggacaaattgttacagccatacgttcaggccgttgacgaattaaaggttaagttgcgcggcatgcgaacggaatttgagttggccggcatcaagacacccgttgaattcgtaacggggcgtgtgaaggcaattccagccattgaagaaaagttggttcgccgtcatatcgacatggaacgcttggaacaagacatggaagacctagctggtgtccgtattatgacgcaattcacggaagacatttttaaaatcgtggacttgctccgtcaacgtaaagatatggttattttggaagaacgtgattatgtcagcaatgcgaagccatctggctaccgttcttaccacatcgtaattgagtatcccgtccaattaatcacgggagagaaaaagattttggcagaaatccaagtccgcacaatgcaaatgaacgtatgggcgacgattgaacacgcaattaattataagtatgatggtgactatacaccggagatgacggagaagcttcgtgaagtggctgaattaagcattcgcgtcgacgagttattctctgaattacataatggtttggataaaccaaaagattaattgtcagccataaggaaagaagacgaaatgaaactcgcaatttacagtaataatggcgcacagtcaaaggctgttgtggctttatttaaagaaaaattggctgcacgcaataccgataagattgtctttgatgacgagcatccagatgttgtgatttcagtgggcggagatggtaccttgcttggggctttccatcactatgccgatcaattggcttttgtgcgctttattggcgtgcatactggtcacttgggcttttatgcggactggcaacattttgaaattgacgaattgattgatagtttggtcaatgatgaagacgcccgaacagttaagtatcccttgttggaagcacacgtccgttacactgacggccgtgaagaacgcgtccttgcattgaacgaagccgccattaagcgtccattgggtactttggtggcagatgtgtacattcaaggtgagttgtttgaacgattccgtggggatggtttgacagcatcaacgccaactggctcaaccgcctataataaggcaatcggcggggcagtgatgcatccaagcttggatgctatccaattagcagaaattgcttcgattaacagtcgggtattccgaacacttggttcaccattgattattgggaaccacgaagttattcgggtgcaactagaaaacgacggcgcagcggtaacccttagtttcgatcatttgagcaaaattgcctcaaatattgattggattgagttccgcgtgtcaaaaacaaaaattcagtttgctgagtatcgacacatgcacttctggcaccgtgttcagtcaagctttattggtacggaggtaaagtaatggcccaattcagttggatcaaccaaggcgacgaaacgcttaaaattaagacgttcttagcccaacgtggtgtctcacaccgcatgttttccattgtgaagcgtggtggtggggcagtgctccttgcgggtaagcaagttcggaccgtcgatgaggttaagccaggtgataaggtcacgattgtgatgccacctgaagaatcaaatgacgtcgttgcgatgtcagatttgccaatcgcggtcttatatgaagatgaaaactggttggttgttgaaaaagaagctggcgtgacgtcagtgccgggtaaagctgaccgtgaaacgaccatggttaaccgggttaagggttacttagcccggtctggggctgaggatttagtgccccacgtggtaacgcgactagatcgctttacgtcgggggttgctttgttggccaagcaccgttttgcccatggcttgctcgacaagcagttgcaaacgcactcagttgataagcgttactatgcaattgtcgatggcgatttgccagatgattacggctttatcgacgcaccaattggtcggatggacgacgactttattcgacgcgaagtgcgagaagatggtcgtccttcacaaaccgagtactgggttgtgaagcgttttggcaaccaaacgttggtccgcgtgcagttgcacactggccgcacacaccagattcgcgtacactttaagtatttgggtcacccattgattggggatgaaatctatggtggcccaatggatcgtggcattacacgccaagcgctacatgcttattggttacgcttctatgatccatttgcacaagttgaacgcacgacgcaaagtgcattgccacaagatatcgtggctgttttggacggctatcaagtcgaaccagacgaaaattaattattaagaatgcggggaaagaatcatgaacgacatgctggacgaaattacagatgagatgcgtgatgaactttccgaacaagctcatcacttggtcaattatttggaacatggtgagaaagaggcgttcttggacggctttgacgaacttcacggttacgacaaggccgttttttatgtgactttgccatcacagctccgtcaccaaattatcgagtggttaacgccaactgaattggcggaagtctttgacgaaattgaacccgaagacgttgatattaacgacttgctggaggaaatgtcaccacgctatgctgcccaaatgctgaaccaaatgtataccgataattcggttgacttgtttgaagacatggaccagcgtgaattggggatgtatttggcgttgatgccgaaggaagatgcagctcagattcgtcggttgttgaattacgaagacgacacagctggatctttgatggggactgagtttgtcgcgattaatcaaaagctgacaatcggtcaggcgatgacagcggtgaagaaggcagctcaggaagccgaacaaattacttacatttatgtcgttgacgatgatgaaaagcttgtcggcgttatctcattgcgttctttgattgtttggccggacgaagccaaggttgcggacgtgatggatacaaacttgattacagtgacaccgagtgatgaccaagaggacgttgcccggttgatggccgactataatttcgtgtcgattccagttgtggtgaaagaccaccttgttggtaccattacagtcgatgatatcgtggacgttattgatgaagaggccgcggaagactactctcgtttggccggtgtggacgttgttacgttggaagagaatccatttaaatccgctgctaagcgtttaccttggctagtcggtttgattttcttgggaatgggaacggcttcagtaatcaataactttgaaggtttagtgagccaagcgtcgattttggcagtgttcatctctttgattacgggaaccgccggtaatgccgggacgcagtcattggccgtgtcagtccgtcgtttagcgttgaaagaaacaagttcgctcattaagatgttgatgactgaggttttgattggtgccatgattggtgcaacggccggtttgaccatctttttggttgtgtgggtttggaaagccaatatgctcttaggtgttgcggtcggtcttgcgatgggtgtggccattctggtagcgaatgttgcaggatcattcattccactagtaatggataaaatcggggttgatccagcagttgcgtcgggtccattcatttcaacgttatctgatttgacatccgttattatttatttcaacatcgctggcttatttattagtcactttgtgagtgcgtaaagtaggacgtacgcttatactaaaaacatgatttaagtaaacggctcaaattgggtcgttttttgattgggagattgtgggttatgaagaagaaaattggcatctttcagctctttttattgggtgtcttaagtgccttttcaccactggcaatggatttatatttgccagggttaccagagttacaacaggatttacacacgtcaacgtcattagcgcagttgacgattacagcatccttgctgggtttggcactcggacaagtgatcattggaccactgtctgaccgaattggccggcggacaccgttgctgtggggcacggtcttattcggcctgagttcggcaaccattgtcttcgcaccgaacatttgggtgttgattattttacggttgattcaaggcttggccggttcaacggggattgttttgtcattggcggtaattacggatttatttactggtaagactttgacgaagcaaattgcgattaatcaaacgattaatggcgtctttccagtcttggcgcccgtgtttggtggggtgattattgccattgcggactggcagatgacattctgggttttggcagtcttggggctgattttgtttgtgagcgtcttgcttgccctgccagaaaccttgccggccgaaaaggcacaggtagctgaccgtccatcagtggtgggtggtttcgcacaattatttaagcaacgtgaatttgtgctatatgcgcttacacaggcctttatgacggcagcattgtttgcatacatttctggttcatcattcgtcttgcaaaagattttcggcatgtcagtgacgactttcgggattgtgtatgcgattaatggagctggtattgcactcatgtcgggtctggctggtcgctgggcggtgaagtttggtgaataccgcgcactccgctggtttatccgagctggctttttaggtgggattctcttgcttgtgacggcattcttgcctaagtcactttggctgattttgccaccattattcttagttgtggcaacggtcgggggcattatttcattgacgacggcgttggggatgcaagggcaacaacaaaacgcaggttcagcttcagcgttgctgggactagcgcgttatgcgttgggtggactgatgtcaccaattgtcgggcttttcggccaacacacatacatgccgatggcaatattgattgttggggtgcaattggttggctttatcatctttagccaagttaaaaaacaatagaaaaatgggtatcgacaacgcggtcgatacccatttttttagtttgaactaggttgtggcatgaatggcttgatcatattggcaaaattctcaagattcaatgactgaacgagaacttttccagtgccgttaaacgtgttgaccacaccttcgccagtgccgattgatccaatcaaaccgccaccctcaaggtgaatgtcataagttagtgacgtttcccaagcgacaacgtgcgcattatcgatggtgaagtcgtgggcgtcttgcaggtcgatttccttaattgatccgaacgctgcaacgagtaaagttccttcaccagacgtcttcataacgaacaaaccaccttgaccacccaaaatagcgcgtccaactgattgccgttccatgctgtactgcacggtaccgtccatggctaagaaagctgagtcattcaagtagtagttgcgaccaggcgtaacttccaaggcttgaatcgtaccaggcacggcgggggccaaagctagatcaccacccttagcaccggctgagacttcggtaatgaagactgattcgccactgaccatggcacgtccggcggcacgtaatagcttaccaatacctgaaccgccatttgcgtttagacgaccctttagttgggtgtcgccagtgtgataaaccatcgcaccactttgaatgcgaactgtttcgttgggtaacaagttgtatgtcaccagtggaaattgcatatttgcctcaatattgtaatccattgtgataacccctcaatattatttgatacttatagtctacctgaaatgcgggtttaatgcaggcgtcagctgtcaaaaatatttgataaaaaaatgacactttttacgtgcattgtttttggtagttggttattatgtgtacataaagtaaatgacataaaaatttttaaacataaaaagagggcagaagtaatgcaaactcaccacatttcactattgactggcgatgctaagttgaacgctgattactacgttggcgttttgggcatgcgtttcatcaagaactcagttaaccaagctaacccacgtaaccgtcacgtttactatggtgacttcatgggaacaccaggaacggttatcacgttcttcccaatcgacgatttgcgcgaccgtactgacggtaagatgttcttctcaggtattcactactcaattcctgagggatcaacgcaatactggttggaccgttttgccgaaaagggcttgaaggctgaagttgacgctatgggacgtatccgtacggctgactttgaagacttgccaatccgtatgcaagaaactgagggtaagaactttgactggcacatcaactacatgtcagatgttccggctgagttccaaatcactggcgtaatcggtgctgaattgcacgtaccagatgttgctgcaacgggtcgtttcttcgaagagttgttggaaatcccagttaagggtaacatcattgatttggatggtgttgaagcaatcgaattggtacaaactgttgaagatgcacctaactcacgctttggtaagggttcaactgaccactacgctttgggtgttgagtcagaagaagatttgaagtactactgggagcgtgcaaaggccttgggcttcaagcgtgaagtcttcatcgaccgtggttacttccgttcagcttacttcatcgagcctggtggaaaccgtatcgaattggcaacgactaacccaggatttacgttggatgagtcattgttcgacttgggtacgacgttcgctttgccaccacgtttcgaagcttcacgtcaagaattgcttgaccactacgctaagaagggtgtcttctttgacgaagtaaagccatacacaggtactggtcacttggagaacggtggtaagattcgcgccatccacgatgagaacggaaacacgcgtaacgactaataccacccttgatatgactaggatgacagcgtttctggtcacaattggtcaccaaaacttttaagccgaaggatatcgacgttttgtcggtatcttttttgtatatgtatgaataaaaattttaaattggtttctggtaaaactcgttctgacgacaataataaaattgctaattattgggcaagattttttgaatagtaaaaatccactcgggataacatagattatgtaaaccagaaagcggttcttgttgaccagccaaagttatcctggcataatataatcaatcaatagaacacgaggtaaggtccattgcgcaattaagctgatttcaagttgatagatactatcggtgagattggttttagtgtggacttttgcgtgtgctaacaaacatgctttttgaagtgccttcaatctcatcgtcatcgagattggaggcttttatgttacaaggacaaattcaaaatcttactaagcagattaatggcgatacgctattcgaaattgatcatatcacgattccccagacaggcattgttgccatcgttggtgagaacggtgcaggcaagacaacgctgctaaacatcctacgaggagtggacacagattattccggcaccgtcacgttaccaggttttatggcttttgtgccacaaattaatacggtagatggggagtctggtggtgaaatgacgagacgattgattagtgaagcattagtcagtcggccagatgttttaattctagacgagccaacatcacatttggataccgcacatcaagcgtggttaattaagtcacttcgccattttaaggggttggttattttggtctcgcacaaccggacattcctgcgtgaagttgcaacggcggtttggtcttttgaaaatggaacggtcaccgctttcaatggcaactatgagggatatttagctgaggtggctgctaagcgcgccgctcaaatgcaagcctacaaagcgtacgtttcggagaaaagtcgcttatcgcagcgcgctagagaggctggcgaacggtctgcccgcaccaaaaaaatcaatccacacaaacatagtcacgctgaagtagaatcaatcaaaagtaattcaaatggcattgaaaaaggttttgcgcaacaacgcaaagcttttaacagtcgtctaaaccggttaaacaaagttgagaagccgctatcagagacaaaattgacgttacaaaatccagtgatggtgcgcccaggcaagccggttatcaccgcattggatgtaacggtgtcacaaggtgaacgggaattaatccagcatgtgacactcaagattgagaccggtcatcgattggcgattatgggcaaaaatggatcaggtaaaacgacgctaattaatcgtttgttgcagggcgacctggggattacacatgctgataatttgcggattagttatgctaatcaggacttacgacaattagatgccagcaaaacggccttggcaaatatcatgcagacgactgatgaatcagaacagattgctcgtaactttttaggggcaatggggattcggttagaacaggttaatgaattggttggcgatatgagtggcggtgaacgtgttcgtgtcgcgctggtcaaagctttactacaagctagtgatttattaattcttgatgaaccaacgaattatttagatattccggcgttagaggccttgactgcgtatctgcagacgacgaaacaagccgtcgttttcgtctcccatgatgcccaattcgtgagagatgttgcaactgaggtctttgagattagcgaaggaagtctgttcaagcacacaaactaattttttacactgacagaatttaataaataatgatcaaaaagtcacgttttaacaacgcgactttttctttttataaattgagtttgcatattttatttaacattgttaaaattaaataaacaatgttaaaggagcgcagtgatggaatggtttttagagttgagtactgaagatcaggaatttgtaaaacaattggtactttcttctggttcacttaagcaattagcaaagatatatgatgtgagttacccaactgttagaacaaggttgaatatggtcattcagaccattaatttaattgatagtaaacaagctaatagttttgaaggtcgtattatgaagatggtgattgcggaaaaaatatcgttggatgttgcaaaagaaattatttcagactatcgggaggcaaataaatgagtgattttaaaggactaatgatggggatgttaatagtggcagttatttatctggcggatcgctatttgccaaaatggtttggggctgtaccaagtgtattatttgccgtgcttgttggttatttggtgattttctatcatacgtcattcttcagtgcattaacaccgctgctagttggtgaagcaattttaaatggtatatggctaagtagcttggatgaccgtaagaagaaagttcaacaggaactggaacgaatgaaggccaaagatttatcgtaataatattcaaaatagtgttgtgacggaagcgttaaattaaaaaacactgattcataaaattgaaccagtgtcatagagattatttacgaatgaaagttgcatcagcgtctggtatgccatcctcatcagataagtatcgttcaacacgcatatgtaaatcatatttttctcgtagacgtgcaatttcagccatcattggagaggcatggtgcacgtcaatggcggcctgattttgccaggcgtcaatcaaaaggatcgtttcagaatcattaagcggttgaaaatactcgtaacgttcattaccaggcatggcgcggatttgggctacgacacccgtttcaagcatctcttttgcaaaagcctgcgctgcaccgttggtaccggtgtaatataaattaacggtgactgtcatattgaatctccagtttctgtagtaaaaaaattaaattcattattgcaagatagttgaaaaaaggcaatttgcagctgttgattggtcaaattttgagaggtaataaggcaaaaaacgttaaaatttagcctggcagctggcaataaagtatcagtggtcactgttccttcgtatttatatgattatatgaatatattgatgaaatatatcatataagagggaatagcatgaaaacgattttgttactattgattggttttgcgggtgcatttgtagcggtgacgcatactgatgacgtattagcccccgataagccgactatccagaatatcttaccggtgaaccggactgagcgggcgttggtgttggatgcacgaaaacatggcttggattacgcactaagtatcgtggagaatcggactgggcgggttacagatgataaatattggctgcttaaagatcctcatggtggtggttattggggtgattataatagcgatccaacccatgacggggttaagcggtacaaaaccgtcgctggcaaagaagtgttggaagtaatcaaaatttacgaggcgccggatgcgacaacgctagagaaagcaaaacgagtattggcgttatactgtcagtaggctgtctggtttcgtacataaacgtgattttgtggtgaccataaaaatatagaggtgccgtccaagttgtctgtgctattatggtgaaacatgattaaaggagcgactcagatgtacaccagagaacagttgatcgcgctggtacaagaccatgcggcgactcatgaaacgtatccatttaacaaaaccaattcacatgagacgattatttggacagttatgaagcataacgcaagtaacaaaattacggcaatgatttttgaacgtgaggcggtgttgtatttgacgttgaaactaacgcctgaccacgttgacgagatgattaaaacgcgcgggattacccgtgcttatcatatgaataagcggcattggattacgatttcggttaacgctactgatgcgacaaaacaagaaatgttagggatgttggccgaaagcgaacgcctaacaaaacagtaggaggccaatgatgttaaaaaatatgaacacgtggtcgaaaaatttactgtatataatggtaattttcgcagttccaaaacttgtaattcgccacaattttgccgagttgttgttctacttagcaattgccttagtggccgtgattatgtcgttagcacctaattggggaggagcagtcattagtgctgttttgtttggtgtgctaaccgaggtgtttgactgggtttcgtatgctaactggtattggccttcattcttgacgtatctggtaatcggcggcgttcttgcgacggtgcttgcgtggcgtcagcgtcgggaaatcaataacattaaaattaaataataaaattattgacaattgatgagtatggttttaatatataaaagtcgactaggacgagatgaagtaaaaagtgaaacaggcgtagagagctaacgtgaggtgggagttagtgctgggaagcttatgaaaatggtctctgagtcagttgtaatcgtgagcgacagttagcgattgccgggtgcgcccgttatcgcgcaaacgtatatccggcggttgttgactagtccaactataaggcgtacgtgtgagcttgtttaggtgactaagcagggaaactaggtggtaacgcgattaatcgtcctgggaattcgaatcgaattctcaggacgtttttgtttattcggccaaatagacacgcgcttgatgagtaaaataggaatcgagtggaattatgaagaagattattaagacgtcggtattattatcaacagcggttattttggggagcggactaaccattgtagcccatgctgcaaccgataagacaattaattggaccgaatcagcggatttaagtacgctggatccatcaacggtacaagaattggtgagcgatgatgccattactgcatccggggatggtttgtatcgcaatgacgcgtcgggaaagcctcaactatcattggcacaatcagttgataagtcagctgatggattgacctataccttcaagctacgaaatgggattaagtgggcaaatggcgattcaatcaccgcacaagattttgtgtatggttggcaacgaacagtcaacccaaagactaagtctgtgtatgcatacttgtattcagggattaagaatgctgacgccattaataagggtcaagacaagaatttgaatgacctaggtgtcaaagcacttgatgatcaaacattgcaagtaacgttggaaaagccattgccacaattaacggctgaattaacaatgccagagtttttcccacagaatcaaaaatttgaagaaaaggtgggaaagaaatacgccacgacctcgactgatgcaatttctgcagggccttttattgtgaaggggtggaacggttctagtaacagttatgagttggtcaaaaatccaaattattgggatgcaaagagtgtgaaaacaccgaagattacagttcaaactgtgaaggatcaaaatacaggttataacttgtacaagcaaggcaaggtcgacttcacgacgctatcatctgatcaggtgcgtgcgtcacaaaagcggtcagattataaagttattccgactgcagcaacccgctatttggagttgaatgagcgccgagtaccagctttcaaaaatgctaaggtgcgtcaagcgatttcatatgcgattaaccgtgatcaattagcgaaccacgtgttgcggggcacggcaacaccggccacaacttttactgcgacgagactcgcaaaagttccaggtacaaccgaagattttgccaaagatgcccaagtaaagggggcaatcgcgtacaatgaagcaaaggcaaagtcgttattcaaggctgggttgcaagaaactggtacgtcaaagctgaacttacaggtgttgactgatgattcagatgcatcgaagaacacggctgaattcttacaatcgcaattgcaaaaattaccaggattgaagattagtgtcaaagaggtgccagctaagcaacgcattgcgctgacaactgggtcgcgtaagtttgatattgctatctctaattggatggccgattacgctgacccatcaactttcttggatttgtatacgtcagattcgtcgtttaatgacggtggttggtctagtgcaacattcgatgctgcagagaaggcggccaagacaaccgacgtaaatgatgattcgaagcgttttgcagactacaagacagctgagcaaacgattgaaaaggacgctggtgtggtaccgctttattatgcctcatcagcgacgttgttccgtacatcggttaagggcgtggtggccaacacaacaggcgcacaatacgactggaagtgggcttacaagcattaataaccagaaagggctaccaattcattttggtagcccttttgcgtagcgctatttaattgggagttcattctccaaataatggataaattcatcgtgcagtggggttaagaagggagtatgcttccaaatcattgtgcctgttgaaatgctttcaggtgtaaatggtttgaagagtaactcaggggcattgatcaccccagcgataccaaccaagaggagctggtcgtcaactaatggatacatgcgggcattaccaatcagattatacttcatgcgaatattcagctgcgatgctttcaagccgagttcttctactaaggaatcgttaaacgaggactgcattgaaatcgccacggggtattgggtgagttgttcagctgtgattgctggctcactggccaggggatgatgccggttgataaagaccccacgaacatccgcatctggaaagtcgaggtagtcataagaagctttttgcgtgaaatcaagagcaaataggaagtcgagttcgccttgattaaggcgagccagtaagtcggttgttgatccagatattaaagtaattgtgacgttagggtagtcacgttgcaatttagaaatcgcctggataacgtgatcgaacatcactgtttcagcagcaccaatcgtgataacgccggcaatcgcttccttggattgtaaattggtaacggttttgtcagcaattgcaatcatgtcttcagcttgtttgaccaggtagatgccttcaggggttagcgtgacaggcttatgttcacggttaatcagttgcacaccgagttcagtttcaagtagttttaactgacgtgataaagcaggttgtgtcacgtttaactgagccgcagcggcggttagtgtgccagtgcgtgcaacagctaggaaatatcttaaaacgcgcaattccatattattacctctcgttatagtttgttataaaaacaaagcattagtaataacaagtataacgcactacacttgagatacaagggaggtggctaagatgacactaacgccagaacaagttaacgactttagtcgggcagatgattttcatattgcgccttatcgagctgatggtcgcacgccggggacaccaacatggatttggtcggttgttgtcgacggtgagttatatgttcgcgcctggaatgggttgcaatcacgttggtatggatcagcaaagagccaaggggcgggtgaaatcaccatcgctggtcagacgtatcgcgtcgcctttgaactcatttcgggggctggccatgagcaacttcaggcggcaattgatactgcctatcagacaaagtatgcggacagcgcctatatgccaccaatgttgggtgccggaccacgtgaggcgacggtccgtgtgattttgaaagaacgaggagcatgaacatgacaatttttgatgaaacctacaaattaaataatggtgttgaaatcccaaagattgggttcggcacgtggatgattaccgataatgatgacgcagcccaagctgttaaaacggcgattcaagtgggctaccggcatattgatacggctgaagcctatgaaaatgaagttggtgtcggtcgtggcgtccgtgacagtggcgtgcgacgggaagatattttcgtgacaaccaaactagccggtgaaatcaaggactatgatgatgcggtggctgccattgaccaatcattggctgatttagggttgaactatattgatatgatgattattcattcaccaaagccttgggttgatttccaaaaagaggaccgtttctttgccggtaatctggctgcttggcgtgcattggaagaggccgttgatgctggtaagattcgaacaatcggtgtctcaaactttgatgaagttgacttgcagaacattcttgataacggacgcattaagcctgctgtagatcaagttttggcgcacatcggcaatgtgccatttggtctctttgattatgccaagcaacacgatattcaaattgaagcctattcgccatttgggcacggtgaaatgctgaagaatccgaacttgcaacaaattgctgataagtatggtgtatcggtaccacaattggggattcgctacttgttgcaattggattccttgcctttgccaaagacgctgtctgaagaccacatgcgtcataacgcaacagtcgactttaccattagtgatgatgatatggcgctgttaaagcaggttacgttgaatgattatggtgaatttagtggcttcccagttttcgggggcacgttagattaagaacggagatgagtgatatggcagagaaggtaactgcaggtcatgacgcgttgggcgcgtttgcacctaagtttgcagaattaaatgacgaggtcctgtttggccaggtttggtcacgcgagacggaactttcagctcgtgatcggtcgtttgcaacgattaccgcactgattgcgacaggggcgtttgaacaattgcccttccacatgcagaaagctaaagagaatggtctgactgctgatgaagtagctgaaattattactcacttggcattctacgttggctggcccaaagcctggtcagcatttaatatcgcaaaagaagtttacgaggtagcataatggcaaagtttccagaaattaaaacggggacaatcttttcagcgggtgttctaaatccctatggcgaattttttgtcggggacacgtatttgaccaatttggtgacgtcgccggatgaaaagattgggattggttcagtgtcgtttgaaccaggatcacgaaacaattggcacattcaccatgatggctatcaaattttattggtgaccgccggtgaagggtggtatcaagaagaagggcaacctgctcagtcattgacaaagggtgatactatcgtgacacgtgacggtgtgaagcattggcacggtgccaagaaagatagttggtttgagcacattgcaattacggctggaacgccagaatggcttgagccagtttcagatgcggactatgacgcactagtttaataaacactataaaagcggtaatcaatttgacgattaccgctttttgttgcaaatgcaacaaaaaggttatagactatacgtgaggacggaaatatgacagctaacttaagagaaattggcatgattgcgcgtgccctagattcgataagcaatgtggaatttaaagaatttaatttaaccaaaggacaatatttgtacttagtacgaattgttgaacagcctgatattatccaagaggcgttgtcagatttgattatggtcgaccgcacaaccgtgtcgcgggctgttaagaaattaattgccgatgggttagttgagaaacgggataatcccgctaatttgaaaattaaacatcttcgggcaacagacaagggacgcgccatttaccaggtgattaaacgggaaaatgattactcggaagccgtggcgttacaaggattttccaatgcagaggtgcaacaattgaacgccatgttgatacggatgcgtgaaaatgtcgcagccgattggaacgctgttaaaaaagggcaacaccgtaactattaaagatgaggagattaaggatgagtatgacattacgtcgattgacaaccaaagatttggacacactacgggatatttcaattgaaacattttcagatacttttggtgcgcaaaatacggccgaaaacatgcgtgattacctggcagcggcgtatacaccagagaaactaacagctgaattagccaacccggcatcaatgttttattttgtcttagtggacgaaaaaattgcaggatatctcaagctaaatgtggatgacgcgcagtcagaaaaaatgggcgaggatgcgcttgaagttgagcgcatttatgtacgccgaagtttccaacggcaaggtctcggccgtgtgtttatcggtgaagccgagcgactagctaagtcactagataagcaccaaatttggcttggggtctgggaacacaacccaaatgccatcgcattctatgagaagatgggcttcacgttaacgggtgaggcgcatgatttctatatggggactgaccaacaaacggatgtgttaatgatgaaaaatttggcatcgaaatagcacaaggactacttacgttgtataatgtcttttattatgaataaaattttaaaagaacaatttttcgttgataatctttcagcggaacaagaagctgttatttctaatatgaatgcctacattggtgatggtttgaagcaaaatgatcaccgtgtcgcaattattcaaggtgctgccggtactggtaagtcagttgttttaatgaacttagttaccaagtatatgacggacaagcggtacaagacggcgttggttgtgaaccacccagagttgtttaaagcctacaaggacttggccgttgatattccaggcatgcgcgataaggatattacacgtccgacaccgttgattaacaatgcgcaaaagcgtaactggcagtacgatgtcattttcgttgatgaggcccacttattgctatcaaagcctgaaccttacatgcactacaatggtgaaaaccaattggtagatttgatgtcattggctaaggtcgttgtcgttgtttatgattttgcgcaagtgttccaatcaaagatgtactgggacaaggacttgttgtttaagacgattggtaacaacccatatcaccaatttgatatggacttccaatatcgaatggtggcgagccaggaacaagttgactggttggatgatttgacggctgaaaagcctttgaagccatttccatataattctgagtttgaatttaaggtctttgataaggccggcgatttgtacgaagcaatcaaggaaaagaacaaggagttcggtcaaagtcgcgtagtcgccacgtctggattcccacgaattgatggtcgtcacaacgtcgagatggacacctttaacttgccttgggatgaatgggatccacagcgtacccactgggctaagcgtgaagggtcaattactcaggtcggaacgatttacacgttgcaaggatttgatttgaattatgtggggatgattattggtccttcatttggttatgatccaaagactgatagcgtgaaaattattccagaaaaatattctcacaaggaaattttcaagaagcgacaagatcgtaagtttacggaagatgaattcaaggcgtttattgcaaacgtgttgaacgtcttaatcaagcgcggtaagtacggtttgtacttgacagcatacgatgacgcattgcgcgcgcgcttgttggaacttcaaaaataagtaatgaaacatgacgtttggtattaatgcccaagcgtcattttttatagaaaatggtggatgatccatgagtcaggtaaagtatttaacagctgctgaggtgttgcatctaaatgaaacggcaattgcaaccctcggtggtggtaatgcaggtgtgcagtcaccacgagcgtttgatgttgtgattacgcaaccacagcaaattgtattcggacaggaaatgtacccgacaatttggctgaaagcggcctacatgatgcaacaaattgtcaaaacaccagtatttgtggatggtagcaagcgaacggccatgctggttgtgcaaacctttctgactgccaatggctatgaccccacgccagatttttttgaagatgtacgggcgtttacgattgaagtgacacaaacagcgaatactgaagcagtcatggcgacgattgccgactggttggccagtgtatttaccgaaagacaatcaaagtccataaaatgacaggtatcatttgaactctacttttcaatatgccataattggcatataccataagtgacatattggaaacggaggggatgaagatggcacacacgcatcatcatgaaattgaacagaataatcagacaccgtatttaatcggcattggactaaatttggcttttatcattggggaaatgattttcgcaaaattggctggttcgacagccttatttgcggatgcactgcacagtgttagtgatgtcgcgtcgttaattttgtcttggctagcagtattagtttttgggttgaaagcaacacgtcgacggacatacggctttcataacacgaccattcttgctagcgcgatcaacgctattttgctattaattgccgttggaattatttggtttgaagctattgataaattgataaatggcaaggcgcatgttgacggtgatatcgtgatttgggtggcgttagttgggattttagttaatttcttggcagcgcacttctttgccaaaagtggtcagcaagaacatgatttgaacgcacgtggcgcttatattcacttgttggccgatgccggcgtttcggtcggcgtcgtgatttcaggtgtattgattgccctgactggttggaactggattgacccgttggtgtcagccttaattgggattgtgattgtggtcagttcatgggatgtatttaagcagtcgctgaatttgctactcaatggggtcccagcggggattgatgaggcgggtatcgcggactacttggcaaaccatgcggccgtaaagtcagtccatgatcttcatatttgggggatttcgacgactgaggcggcgttaacagcgcacttagccgttacaccgacatttaacgatgctgaccttgatgatattacggaaacgctgaaacatgagtttggcattgcccacacaacgattcaggcagaaacgcacttagaagttaactgcaacacaatttaaaggttgggtgataagatggcacaggaacaagcgctattacaggcggttgccggcttttacaaagttttaggtaatgagagccgattagcaattttgcattatatggtgatgcacccggggcctgtttatgtgagtgaattggttgcgcaaactggaattgcgcaaccaacggtatcgaaacatttggcaattttgtatcaaaatcacgtggtgacgcgcgaaacgtcaggtaatcgggtctattatgaaatttatgatcagcacctgaaacaaaccctggaagcgacgtttactcacttagagcatatggacatttcaaattagatggatatggcgaccaactttgtttggttgccatattttttgctgtcatgccagtggcattttgctatacttaggccaagaaagtttgaaagaaaatggtgaacaaatggttgaacaaagcggattttcagattttgaaaaacaggcgatgaaagaacgagcagctgaattacgacgagaacaggcaaataagcgtagtaagaagaatccagaggccgatttgctggagaaaattgctgaaatgccggatgatgaggcgtttatcgcggcgaaattgcatgacttagtgcgagaaattgcgccagagttgcaacccaagacatggtacagtatgccagcgtatgcaaatgcggatggtaaagtggtactctttttccagccagctacgaaatttcaaagccggtataacacaattgggtttaatgatgctgcccaattggatgatggggcgatgtggccaacgtcgtttgcagtaacggcgtggcaggaagatgtagctaatcaagtcagtacattaattaaacgcgcaatgaaaaaataaataaaacgtgaaagcagctgcctttaggtggttgctttttttaaaacggtataggtcataaataattttacataacgccacaaaaacacaatcgactaatatttcaatgaaatggtatatttttggtcaattgttcttactgaaaataaatggtaacgtatttgtaatgtttggtttttggaggatttatttatgagtagaaatacggatattattcgggatagtcgtggttttttagcgattaagcaggtgttgctggttgccctaattgcggttgttggggatcttttctttactttggttggggacgttttaaattttaaatttggtgaggagcgcggtatcggtttactgtttgcgttgattgccagtgtatttagttttgtgatgctgggcatgctctatcaggtggtggtctttaaccgggccgatagaaagatttttgattattttaaggatgcacgtttttcgtggttattgattaaaattagtcttttggaaacgattttcatgtttttatggggcatattgtttgtgattcctggtattgtgaagtcatacgcctatatgcaggcaattcctaaagccgtcgatgattttgagaatgggcgtccgttacaaggtgcggtggcgtacgtcggttggtctgatgatcaaatgaaggggtataagggacaacttttcatgctaactttgccatggtacatgatcatgtttgctttagtcattgggatttacctggtgtatgtttttgtggcgcatcaatcaattggtgttttctttacaaacaacaccgtcatctcgacgtatgggtcaacgttaataacgatcgtaccttcattgattgcgatgccaacgatttttgttcgtcagactgtcttttcgcgtgactttattcgtgaacaagatgcaccagtaaagtaggttttgttatgactaaaaatgaaaaaagagcgctgattacggtactctgtttgttactaggttactttgttttagagcatggtatgatgctgtttcatgtgcccaattttattgatgcgattgcgacgattgcttatgccatcttgacgttgttcgtggtcgtacgtattatgggccaattgttgcaacatgatatcggtctaaaatttacgaagtttgccagttgggtgccgttggtttgctatgtgattatagttgcactaaggttaatttttggtgcagttaacatcgtgcattatcactttgaacaagcagcgtcgctgacattgcgagcacttgaagctggtattcttgaagaaacaattttacgagccggcattttctatattctgctacgtgtcttacaaaagcgtcggaatgcaccgttccaggcagcaatttattcatctgtcttttttggtttattacatttaacaaatatggcctctggtcaagatttaacgtccacactgtcacaagtattgttcgcaacgtgggttggtctaatctttacggcaatttatgcacggacgggttcaattttgtacgggattatcttgcactttgcgatcgacttcaatagcatggcccagatggggacgacggtgatgtcagttccagttgaagcggtggccgcacaaggggttgttttagtgattgtactgatcatcatgatatttggtgtttttccaaaccgcaaagcggcgcgtaatagtaagttattaggtcaataatttttaacaaacccgcatccgaaggtgtgggtttttgctttcctaaaaaaattccgataaaaaatcctttacaaacgggaagtgaattgatattattaattatgttgttgaggcaacgaattaaatattttgggcttatatgctaattggataaacaccccggctacgaaccgggtattgcaggttcgagtcctgctaggcccatacaagaaagcaccgagagataattctcccggtgcttttattttgcattcgcgactagttttaggattatcgttttttgagttcgttgtgaacgcgagccgctaatccaagatagaataaatcttgttctcattcattaaaaaagatggcttaactaaacagggattaccttgaaaaattcaatcccagcttgtagaggttagtgttgtgtttttttaagcaaacgtaatagttctgcttgctcatcttcagataattttgccaataaatactttgattgcgttttttcaaactcgaatagttctgggtaaatatctttcgcaagttgcgttggaaatactcgctgcaggcgtccgtcgtgatcgtctgattttaaatcgagatacccgttctttgctagtttttttatgctgcggaatgcagttgaacggtcgatgctcagtgcgtcagcgagttcgccgagaaacatacctggattttcaatagctcgaataatatacaaaaatgcgttatttcctagtccaagtggtgagaacttcttattgctttgaacttgaattgatctagtgatagtaccaataagtctgattgtattaaacatgccgtccctcctttacattagtttatgataaacaagttgcatttgcaattatcttctgataacatgttaggaaacttattgcatttgcaattagattagaggagctattatgatttcatttttgatatttgtttttgtgatgtcgtttaccccggggcctaatacaattatggcgatggtttcaggtcagaatcatggcattaaaaaaagcgtgcccttaaacttgggtatgctaggtggcttggttgttattggggcacttgcatccatttttgcgagctggatacagtctaatgagacgtttgtattagtgatgaaggtcgttggcagtttgtatttggcatatttgacgtatcacgtacttattagcgtgcctggtagtgaagatgaagaagcaggtggttttatgaccggctttttgattcaaatgacaaacgttaaagtgtatttgtatttcattacaggtttgggtgcgttcacattggccgggatttggggtcacatttcagttcgactggtgttaatggtcttgattggaagtcttggaacatttacgtggacgattttgggacaagcgattaatggtgtgtataaaaagcattatagggtgttcaatgtggcaatctcgttgttgcttgtactttcaattgttgatttatggagataataaattactgaacttgcaagcaatgtgagtccagcaggcggggatgctcagtttagtgtgaatgaaatcaaattatgtacggaatatgacattaaaaattgacattgtacagcgtaaattttgacatcaccatgtaaatgccttgcttttactttcatttttggggtagtcttttcttttaattgtttaaacgttaccttgttaggggggagaggctatgtttttgttaaaaggactgttattagggtttgcattagtagcgccaattggaatgcaaaatatttatgtgtttaacaatgcgtttaatcactcgatgaaaagatcgatgttatattctttattcgtgtggatctctaatactgccttggcattggtgggatattttggttttggcgtcattttaaatgccaatgagattatcaaacaagttgtgatgtttgttggtggagtattagttgtttggcttgcgtggaatatattgaagtcagcgagaagtgtagacttaaatgaacaaatcaatcaaataccggttaaaaaagcaatattgacagccattgtagtcatttgggcgaatccgcaagctgttattgattcatctattacacttagtgcaattcgtggaacattagcggattctgcggttggcatgtttattaccggaattgttatggcgacatttatttggattatggggatgacgcttgttatcaatagtttaaaagatagattgtcaaagaagttcctaatttggatcaatgtgatttcaggtattgtgctgttactatacggtgtacatttgttgtatgaggtaggtgttaacgtgatgtccatgttttagttattttgtatgagtgtcgggacttttagtcgttcaacatttgattaacgtcaactagttcagatgattcgtcttgatcacgtcagccatttgagtaccgagtatgtatgtacttgcgttatgattatttctttctttcattaaaatcaccccgacgcaacctactaactagtagtgcgtcggggtgattttgtgttttgtgtatttgctataacgctgagcatgctttgaccctcgtcggtcaactactagcgcgtgatgacgaatgcgcgtctatcttgctgcagagagtttgtgattgctgatggtgccaagcaattgtgcgtactctgtggcagcgatgatgtacttgtcgttcgagtgatcgtaaccaatcatacccatgtcgatcggcacaccattgtcgtcataccttaattcgataagtcaatttattcactagcagtagcaaacgcaatttctagggaagtggcttaattttggatatgagatagttcactagcactaggagtatgtttataaagataaataatttcaggctaacaactagcagtgcatgctgatcaaacccgatagatgccatataactaaatctaattaaccatgtcgtaggcacaaaaaacatggtgtaatcaaacaatgcagtttctgcaattaacgcaataattgtagcgcccgccacaattagataggatagtacagagtttaaattacgagagagcagataagtaatttgtgccaccatcagtaagttaagcaatataagcgagggcaaccaatttatagttacgtgtgctatatggctcagtatgatgtaactgatgattgcaagtagcgtgtgaaatatccaatgtgtgaccacttgcatttctccccagataaagtaggggtttcgaagatgggtcgtaatcatgaaatttccagctgttcgatcatgttgcacggtttgaataatcgatacactcatcaacaaaggtgcaaatatgccaacaaaaagtttgacgaggacgataaactgaccagggtgtgttaggcgcggtaaataaagcgcgaggatgactgttattacgagataactgattaacactgctggtagtaatcttttgcggtttttaataaactcaatcgcgataatgctacttgtcatgtttgtgcctccgtgtatatagatacaaaatgccttctagtagggcaaacatcacaaacgttgtgaggagtgttggcctgataagtacattgctgtagtgtcccaaggctaggccgtttggtttcacgccggcgatgtaagcaatgttgtgaatcgcaaaagaccatggtgttggaaaattaattaaggcggaagctaatataccgattacaacaacgacgccaataacgttatttaggttgattaccaaaagatagattactggtaatagccatgcggcaaatattgcaatgaacaggattggtagaacgaatccctgatagaagttgatatcagatagcccaaatataaaggtcaggaacgcgatagctgcaacttcatagagagctaagccttttagaaatgaccagtacaggtttaacagcagagcgtggtagtatttggagatgtcaatgacggactcacgcacgttaaagaagttacccgcatttcgctcttgtcgagttttttcaatagctaacacagtcaaagttagaaaaatccagatagttgaaaaattattttggaaagttgccagacgcacactgttctgtagtggacttgttagtaaccaaataactgtaaatccagctgcgatgacattagcaacgaccatcaaccagttaatatgactgtgttgtagtttcaagtgctccattgatagataatgactcataatggtatggtccctccgctagtcgttatagtcacgatagatggtcgtaagatcctctgcggaatagccaccacggtttgaagcgtaggttattttgccgtgctgcagaatggcaaaagcgtcaaacgcggttgctagttcagtaatttgatgcgtagtgatcataatggtcatcccactagcggctaacgtgtgcacaatcgtcttgaaatcatcgacacctgccatgtccaatccattggttggctcatcaagaattaaaaactttgggttatggataatagccatagcgattcctaaacgttgcttcattcctaatgaaaagttctttactttaagttttttgctgacgtcacctagaccaactgcatgaagtgttgcgctaattgatggttctgatagattgtacaaaagtgccataattcgcaagttttcttgtgcggtcaaattagggtagatagctggtgattcaattaaagcaccaaagtcttttgcttgttcacgtgacaatggttgattgttgtaagtcattgatcctgaaaaatgcttattaagacccaggatggtttttaacaaagttgttttaccagccccgttatcaccaagtagaccgaagatgctaccagttggaatgtttattgaaacgtcatgcaatatttgctgattgtgatactgcacggataagtcctctattagtaaggtgttactcatataattactccttaaaatataaaacactgcttgcaagggatagggtagtccaatttcaagacggttaattcgagtataccgttactaaaaattttaactgtatgcattattgcacattaaatttagtatcaaataaaagtggatactaaatcaatcatttgggatatagaatggttcgtaagttgaacgatttgttcatgctgtaaatgcaatgtcacgcttaaatatcgatacatagtcttgggttttcagggatatcatttgccagtgcctataagtcaataacattaaaaatatcacttgatattgggccacatgtcatcaagttataacttgagacatttgacaatttttgaactgtgttggatattgaaattaatcaaagagtggaattattacatctcttgtggataatttttgacctgtatttcatgcagagaatggagaactactatgcaaaaaacggaagaaatcagtcgcccgattggtgtatttgactcaggtgttgggggcgttagtactctaagaaaattgcatgagatgttgccgaatgaagattttttattctacggtgattctaaaaatgcgccgtacggcagcaaatcacaagagaaagtttatctgttgtcaaaagatatagttgaatattttaagcagaaagatgttaaagcaattgtgatagcatgtaacactgcaaccagtgcagcaaaagaacgattgactaaagaatacccagaactaccaattattggaatcgagccagcgctaaaagaggccgttgataataacgaacaaaatattttagtgatgggaactaaattaactatgaaactaccaaagtatcaaaagatggttaatgagtatagtgatacacgtcatattatttcgctacctagccctggcttagctgaatatatagaatcggggatgcatgacgatgagacactgaagggattgctacagaatttattagcaagttacgcaaatgttccatttgatggggttgtgcttgggtgcacacactatccgtttgttgcggaggcgattcaatcatgctttcgttctaacattgccattcatacagggtacgaaggggtggctaatcgacttaaaaaattgttggcagaattaggactgtcaagtaatcgccgggatgagggatctgtatcgtttgatagcagctcacacgattcaattcagtattatgaaaaaatgtttcaaactaggtaggtggctacaattttaaatcatcaaaatatagagccagatgcagggttagtggcgaaaactatcgcacatgatagtcagacgcctagcgctaatgagttgcattggcatcaagcgttagaaattacgttcatgctggactggcccgaatcagtgattgccattggacaaaaccgggtcgttcataagccaggtgatatttggctagtgaatccaatgcaaatacacaactaccaagcgctctacaaaactgcagcaccgaaggccttaactatcctatttccatacaatttcttggcagctgtttacggggatatatctctcggatatttcgaaataaatttacaacgcagggatgatttatggcgtttgggtaatgacatttggtcgttgtatcgtagtgaccgaaaggatgcaaaagttcttcaggatatccgattattgcagttgctacaagagttagttgcgtatcattttagatatcgagatgaagtagatggccataatgaattgacattttcggttggacgcactgctgaagtaaccaatttcgtgatgacacactttgccgacgaaataaatactggtttaattgctcgccagttaaattactctgaagcgtacattgcaagactagtaaaaagcgaaatggggattactgttacacaattaataaatcttgtcagagctgatcacgcaaaacatctgattgacacgacgaattatcggttagatgacattgcagtacaagtcggattcaaaaacgtaaaaaatatgaacagatggatgaaacgatactttggcaatggcagtaaaagttttagaaatcagtaatagatagtttaaaggctaatttccgatgtcagaaattggcctttttagtttcgattttgataacaacatgaaaaccaggtgcttataatggtgcacataggggagttttaattgttttggaggtgtcaaaacatgatgaatggcattagcttatataaaaccgtgaatattgatgggattaatattttttaccgggaaatgggttcaactaataaaccggtcttgctgttgttgcatggattcccgtctgcaagtcatatgttcagagacttaatgccgttgttaaatgagcagttcaggctaattgcccctgattatccggggtttggccaatcggacgctcctttacgagccgaatttgattatacatttgataatttagctgacgtaatggataaatttatcatgcaacttgatatcccacaattttatctctacgtgttcgattatggcgcaccaattggttttcgaattgcgaagagttcccctgagaaaattcttggtatcgtcagtcagaatggcaatatttatgaagaaggattgggagaaaagtggcatgataggaaagcgtattgggccaatccgacattagccaaacgtgaagcctacaagcaagcatttgcaccaaagacaattattaatcaatatctagatgggacgatgcgagaaagagtttcacccgatggttatactttggatattgcttacacccaatctaaagaatatgcagaacggcaatccgacttgatttttgattacagaaataatgtggcgaagtacggggagtttcagcagtatatacgtgaatatcagcccaaaattctcgctgtttggggaaagcatgatgtttcctttattccacaaggagccaaggcatttaggaaggatgcagaaaatgttcaaatttatttgttagatactgggcatttcgcattggagaccaatgccacagaaattgcgtaaatgattagtaattatttttagaggtgaataaataatgccattaatgaaaatcgatatgataaaaggtcgaaatcaggaagaaatcacaaaaattctcgatatttcataccaggtgatgttggaggcgtttggtgctcctgaaggagatcgttatcaaattgttaatcaacacgaagactacgaaatgcaaattttagataccgggctaggtattaagcgaacgaatcaagtccttgtattcagtttaattactcgctttagaacagttgatcaaaaacagacattttatagaaaccttgtattacagcttaatgatatgttgggaatcaggtccgaagacatcatgattaatctagtggttaaccaggatgctgactggagcttctttaatggagaggcacaattcctaacaggcgctctgggctagaatctttatatttaatttggaccaactttgttgataaagcatgtttaacaaagccaatgtcagaaattggctattttagtgtagataattggacaaattacttcttcgagtaaatacaatattaaatgtaagcgcttactaaaatgtatttactttggagggactatgaacaagtttgatgacattatcaataacgctattaacaatggtagtcttgggggagctaatttaacaatcttacaatcaggtaaaaaggttgttcatgctcactatggtactgatggtgaggatgcaatttatcgtctatattcaatgaccaagatttttacagcggtagttgcgagaaaattgatcgaaaaacagcagctttcattgacggaccagctatctgactacctacctgagtatggtaatcagttattttttgacgaagatggtcatatcaatcacagtgataagccaattacgattgaacatttattaaatatgacatcaggtatttcatacccgtcgacagggacttatggtaaagagaaaaccaaggagcatgaagaggcgattgtggcgctgttaaaggctgggcgaacattatcaaacagggatattgctaattcatacggtcgagttccgcgagattttgaacctggtgaaggttgggaatatggtgccaatgctgatattttaggtagtgttcttgaaattgtttctggtaaagatttagaaacgctgtatcaggaggagttatttgagccactgaaaatgaaagacacccatttttttgtccctgaaagcgagacacatcgtgtgagtggtgtatttacgcgagatacaaagttcgaattagttgttcaacataatcggcctctaactaaaaagccggaaaatgggtatttaactttaccactgcataataacattgatgtggtagcgcctctgtatgttgcgggtggcggaagcgcctattcaacagcagacgattatgctgtttttggtgaaatgctgcgtaataatggccggcttgatgacgtaacgatcttatcaggggaaacagttaaagatatggttacgcctagtttgacggagaagcaaatggcatttaaaaacaaggatgaagttggtgttaccgttcctgggtataactattcaaatctcatgcgaattcttaccaaccctgggcaggctaaggtgctaggtgttaatggaactatcggtgagtttggatgggacggtgctggtggcaactttattgtgattgatccatcgcgtgaattagtggcagtcttcatgatgcaagataattcaggaccagaacctattcttcgacgagccttatataaggcacttatgtctgagtttaaggtgattcattaatgggaaattataaagagtttagactcaagctaggattgttgtcgatatcaagtcttcttgcattagcccaagttgttgcggcggcttttccattgatgtatgcgcagtttgaaggtgtttcaaaagctggtgtcgaattacttggtacagtacctaatttcggaacattaataggattactcatgtcagggtacgttattaaaatactcggatcaaaaacgacagtacttcttggcgtacttgtatatttagtgtttggtacgatgccactttattttaatgattacactatcattttggcttctagagtattactgggaatcggctcaggtctatttagtgcactggccatttctttgttaagtcggttttttcaagggccgacattatttaaaatgttaggatatcaaaatgcgacggcaagtgtaagtagtacatttttctcatttacattgagctattttgtgatctacagttggcacggtgcttttgcaatttatctgttagccgtaccagtattattcatgttttggaaatgggtgccacgtatagctgatacagtgcctgataaacaatacgaaccagatgtgaatacgagagataataatagcttgaataataaattggttttgatggagttagtggttatgacgctagcatttttcatcgcgttggttgcgatgagctataaaatgccacagttgatagtagagcgacatttgggcagtgtccaggacgcatcaaatctgtatggattttttacactaatcagtattccagtgtcgttagtttacggtcaggtcaaaagattttttaaaaatacgttgatcgttttgatcccattgctggggacgattggttatgctttgattattgttcaaaacagcattctaggactgtacactgcaactattctggtgggagttgcgtatggattgatggcaccagaactttttaacaaggtatcggaaattgcgccaactcatcgtacagatcggtatacagcgatagcttcaatcgccctaaatattggtgtatttgcttcgccaatagtgacgaatgttatatcaaacggtattttacacgtacaaagcagtgatggcgtgttctatgtgggattggttgggtttggtatagcgacgttattggcttgtcttgtaaggaaagcttattgaaaataaaaaatatgacagtgtaggattgaaaataatagacgagcaactaacttaagtcagtcgaaaagctaataggtataaatagaaagcagcctgataatcacgcaatgcagtggttatcaggctgctttcattcagttatgacctagtttttaggcgttgaattagaaatttttgacacaccaataatgaacactattaacctaataactaaaatagtgatacttacttttgggattagggcactaagaattaatgctataggtgttgttaaaccaccaaaaatagcagctttttttgatttagttgacaatttcattgttgataccatgaaacaagatcgcctcttgtagaaaagttgatgactacaccacggtctcctgatatttcactagcaacaccgtatcccacgtatttaatactttttacaatggcggagtttaaatacagtttaaacccagtacttatttgcataatcttattagtgccctggcgaagaaagtcttgctgataggcagcgcttaatacatctacaggaattaaagtatatgcggcaggattaattgttcttaatttactcagcatttctgtgtttgcaatggagtagttactgataatgggcttttctttacacgtagtctgagaaatcatatcttctaaactatcacccgaagacgaagcaaaagctgatattggtgtaacgaagctaccaacggtgaaaggtaaagccatgagtgaagtcaaaaatgcctttttgtttatcaaaataggttctccaattatatattttgtatttgtcttctggtcatttgaatatggtaaaaacgatatcaaacataaaaaatgtttgcaaaatgatattaaaattttgtttagatttcagatcgagtaaagagtctactgggagagtttttggttgttgattcgagactagtaattttaatgtgaatttgatgcctttttgcggacctaactgacgataagaatgatgaaatgttgataacaactgaggggttcaggataatttgggttaaaaagcatttgtaaagtcgtgatatgctagtagaaaatcacaggggataatgatatgacacacatttatgatttaattattgtcggcactggttcagtgggggctgcaactggttattacgccgcccagaaaggcttggacgtattagaaatagatgcctacacaccgccacataccgaaggatcacatcatggagagacccgaattattcgacatgcatacggtgaaggcggggcatacgtgcccatggtgctgcgggcgcaagaattatggaatgagttagcatcaatgacagaccgaacaatttttgaggcaactggcgtattgaatgctggaccggctgattcagaatttttacggacagtacgggaaacggctgacagttaccagttgcctgttgatgaatacaatgggcagacggtccgtgaaaagtggccatcatggaatttaccggtagattatcgagttttggttgaacgtggtgcaggtgttttgcattctcaaaacgccattaaaacttatattgaactggccaagaaacttggggttacccagttatttaacaaccgggtagtccgacttgattcagattcagatgataacgttgcggtggtaactgaacaaggtatgtatactggacgacgggtggttgtgacagcggggacttggataaaggagctgattccagatttacctgtgcaaccaactcgtaaagtgtttgcatggttcgaggcggaatctgaattggcagccaaaaatggttttccagcatatacaattgaagatcgggacggaacccagttttatggtttcccggccactaatgggacaataaagattggtcggcatcaagggggccagcctattacgtcccccactgaacgtgtgccgtttggtgaggttggtacagacgtggatgaagtgaatcaaatgacagatatgtttttaagtggtgttggatcaatagcacatggtgaatcatgtacatatgacatgtcgccagacggtgatttcattgttgatcaggcttcgagattcgagaatataacggtggttagtgggttaagcggtcatggatttaagtttgctagtgtccttggtgaaattctggcacaggaagcggctggaatcgatgtgccgtttgacttagcaccgtttcgattgaagcgtttttaatttagtggtttatctattcgaaaaatcgaatggggtcgctatctcaagggggctcccatgaaaatcgaagtcgtataaacttaaaaccaaaaagaatagaactgttttttaggcgtttgcagttggtgatactcaaacacgtaacctgcatgctttacttggtgcatcttcagaaaaatgggcgatgtagaatgaaacaataacgatcttggattttgtgtcaagaagatggggctaccaaagatagaaatgcctatacaaacagcctgacaatcacttcaagaaatggttgtcaggctgttttcttatatatcacgtttctttatttcaagttgaatctttagtcgatcattgtgagaactcttgttaatgcgttacgttcacgaacgccttggtttaatgggtgtgtgtcgtccccgtaacctagtgcaattccgataccgattagttcgtcattaggaatgttcaaattttcatgtagaacatcaggatacttaacaagtgcgtaagcaatagctgagtccaatccctggttttgagcgctcagcattagagtttgagaaaacattcctaggtcatggatagaccagtctggtgatcccactgggatggttagatacacaatgtgtggcgcgttaaataatgttatttgtgattcgttaaaaccgggggtattgttaaattgttcagtggccccaaccatattttctcttgagaatttaggccattccgtccgacttatgttcttaaaatcaggtgatccttttatgcctttcatgttattttcaaggtaaatacgcttaactgtttttagactgtcaccactagaaatgtacaccttccacggttgtgcgtttacccaagatggcgttcgttgcgcctcttcgacaatggtctctaacacgtctttgtcaattgtctgatctgagaagtagcgtgttgatttacggttgttgattaattcttgaaagtccattttaataacctctctatgtgtcgttgtaagtaattttatactggacctaaaatcgaaaataccaaaaatcaacgaaatgttgtaaaatttacactgaattaggaggtgcaagatgagcagtgccgaaatatgcataagatttctgaatgggtctgattacaatgaccaacaaattacatgtaaccaatttagtaagttggaatactctgacgaaaaccaaacaatcagtaatgagaagcaacttcttgagaactttaagaatggtggcgaactagccgttcaaaatttgcaagagtattttgaaacaagcaatttattcagtctagctaaagataaattacaaagttatcaaatgatgttcatcaaacaaataacactcgttaatcaggccgcggtatcagccggtgtcagtgcaacgtttgctaatactgtcaatgattatttcatcgagcgaatgttgacagccacggatagggacggtattaatcttattcacagagagatgctagaatattatctcgaccaaattgtaaaaagtcggggttcgcagggatactctgctgaaattagtgaagcaatgcaatatatcgatcgacgtcttcatcagaaagtaagtgttaaagaagtttcagatagcgtaggcttgtcgcccaactactttgccaacacatttaaaaatgaggtagggattgcattaaccgattatataaacagacgtaaaatactggtttcgcagaatatgttgcaatattcaaatttcagcatcactgagatatctcagtaccttgcgttcagcagcgaaagttactttatcaaggtctttaaaagcgtcaaaggcatcacgccgaaacagtttaaaaagaccttagtagcaaacggatagattggtgcgactttagtggtacctaaaaatagcctgatgatcacgcaaagaagtggtcgtcaggctatttttaaattaaacgggctgtaagtaactcttgtatgtatgtattgtcgccgattgcatattgactggtgaataaaataaaaaagcatcatgcatatgatgcttaaacagtctacgaaaataagttcttgatgaagtttaaccatttaacttcatgcgtctgaggctgttttgtttttggggctaccttatgagtggcactatgggattggtccttgatcatgttgtagtaaaggagattcgtttccatagacgctttagtagctgcagccgtagctgtcgaaaaatcacctgaatatttgctagtatccatctctacattgtgtttctggtagaactttctgagcgttcctatcttaacgtaaatgtcagtttttttagcttgcttaattgcgtaagactttgttggcaccgaaaacatggtgccagtttttcgaataacaacataactcgaatctggtccacctgagaacatgtcgtctaatggagaaatatctgaagccgaaattgttagtggtataaggccaataatgataaatgataatagtgctgtaaataaattttttcgcatcttaagtcctccgaaacataaaactaccttgaataatacaaacaacgtaccatataaaatgtcgaaaatgcaaaactgctattaaaaactgtcattttttatatttgcgttgtaatggtaatagttatttttgtattcgtaacgatcaactttacgtttaggttcaatgcttataacaggttagcagttttctgataccgtgataagcttgagatattcgtgatgattattgagggggatgtaagaatgaaagtgaaagcgtacattgcaagtgcttttagcaaggacaatgccggagggaaccgagcggggataatttttctacaacaatcgttatcagtgactcagaaaatagccattgctaaagaactgggtttttctgaatcggcctttatttccggttccgatcaagcagatttcaaatttgagtattatacgccaacgagcgaagtggatttatgtggtcatgcaacgattgcatcctttaccctcatgcgggaacttggaaaggttgtaccgaaccgatacacaattgaaaccaaggcggggattattccgatcgaagtccagccgaaaagaatatttatgaaacagccgccctcagaattttttgaaaagattgaaaagcctgaattgagcgaggccattgatatttcagcagttaatgacaacttcgatattcaagtggtatccaaaggtgggaaagatattttggtaccggttaatatcaatgatctcaacgcgctaaatcctaattggcaagcaatagcaacacttagtgagcaatatggtgtcatcggcatgcacgtatttggcttgtcagaaacggatattgtctgccgcaattttgcaccgttgtatggcattaacgaagaatctgcaactggcacgtcaagcggtgccttggcgtgctatctattcacgaaaaatattcggcgccaaaaggagtacatttttcagcaaggtgctaatttgggaagtccttcagaaatcgttgtaaagctttctgttaatcagcaggatgaaataataggtgttaatgttgggggcgctggttatgttgacgatgtaaagttcttagaagttatctgatacgaaaattttttcaatgatcgtgcgaagaactgttgcagttagttactcaaaattcgcttgaacatgtatatgcctgatgatgtttcgtagtcatcgggcattttttgctgtcttttcacccaggataagctaaatttgaacttgtttactattttgaaaacggttacaattaacccgtacacaaatggaaccggttccgtaattatgttttagggggaataatatgaaccacgaagaggtagcaaagcgggttgcgaaggctttgggtgatgataatgtcattacggcagcgcattgtgccacgcgtttacggttaattgtgaaggaccgtgacagtattgaccaacaagcacttgataacgatccagacctaaaggggacgtttgattcaaacgggcagttccaaattattgttgggccgggtgatgtcaataaagtatatgatcactatgttcgccagacaggggtccagacggcgacgcctgaagaactgaaggaacttgcagcgcaacagggtaagaaaaagaatccgattatggctatggtccaggtattgtcggatatctttgtgccactgattccggcaatgacagcaggtggtctattgatggcactgaataatatcctgacgggaaaagatttgtttggaccccaatcattggtgcaaatgtttccacaaatcaaagatgcagctgacatgattaatcttatgtcgtcggcaccattcgcatttctgccaattttaattggttatacagccactaaacgttttggtgggagtgaaatcttgggagccgtggccggcatgattttggtgatgcctgcgctgattaacggaaatgatgttgcatcagtcatggccgctgggaagatgccatcgtgggatatctttggtctgcatattgcgcaagccgggtatcaaggccaggtattgccagtcatcggggtggcattcattttagccaacgttgaaaagtttttccataaacatttaaagggtgcgattgattttacgttcacaccaatgtttgccattattatcacgggttttttgacgtttacggtggttggcccagtactacggacgttgtctaatggcttgactgatggattagtaactctgtatcaaacgttaggctttgtcggcatggggatttttggatcagtgtattcggccatcgttgtgacggggttgcaccaaagttttccggcaattgaaaccacgttattagctgatattacaaaaacgggtggtgattttattttcccaattgcggctgtttctaacgttgctcagggagccgcagcgtttgcagtatttttcttggcgaaaaaggacgagaaactgcgtgcattatcatcatctgccggggcttcagcaatgcttggtattacagaaccggcgatgtttggtgttaatttgaaatataaatttccattcttcattgcgctgggctcagctgggattgccggtttagtaattggcctgttccatgtgctgtcatcttcattaggcccagcaggtgtgattggctttatcgccattccagccgccaagtgggttggcttcttcattagtatcgcgttggcgtttgttttggccttttcggtgacctatggttatggcaagcgacgccattttggtgaaactggtccgcgaactgatgtgccaacgcgctatgaaccagcacccgatgatatcgtggtggcgtctcctgtagcaggtcgggttgaccggcttagtgcagttgatgatccggtcttctcgagtggtgcaatgggtaaaggtgtcgcagtactgcccatcgatgggcaagtgtttgccccaattaacgggacagtcaccgttgtgtacccaacgggccatgcctacggattattgggtgacgacggcgttgaaatcctgattcatattggggtggacacagtatcactaaatggggatggctttgaaaccattgtgaagcaaaaccaacacgttcgagctggtgaagcattagggacatttaatgcggataagattaaaacagccggtttagacgaacacgtcatggtcatcgtgacgaatacagggcagtatctggatgttaaacagattgcaaaccaaacagttatggcgggtgaaccgcttttggcagcccaaaaggagacgaacgtttgattattggagacacagaaaaatttgaacaatatcacatttatccagaatatggtttaattaacgatccaaatggccttattttttttaacaaacaatatcatgttttttatcagtggaatcctaacgcactggatcatacgtataaagtttgggcccacgtggttagtgatgatttggtaaattggcgacgtatgccaattgcgattgcgccaagtctgccagaggaccgatcaggcgtttattccggtacaacgctggtgaaagatggccgattgtacgcattttatacgggcaatgtacggaatgatgcgggtgaaagtgtggcctctttccaaatggcggctgtgtcggatgatggtattcactttgaaaagatcggtaagttatttgatcagccgagtggttatacgcgtcatgtgcgcgatccgaaagtttttgaacgtgatggtcattttttcatgttacttggcgcccaaaaacttgatttgactggtgatattatcgcgtatgaatcaacagatttaagcaattggacatttctggggtcaattttaggcgaacaggtaacggcgtatcgcggctatatgatggaatgccctgatattttgacaattgatggccaagatgtgctgatgttctcaccgcagggactacctgcccaaggcgaccggttacaaaacattcacaacacaggttatgttctgggaaagtttgacagtacatctggtttatttgaagtgacgtcggatttcgaagagttggatcagggatttgaattttatgcctcgcaaaccttgcagcatgctggccgtcatttattgtggggctgggctggtatgatgccgtctgaccgagaaaaaacgttgccaactaggcaagctggttgggcgcatgttttgtcgctgccacgtgaactgcgccttgttggcggtaggctgcgccagtatgccattgcagaattaggcaagtttcgtcaagcaacacctgacaaaattaccggaccgggactttggcgcgtaactgccgatacatggcaggttaatctaacagctacaatgattgtgcaacgggagcgggataccgttacgattaaacgaattgcgtgggagtcgggcgaatttgaaattaggcaggcaaaggtttctggggatgtgttactggtcgtcgataatgatgttgttgaactatatacgacgtctggtgatgcagtgatgacagcacgatattttgattaaacggttagttaacggtgggcatgtttgtaaattggcagtaatgtcagtatattagtgaagatcgggtgaactatattgccaaaaggagaatcactatgattaaaaccaggcgggttacaactttaatgccacaatataagactgtcgttgacatgtacaacgaggcgtttccagattcagagagactgccattactgtatttaaaatttttatcttggcgcaaaggcgtttcttttactgcttattatgatggtagtgacattattggtatgacctatacggtggaaacagatcagatgatatttgttttatatctgacgactaatgttgctgttaggtcgaacggatacggaactaaaatactacaggaattgattagaagaaatgcgaatcgagaggttgtactaaatatcgagccattggacgaatttgctgaaaatgcggaacagcgtgaaagacgctggcgcttctatcagaaaaatggcttcctcatgacggggtatttgctggaggaagatggtcaatattttgaaatattaagtacatcaacatctttttcagttgcagattacataaaaaacgttggccgactgtcgtttggcctgcaaaaagtaaccgttgtggaaaagtagtatttcagggtagttattttagacaaaatgccggaaaatgtccgtttttggatgaaatgcgttgtttagaatggcgtaacgacaaaccatctcgtatactggcagaaaaatacgagtggagggaatgtcaattatggaatttaagtcgttacgtcggagagattttggtaagattcagcagtttgccattactggcatgcatctttttaattacacgtcaaaccggattgaactattcttttacgcaaaatacttttggtacctagaacttcttcgcgcaacaagaatttatgccacctatgatggagacgaattcgctggtgtgctcctacttgatattgctggtgaggaaaaagcctataaaagtaagtgggcatcgatatttgttaaggtcatggaatgggtcatgcaatggggctacgctgacatgtctgaccagtacagcaatgctaatacaacgatgcttgctaaatataaaaaagaccatgctgtggacggtgagttgaatttctttttggtgaatggtgcaattgtgggcaaaggtgtcggatccaaactattgtctgaggctgagaaagacttgcaggggaagcacatttacctatatacggatgacggatcaacctttcagttttatgataaacgaggttttactcgtgttggagaaaaacaaatttcgatgttaaatggcacggatagtgtgccattaacagcaatgctatatgccaaggaatactaaagagcaggcgattaacaattaagtgttgatcgtctgctctttagtattgttcaaaaatgttttgtaggatgttgctaatgtctggatttccggtttgtgcaccgttatgtagccattgggttatgacgccgattgtacctgttactgagtatgtaacgccgtagtattcggatggattatttcgatccagtcgttctagtgtcaacactttttctacaaagaatggtgtaaaacgatttaagaaatcggtgttttgtgcgcgcgttaatgtaacaaatgcctctttatgggcttcgatatatgctatgaaatctttagttaatactgcaaaattattttcttgtggactggggtaatcagcatccattctatcggctagtccggctaatagttcgttgatagtttgttcatataaatcaaaaatgtcatcgaaatgtacgtaaaaggtacttctagacacgttggcgatatcaacgactgactggattgatattttctttaatggtgttgttttaattaaggtgattagtgcatttgataaggcatcacgtgtacgtttgatacgtctatccgtagtcatgttttttgctctccttgggtgaagcggcataagatgaatgttcattttcaacaaagtagataaatcacaattaattttaacattagttattagtcagttattagacagatgtttgttaaatgtccgataatggacgaattttttcaaatcgcgctttaacgaaggaacttctttttttacaataaatcctattaaattttgactacatgtcgtcaaaatgcgaaaggagacaagaatggcttttttaaaaaataagcatagtatctggtttattttttggctggcattgctgtcactagcaatttttgccatgcctgatgaatcgagcttgaaatcagatcaatcagtacctgatacatatcaaagtactcaggcagataaattagcaaatcaatttagtaagaaagatcgaggtgcgaaaacagttattgctgtctacaataatggtaaagatccattggttgcagaccaaaataaagcaattgacgcaaccgttacctcactaaaagctaatgctgataaataccatattacgggaataactgacattagcgatggcgctgaagaaaagtcacaacttgtttctaaggacaagtcaacgagattggttcagttgactgttaaaacggatgatattccaaaaatgaagcaaactttagcccgtgcaacaaaagcagagcatgtcgcatcatatatcacgggtagtgatattctagatcaagattttggcgatgcaacaagtaaaggcatcgccaaaactgaagtcatcgccataatttttatttttatcgtgttgatttttgtttttaaatcacccattaccccattattgtcgttagcaaccgtgggggtatcagcgattgttggcattagtcttgtttacaatatggtgaaatattttgggctagcatattctgatttgactgaagccttcatcattattgtgcttttcggaattggaacggattacaatattttgctatataacgaattccgtagcagtctatcacaggggttggataaaattaaggctgctcgcgaagcagttcgagtcggtggacggacaattctatatgcgggactgtctgtcttgattggcatgggaacactatatttttcagatttctatttgtataaatcggcctttgggattgccataggagtggcagtgctattagccgtactactgacgttgaacccattctttatgacaatatttggcgagaaaatgttttggcccaaaaagaactttgaagaagagggtgaaagtcgtatttggcatttctttgcgaaaacgtccttggcaagaccgtttgttgcactgggaatcttagttataatgcttgtcccggttgcgatgcaaacgcatggtgatttaaattacgatagtgctgttgaggtaagtgatcaaacgccgtctaagcacggttacaatttgattcaggaacacttttctaaggggatggcggcttcaactagtatttatatcaaaacaaataaaacgttggataatcaaaatgacttacgcgtcattgatcaaataacgcaaaatcttaagacaatcgacagtgttgataaggtcatgtcccttacgcaaccgattggtaagaaaattgcggacttgtatgttaagaaccaactatctgatgtatcagttggccttggcgacgcaacgaaggggctaaatcagattaagggaggacttgggtcagcaaaaaatgagttagacggtactgatgtaacagggacggccgcttcagtctcggatctagcgactggttcagcagaagttgcgactggtgcagctgcactacaatcggggattggtcaaattactgcaaatattcgtgatttaaatagtcaattagcaactgggacatctgataatggtcaaattcagcaattgatgaccgcgttaccagagttaaatcaggcaattacaaatttaaatgaccaagtgagtgcggttaattctaatggtaatgacgccatacaacaaaacctgagcaaaattaatactgctactgcagcgattggcacacagttacaaactataaataatacagtagaaagcataacgaaagaaacgaccattgatgctaacgctatcatcgatacaattaaacaaagtggcgttgccattagtgctgaccaagagcgtgcgattcatgattcaattagtaacgtactgaaaaaacggcaggacgcgatgacgaatttgcaaagcactgtgggtagttcattaggtgcgattgcgcaaagtacagaaactattggcacatctgatcaagctttggcagacaacattaccggacttaattctgctactgagcaaatgcaaagtgcagttagtgatttggcaacacaagccaatcaactcttaccggcttcaacatcagctatttcacaattgactgatggcatgactacactcaagtcaggcgccggacaactgacgcaggcgttagacgaagttgactcacaaaccggtgccttaacgagtggcgcgcagcaagttgccagtggtaatgcacagatagcaactgggttcggaggaatggttaatcagacaaaaacattgtcacagggattggctgattcaaatagtggtctagcaactgtctcttctggtacgcaagacgttaataagtatgttgccgctttgcaaaagtcgacatcctctgagtcattctacatgccggaagatgaaatccacaaatcaacgtttaagtcatccttggatacatacttgtccgacgataaacagatgaccacattgacagtgtatttaaagggtgatccaacaacggttgcggcgactaaagaaattgaaaatctaaatgcagttgttaaggcaagcatagctggcacggatcttaaggacgcaacggttgcgattgggggtaccacttcatcaacaaaagacttgaatagtttagccacaaaagactttttaaagaccgctgtcattatgctagtggtgattatgttggcactgctatttatcacgcgttcattctggcaatcagtagccattgtgggaacgctgcttatctcatactacgtgtcacttaacgtggtgcattggttgtcagaagccttgttgggacagcacactctgacatggaatacgccattcttctcgtttgtgatgttaatcgcccttggtgtagactacacaatattcttgatgcttaaatatcgtgatgaagtcgcccttggtggaaaaccacaagttaacgtgactcaaacaatattaaagtcggtcgcaatgattgggacggtcgttatttcggccgctgtgattttggccggaacttttgccgccctgataccatccggcgtggttacgctgattcaggttgcgctagttgttactgttggattaattttacttgttgttttgattccgttgatattaccggcagtcattaaattaacggatggccgtttgaaatagggtacgtcataaaataccagttccttatcaaatcggaattttcattctggcaggtagttttgctaggatgaacgcattgttttgctgagtaattatcgtccttggcctggccgctgcaagtgaagcctccaacggtttggtgacagataatttgaagcagaagaaactgtgataagtaaatttaaaatgaacacgtatctaacttcatactaaaaagacagggttttcatacaattgaaagccctgtcttttagtatgaatgatgtttgcaatacttaacggtatatcatgatacgttcacgaatatgagcattagattcaagaatatcaatgatggccgttgcatagtctgcataactaatcgttgtttgaattagttgatccagtgcaaattcttcaccagcaatcttgtattgtcccgtaatcgacccgttgatatcaaaattaaaagcaggcgaaatatacgtccaagatatgtttgagtatgaacgaacgcggtccagactatcgactaacgcatttgctagaggtttcatattatcgggaaacgctgaccagtctttaagttgcttcgtatggtctggattgatgtacatggtaccagtgccaccaactttaatgtaacgggtattcgtccccataataagctgggcaatatgtgaggttgttgcggtgtgaatatggaatgtgtcactcgtccaagcgctgattgcgtcaattatgacatcataaccggttacgtccgtctgtgttaaatccaatgtacttttgataagctcgctagaaaatgtaatgtcgtcatgtttgcggtggccaactgccaaaacgtggtgaccgcgtttttcagcttcggctacgattgtgcgaccagcgtttccaaaagcaccaagtacgatgatattcatgttaattacctaccttttttaataaaaataatgattacgcaaaatgtacaaggaaaaccccaataaacattaggatgaggccaataattttattgaccgatatgggccgtttttcagctttaaacagaccaaattgatcgattaacgtgctaaataaaagttgacctgataaagaaaggactatcagctggccagtgcctaacatcggagccagccaggcgcttagcatgacatagcaggcgccaaaaataccgcctagaagaatccatctatctgtttttaacccgatttttacgtctttaagacgttcgcgaatcggggtgcccgttaagcggctgatgcctatgagcaagaaactgccgactacaaacgctaacagtgttactttaaccggtgagcccatggcaataccggcttgtccatttatcgcaatctgcataccaaacactagtccggaaagtatggctaagaactgccaagcatatttggatttagtggtaatttgagaacgcttattttttgatccgaataggacggttaatagcatgcccgcgataacaaataagacgcctactaccttgattagtttaatttgtgaaaccggtgcattaaataaaccaaactgatcaattgtcaaacccataatgatttggccgacaatgggcaaaagtgcggtctgaatactgcctaatttaggaaataccagtacattcacagttaaactaaacgcgccggtgattccagctgtccacaaccaccagggcttgttttggaaaactgataggtcaaagccaatatggtcaccggttaggtatagtgcgattagcaggaataagctacctaaacagaaggatatggctgatgctaaaaacggggttttggtataatgacctaaccgcgagttaacagcagcctgcatggctggagttgtaccgattagaatggttaagaatgaaaatatcaaattatgttccctcctcgcttgattaatatgttatatttttgctcatagtctgactttagagaagaagacttttggttataatcgttggaaccacaggttaatatggaggtttattttgattaatgacaaatatttgacgtttattgttgttgccaatgaggggtcattttctagagcggctgagatgctatatatgtcagccgttgccgttcgaaaacaaatgaatgtgcttgagaaggaattagatttccaattatttaaacgcactagtcaaggggtaaaactgactgatgccggtgaaatattacttgagggtatacaaactgttaaaggtgcgagtgaacaagtgtttgaacggcttagtaactatcgtaatagtttgaaaaaaacaattagaatcggtatgtcgttaatgagacctggcacaccactgatcgagatttggcaacagaaaaatcagcagttatccgatttcaatttacagataactgcctttgatgatgaggaagttaatttaagcagtccatccgccaggcttggtaaagactttgatattatcgttgggccgaatgatggtattcgctggcaagaaagcattcaaactaaggtactaggtttcgaaaattttctactggccgtgccaaagaaccatcgactggcggagaagcgtgtgttgtcttttgatgatttaaaaaatgagactgttttgttaccgcctagaaatgagtctcctaatatcgagctgatttcaagagatttagaagaaaatcattcggaaatcaatttggtggcaacagacaactttttcacgcccaatatttataacgattatgcgaatcaagattatcttgtctttattagggaaacgtggcgctatttgtctcccagcatgattgttataccggttgaatgggactataaggggccttacggcgtgatgtacagtcgtgaaccgcgtcaagcagttgttgaatttgttgcgttaattacgcaagaataattggaaatcattacgtctttacagaagtaaaccgcctaatgctcactcgaaaaagtgagtatcagacttttttgttatcgcgtaggaaaacatacagaaaaaatatcgaaaccaacaaaatttgttataggtgcttccttagcgttaccagtcacgttgtttatcttgaattagttgtctgcgacgggataatgcagtggcttgttagtaattttttcagggtgcaaaaacttgataggtaatggtttgcgaaatcgcgtatagtttacgagatagtcagtgttagttagacaacgactataactatttttaacgggaggttgtatatgcgacccaaaaataagacacgtcagctagtcttaatcgccatgtttactgcaattattcttattcaatctatcgttccaatgttgggactactgcctttaggtgcgtttgcggttggcctagctgttcaaataatcggtgtcacagtagcaattggagcagtggctttggggcctgggtctggtgctttcctaggtttcgtttggggcgcttatgcattatgggacgcttggaccagcgtaccatcgataggggcactgatgttccgaaaccctttgactgctttggtaccaagaattttagttgggttaataatcgggttcttatattggcgttttttcaaggatagttctgagcgaataaagccgattgtttttataggattgggtggattggctgcatttattaatacagcgtttgttctgttatttacgtggcttggattcaccgtcatgcacacgacgttcactggcattccgaataatcatttgttaggctggttgattttatcagttgcaggggtcaatggcattgtcgaaattattgtttcggccattttggtaggcgtcattgcgacgcctatcatgagctacttaaatcggcgccattggtaagctatgacagtaacgaaggagttggtgattcacttggatcgtcaactccttcgtttgttttagtaaaatttagggttgacgaataaaaaataagtccgtatagtgtgttttgttaataaattatgagaaacaggtgaaaaactatgttgtttaaggactcacaatttaataatgcttattacttctatttctgaacattgtgattaatgtgctgggcacgtcaatcacgacgtgcccgaaatagaagcattttctattacgaatcgggcgaaagcataaaagcgcttgatttggaatagaaaaaatatgaccagctggatatttttctaaacgaatcggtgctttcatggcgcacggttcgtttttttgttatctggaggaaatattatgacgattcaaaatggcctaaatggtcaattacgtgtagcgagtgataaaagcatcacacatcgggccatcattttaggggcgctagcagttggtgtgacgcgcattatccacccgctgttgtctgctgacacttggcaaacaattcacgcagttgaacagttgggtgttagcgtcgaggttaccgaagatcaggcacttatcattacaagtccgggggctttggctattcgtagcaatcattttcaacaacctttgcaatttgattttggtaactcaggtacgagcacgcggttgatgattggcgtgctagcaggactagggataccagcaacgattacgggggatgcgagtctaacgcagcgtccaatgaatcggatttttgcgctattaacagcatacggtgctgagattcaaacgacggatggccatttaccagtgacaattcgttcaggaattacggctgacgcgattaacgaaacgctggcagtgccatccgcacaagttaaaaccagtttaatgttggcgggtcttagcgcgggaatttcagtcgttatctttgatgattttaaaacacgtaatcatacggaaaacatgttatctagttttggggtagctattgattgtcaggcggagatgatttttgtcgcgggagatcaacaattagtagcaacaacggtcacagtgccagctgatatgtctgcagcagctttttggttagtcggggcaacgcttcaaccgcatagtgacgtcgtcttggcggatgtaaatgtaaatgaaacacgctcaggtattctgacagtgttgcgtcggatgggggccaatatcacattaatgcataaacgcctacaaaatggcgagccgattgctgatattcgggttagaagtgctgacatgcttattggtacgacaattgctgggatggaagtaccgacgatgattgatgaactacctattttggcgttggctctggcagtatcccagggagatagtcgcgtacttgatgcaagtgaactccgcattaaagaaagtaatcggattgtgaccgttaccaagacattgcaggcatttggtgcccaaatcaacgagacgcccgacggctttgtgattgccggtgttgaccagttgcaggtgccaaatcaacccttggtagattacgatgatcaccgaattgccatgctacaagcagttgcgaaattactgaccagcaccgttaaactgcgggaagaaattgggacaattgctgtctcgtacccggacttctacaaagatttggcggtgctgattgatgactagaattgcaatttggggtcttggcgccattgggtcagcgatggcagaacaactgagtcggactgagagttatgaagtattgggttttgatattaatccggtgacaattcgtgaagctctggcggctggtgtcatccggggcgcgtttaatccggcggaaatcaatgccttgccaatcgacttattagtggtcgctgtgccaccgacggaaacaatggcggtgttacgtgatttgcagacaaataatctagtcgttgacgtggcctctattaaacagccgattatgcaggcggcgaatcatctaccgcatttcgttggcggacatccaatggccggtacagatgaaacaggctttcttggtcgcaaaaaggtcaggtttaatcaagcgtcatttttcttggttggtaatgacgctgattgtcgtcgtattatgacgctactctcgcctttagatagtcgcttcgaaacagttgatgctaccgaacacgatgccttgattgcgttaacaagtgatgcgacgcatttaattgcacaagcattagtagcaactttggccgtaaatgtgagcggagaggcacggccatttatcggtccaggcttccgtgatacgacacggattgcagccgccaaccctgaactatggacacaaatattattggcgaaccgagttgcgactactgaagcagtaacgaatttcatgatagaactgcaacgattgcgggagttacttgtagataataatgcagccgaattattagccgctttgacggctattcaacaaatacgaagggaattagcatgaaaatattattaattggctttatgggggtcggtaaaacgacagtggggcaaaagttggcccatgctttaggccagcgctttattgatttagatcaagcaattgctgcgcatgtcgggcaacctatcccgtcgttttttacgcaagttggtgaaccaacctttcgtgaaattgaagcaaacctgctagaaagagcacttgaacaagacgatgttgttatcagcactgggggtggcgtaattgaaacaccaagttgtgtcaccttgttaaacagggcagatgtttacacgatttggctcaatagtgaatttagtacagtgaccggtcgtctgttaacgactggcgaagtacggccgttgatgttgcgacactcactagcctctttttttacactgtggcaggaacggcaaacaaagtatgcacaaacggctgatttaatggtcacgactgattttaaaacaccggcagaaatttgtgatgaaattgttcgccacattgcggacgccacagttttagacaccacacgaagtcaaattgatgcgattgatcgccaaatcttgcaagcaatggtcgcgcggctagcactggtggataaagttgccaagattaaagcgaagcatcatttagcagtggtacagccaggtcgtatggcagccatgcaagaacggttacaagcgcgttttgcgtcaatgttaccgtcacaacttgtttccgattatctgaagttgatgactgaaacggcgattcaacgagaggaggcgcaaatatgaacaaggcacttgcgattcgcatgcaggcgattgtttatctcatgtacgttgtgcaaggttttgcattgattatactcgcacagaccatgagcgcattaaccacgatttggcatactgacttagctggcgcaacagcggttgtatcggcgattgggcttggtaaattgattgcttatccgtttttgggcgaattggctgatcgctggcagcggaaaacattgttattgctggcaattttagcgtatggattattttttatctgtgtgccaatttcaacgcacatttggcaaggacttatcttaacaagctttgccggtattgcgaacgccatgttagatgcagtagcctacccactgctactgatgcttcatcatggtcgttccagcggtaatgttttgatcaaggcgatgatttcgttaggggaagggattttgccaatcatcatcatcaatttaaatcattaccaactttggttcggttgggtattttgggtggctgccgtgattttagtggtggcattggttgtgctgcttggcactaatatgccaaatgcaacagttgcggtgactgaaagggtaacacgggcaccgcgctggcaatgggatattgtgcaagtgacattcttgacgtatggctttactgcgatgtggctgatgattcattttacacagtgggtaacccgctatttccaactggttcgcggcttcagtgcgtcaaacgcacatttattgatgacttgctacagtgttggttcattactaggggttggcattgtctttgtgttaactggtcgccggttaatacctgaaaagtggttgctggtgatgctaaattgtgtggcgttgatgagcttactctttttgctaaccgttcaaaccaaagcaatgggctttgttggtctcgcaacaggtttgtttggtatgtcggccgctggtggcgcgttacaacttggtgttgcacaattgatcgcacataatccagggtttaacggtcgtgcgactgggtggtacttctttgcgggtagtattgcggtgttattgatgccaatcatcaccggacaatttgcggcacagcacttagcacaggttatgcagagtttgctggtcgtgagtgtcattaatgtcattttagttgggacacacgctatgcgcgtagtggatagaaatcgaacagaaatcggagaaaaatagcatgcgatacatgacagcaggtgaaagccatggaccagaagaaatggcaattatcgagggaattccttcggggttaaacgtgacaaccgatatgattaatcatgaattagcccgacgtcaacatgcatacggccgtgggcaacgtcaagtgattgaaacagataccgtgaccattctgtcgggtgttcgtcatcaggtcacgcttggttcgccaatcacccttaacgttcataatgatgatcacaatcattggcgtaagattatggatccaaatacgccagcagatgcagaaaattcgatgcgtaaggtcatgcgaccacgcccaggacatgctgatttagtcgggggcattaaatatcgccatcagtctgatttacgaaatgtgttggaacgttcatctgcgcgtgagacggtaatgcgtgttgcggtaggtgccgttgctaaagcgatgttgcgagaaattggtgttgatgtacatggttttgtgcgaaatattgggccggcgtttagtgatctagaacgcttaacgacgttccaagatcttgcggaattaagggctgtaacggaaagtttcccaacgcgggccctggatgaaaagggcgatcaagcgatgcaagctgttatcgaccggacgaaacgagatgcaaatacagtcggcggtacggtgcaagtaatggcgacggggatgccagctgggttggggtcttacgttgcggcgactgaaaagttagatgcaaaaattgcgcgggccattattagtattaatgcgttcaaaggcgttgattttggcggtggttttgaaaatgctgaaaaatttggcgatcaggtgatggatgaaattttttgggatgctgacaaggggtttacgcgtggcagtaacaacctaggtggctttgaaggcggcatgacaactgggggtgtgattgttgtacgtggggtagttaagccaatcccaacgctctatcgaccaatgcaaagtgtggatattgatacgcacgagaatcaccgtgcgtcgattgagcgatctgatacaacggcggtaacggcagcggtcgtcattgcggaagcgatggtcgcgattgaattggccaaagcggttctagataaatttgatgctgacaatctcgatcgattaaaagagcaggttgccgtgtaccgcgaagaggtgcggttattctgaggaccccaacaaacgttcccgttatgtttggatgcaagagaacattcaggattttaaagtgacttttaggtctctttgcatgttggtttttgaatatgttaagctgtgctcgtacgtgaatatagagaaaatcaaaggaggaaacaacaatggttttaactggtactaaggcatgggcaaagtctgttctaaagactgctggcatcaagcatgtgatggtggcaaagcgtagcacacgcttggcaaacgcctcaatgacggcactatatcgtgaaatcaatcgtcgtggtttgaactaacggacgcttcatgattaaaagtcgtacaaaaaactgaataatgactgctaaggcaacatccggttgggtgttgtcttttcttttttgttggtagacaaaagacaccgctaatcattgctgatcagcggtgtcttttagagtcgtgtattacatggcttattccatgcattagcataactatagcaatctgatatcggaatgtctagtcatgaaggtatcaaatttcaataatacgtttgacgcgacatattcaaacctattcagtacgattaagaaaactgatgagggggatattgcctatgacctatcaaattccaacacctaatgctgtccgggacgcattagaacaacgccgacggcaacatgaaacatcaccgctgtgtaaagtggcgctgcacttaaccaatacatacttaacggaattagccattgaattggccgttaagaaaatgatggtgcgggcagaaaatgtgcaagttgatcacttattatctgaagtggttagtgagcttaagatgccacactatttttcgcaagaatatgttgatcaaattcgtgaaacaatccgggccgatgcagcagtcgagaatgcccgtgaggtcttaaatcaaattgatgacttaatacaagctgatatgcggtcgtggtttgcatacaagcgccaggtacaagttgcttttgaggatgcgggttacgcagtcgaagggacaaccacgatgattatcgtgcaccctgaattaatgattgaaaagtttacgttgatttagctgtcaaaaaaacgcgccggtggttagtcggcgcgttttttgaataatcatggatgcaaggcgtgtttgttcgctgtcacttatattaagaagaattatggcatcacgccttatcaaccacgtgatatagcataactgaaagtaacgagggcaccaaaaacgatattttcaatttttaaaaagctgtttcaaaggattgaaatggtttgtccggtaaatcgttcaaactttgcgattgtaatttctttgactgttcgccgaatctcattaagctcagccaatgttggactatgccgtaagacgatggtttgttgctcttcgtaattcaaatgaatgtttgaaatgacgaggtcagcagttgtgatttgtgtgtccgtaataaagatattgatgcttagaaaaccttgcaatcgctgaattaggcgacgctttaaggcttcgttgtctacaaaatctaacgcaattgtgacgagcggcaacgcatcttcacgtggaattcgggtaatgaacgtattgaaataatcctcaaataatgtgtttcgaacggtttcgaacggtaacttggtttgattcacaatttctttaatgattgtcatcgtcaattccgcatagattgggaattgatggaaggcatctgtaatgttgggttctggccgtagctcactgtggaagtagactaagcgtaagttagatgtgtacaaatcatcaactaaatcagccattagttcaggcgttagtagaccaggattgcctaagaaacgaggcaagcagacgcgaatacagtcgttgatgaccgagaatagggcaacagcttgtgtgggcatgagttgcatgaaatcatgcttgcgagcaaagccaaaggcgtataaggcactgagggcgaagcgtgtctcgtcgtgggccgcgacaatatctagaccgagcattgttttaagcgtgttcatcagggtaatgggaaaggcggcattctcgctaggcaaatcggccaaatcacggagcactggtgtcgagtcggtcaatgaaatgatatgaccatgcttcattcgggtataccacaagccgagttgaaattgcatgacaacacgcatagccggtgtaatggttgacccggttacacgagagagtgtgtcaaaaagttgggctgcccaattttgggcatctggggtaagtgggttggcttgttggtaatagtagtcaaataaaattcgaaagaaaaaataacgaatatccttttcattaccatttaaagtgaaactatttgtcaccaaaatatgctgttgtgccagatgctcagctagttcgcgcaattcgtcacgaacatagggcgttgaaaagtcatgttgcgcggcgaaatcttcgacagattggaaattttccaaaaataaggcgagtagcatatgatattttggcgatcggtttaaataatctaaggtgaggtcatggagactaattgtatgacccgattggacgatgaagtgttggttgctagcgtcaaaggtgatgtacgattgcgcgtttggtgaaagtctctcgatgtcgtcaatcaattcttgcccataatgcatgaccaaatattttgaccaaccgagttgattaataacttgcttgactggtactaaggtatatggttgttccagtaagtatttttttagggttagtttatctaactcttttttatgtaatagccattccattgaaaatctcccaattaacacacaaaaaggcagtgcacgcactgccttttcataagcgctgttatgtttttgttataccgcaacgtgcgctgtcttggcaagttcggcaagtagttcgtcgtaaatttcatcgtagtctgtaatggcgttgtgaaagctacgcacagaactctttaaataatgttggctagcgattgcaaccgctagatcgtgtgcgatttgttcattagattgggtcatcattgacatccttcctgttactgaatgactttattataggaagaacacgtgaccggaacaaaaatgagtttttaaattttgaaaaaatggtttttgggaaacgaggccagcttcgctatgattaaggacattacgttatgaaagcgagagttgttgattatgaatgattcaaaaccggtcaccagtattatgaatgccgggtttgtcagcattacggcgattaatttcgtcatttacttagtgtactacctgttaatggtgattattgccgtcgtggtacacacgaatttgcacgctagtttagcgcaagcgggactagcatcaggaatttatgttattggcacattgcttgctcgtttatttatcgggcagcaacttgatatcattggtcgtaagcagtcactacgctatggtgcgattttatatttggtttcgacgcttgcgtatctagttatccctaatattggggtgatgtttgttgttcgtttggtcaatggtttcgcctatggtatggcttcgactgccaccaatgccattgtgacagactacattccagaagataaaaagggacttggcatcaacttctatgggttgagtacgtcgctcgccgcagctattggtccgtttgtggggatgatcttgcttaacttgacgaatttccgttttattgtggaagtgtcatctgcattgattttgttgaccacgattgcgacactgattttgccagttcgtaatttggttttgacccctgaacgaaaagccgatttgcgtcatatgacgtttgataatttgattgaacgcaatacaattttcattgccagcattggcttcttgatgggcttctcttactcatcagtattgtcattcctttcatcttatgcaaagacgattcaccttgtggggattagttctttcttctttgtggtgtacgccttggtcattaccattacacgtcccatggctggtcgaatcttcgatgtgaagggtgaagattatgtgatgtacccatcatatatctcacttgctattgggttagttatcttaggtttgacacattctggctttacattattggttgctggtgcatttatcggattgggctacggaacttttatgtcaaatggacaggccgtggcgttgaagatggcaccaaatgccttacgagttggggtgtcgttgtcaacgtacttcattggattggatctgggaattggtgttggcccatttgtcttgggtgacattgaaaagttgatgaatttccgtgaattgtacttgctagcagctatcattccggtaattgcgggtctcttatactacaagttttacaatcacgaacatgatgcggcaccacaagttgatgcgcactaattagattttggcacctaacaattctgttaggtgctttttttctgcaaacggttacaccttttttctgccataattttgttagcgggctaaactaaaagttgtaaaaagtgttctgcaatttatttaacaagaaaagaaggtaattctgatgacttatcaaggcagtacaaaagaagaaaaactaaacattattgacttgccaaggttgcgtgacgctgtaaaacgtgacaccgaagcgggagcgtttggctacgtggatggtggatcttcggacgaacaagtgttgcgagataacgaacaagcgtttcgtcactatcaattaattccgcgtatgttgcaagatattgcggcgcctgatttgagtacaacgttatttgatattccacttacgatgcccgtgattgcggcaccaattgcagcgcatgggttgatgcaccaagatggtgaacaagttaccgtcaagggagttggtgctgcaggatcgattttcagtctgtcaacgtacggcaattcacgtattgcggatgtagcaagcgcggcgccggatacacccaagtttttccagttgtatatgtcccgtgatgatgattttaatcagtatttgctagacgaagcagttaataatggttataaggccattattttgaccgctgacgccacgttaggtgggtatcgtgaggccgatattattaataactttacgttcccattgccaatggagaacttggcggcgttttcaaatgctgctggttctggtgaaggattgggaattgctgatatttatgcacgggcaaagcaagatttgtcattgcgcgatattaacaaggttaaagaaatggcccatggcttgccagtaattgtaaaggggattcaagatcctgatgatgcgctagctgccatcgcggctggcgctgacggtatttgggtctctaatcacggtggccgtgagctaaatggggcaccagcatctattgatactttggcggcgattgcaaaggctgttaaccgccgtgtaccggttatttttgattctggtattcgacgcggtgaggatgttgcgaaggcccttgcactaggagcagatgttgtcgcacttggtcgcccaatgctttgggggttgaaccaaggtggggcggctggtgtacaatcagtgtatgagcatttggcaacggaattaaggattgtgatgcaattgacgggcgcccacacggtagctgagttgcaacgtgccaaaattatcaatgcaaaattttgaggataaccatggaattaaaagagacgaccgtaactgaactgtacgcacacctgaatcgaatcctgggtcgtgaaataacgacgcaagacgctgacattgcggttgctgtgttaaacgatcaaaaaatgccagttggtgggataatcgctgaatttatgggtgcagaggtgcacattaagcagcttgtgttatcggaaggtctgcaggcggttggcgttgatgcggcactattgcgtgaagtctttatgcgtagtggccagcgtggtgcaaaggtggcaacggcatatgccgacaacgatgcggtgcaagcattctatgaagcgaacgggtttacggtatttggtgaactggctgacgtgcctgtaatgggacgaacgcgtgtttacttacaacgtcgcttgtaatagtaaaaaacgtctggtaagtaatgtgaacttaccagacgttttgcgttattttgcatagtgaacaattgattggccaagtgacatatttaggcgttcgacagtatcagtactcatcagacgaaaggtggtaccatttgccaccaaggcttcgtctaacataatccaggtccaagtctcgccagcgatgatttgaccgtcatgattatatgaaaagacgaccaatggcagttcggcaccttgatagacatcaatagcaactgtgtcgtcgttaatgcttggtgcagccgcaagatatttttggatggctgctacggccgccggtgtagacaaatcggtagggtcgatgaagcgaccgtgaccaaacgcctggcgaacggtgttgatggccgttaaaataagttgttctgtttgcatgggtagcctcctgtactgtgttcctcggatagataccatcattatacagacgaattgttagaaagatttgaaatagtgtgccaacacatatacagtgtgatataagttgctattccaccagaatggtgttactataataactgttaatgaataagctcttaattgagtggccaggaacgaaattccttggccgctcatttttttagggttttacctctgacatagatgattttacggaacgaagggagggaataatatggcaaacgttgtagaaacagtgcaagctgtcctagcgcctgagttggcagaccaagggtttgatctctgggatgtgatttacgagaaacaaggatcagatatggtgctccgtgtgttagttgatcgtcttgacggtgcaattaacatggacgatttggttatgctaactgaaacaattggtgagcgtatggaccagatcgaaccagatccattccctgaggcatacttgatggatgtctcatctcctggggcagaacgtgaattaaagcgaccacaagattacgagtgggcgctcgaaaaatatattcacgttgccttaaaccaagaggtggacggagaaaatgaatttgacggtgaattacttgccgtcactgacgatatgttgacattggcaattacagtcaagggtaagcgtaagcgtattgatgtaccacgtacagcgattaagcaagcaaacttgacgattagccaggaacgcatcttaacgacaccggaagatttcgactgggcgatgaacaagatggttcgtgtgtcaacatatcaaaaaatcgatggtaagaaagactttgcgggtgagttgacggcggtttctgatgaagcgttgacaatcactttggaagatgaaactgcagttgatgtcccacgtgacgcaattgcgcaagctcgtcaagcaaataacttctaattttatatggagaatccaaatgagtaaggaattagtaaacgcccttgacgctttggagcaagaaaagggtatcaaggctgaagtcttggtagaagcgatcgaagaagcgttgaagaaggcttacgaaaagaactacgacgaatcagaaaacgttgaggttcaattcgatcaaaagaagggtaacatcaaggtttactcagttaagacggttgttgaagaaatcgacgagccttatgagcaaatcactttggaagaagctttggaattgaacaaggcttacgaaattggggatgaaatccgtttcgaagtaacaccagctgactttggccgtttggctgctcaaacagctaagcaaatcattatgcaaaaggtgcgcgaagctgagcgtggcgttgtttatgacaagtttatcggttatgagaacgaagtcattacgggagaagttgaacgtcaagattcacgtttcttgtacattatcttgcccggtaaccaagaggctgccatgaagcaaggtgatcaaatgccaaatgagtcataccgaatgggtgacaaaattaaggtattggtgtcacaagttcaaaacgaacaaaagggacctcaagtgttcgtttcacgtacgcaccctgagttggttaagcgtttgttcgaagccgaagtacctgaagtatttgatggtacggtggaaattaagtcaatcgctcgtgaagctggtgatcgttcaaagattgcggtttattcacataacagcaacttggatgccgttggaacgatggttggtcaacgcggtgcccgtgtacaagccgttgtgactgaattgtcaggcgaaaacatggatattgtggaatggacagaagatccagcccaatttatcaagaatgctttgaaccctgctgaagtcgtggatgttatctttgatccaacaaacgaccgtgctgtaacggtgttggttcctgattaccaattgtcattggctatcggtaagcgtggacaaaacgctcgtttggctgctcgtttgacaggtttcaagattgatatcaagcctgaaagcgaacgtgacgctgttgttgctgacatggcaaacaaggaaaacgaagccgctaacgcaccagttatcgaagctgatgtggccgacgacttcgaggcatcagaagaagcctaaggaggtgtgctcatgaagccacgtaagattccaatgcgaaaagacatcgtaaccggtgaaatggtaccgaagaaggaactcgtgcgcatcgtacgtacccccgaaggtaacgttgaacttgatccaaccaaccgtgcaaacggtcgtggggcatatatctcattatcagttgaagttgccgagatggcgaagaagaagcgcacgtttgatcgtgttttcgaaacgaagcttgacgataacttctatgatgagttgattgcctacgtcgatcaccaagctgcacggaaggaattgtttggcgatgcaaaataagcaaaaacttttaaacttattgggattagcgcgccgtgctggcaaactagtgaccggtgaggatatggtacttggctcaattcgaaacagtaaagcaagtttagttttctttgctaacgatggcggtgcaagtagtatgaaaaaatttacagataagacaaccagctataacgtgccatttacaaccgctttgacacgacaagaattagctgacgcaaccggattagcgcgtactgtcattgcagtagctgaccgaggatttgcgaaaaagatgcgggaatacttagaaatctagggaggatgacacatgaccaagcgcatttacgaattggcgaaggaactagatgtttcatcaaaggacttagtgtcagcagctgaaaaggctggtttggacgttaagaaccacatgtcaacaattgacgataaggcggtgaagacgttgacgaatgccgtaaaaccagctgctaagacagcaccaaaggccgaaaagaaggccgaggcacctaagaagcctgcccaaaacaacgctcctaaggcagcccaaaacaacggtggtaataaccaaaaccgtaacaacaaccaaggtaaccaaaaccgttcaaacaatggtaacggtaaccaaggtggtaaccgtaacaacaaccgcaacaacaaccgcggtggaaacaacggtcgcccaaacaacaattggaacggtaataaccgtaacaacaagaagggtaagaaggggcctggtcgtaaccgtaacaacgaaaaccgaccagcaccaacagtacgtaaggaccaaccattaccagaaactttggtttactcagttggtatgaacgtgcaagatattgccaagttgattcaccgtgatgccacggaaatcatcaagaagttgttcatgttgggtgtgatggttaaccaaaaccaatcattggatgctgacacaatcgaaatcttggctgccgattacggtattgaagctgagcaaaaggttgaagtcgacattgccgacatcgacaagttctttgaagcagagcaagaaaatacagaaaacttggctcctcgcgccccagtcgttacgatcatgggacacgttgaccacggtaagacgactttgcttgactacttgcgtaactcacacgttacggaaggtgaagctggtggaatcacgcaacacatcggtgcttaccaagttaagactgatgaaggtcgtgtgattacgttcttggacacgcctggacacgcggcctttacggcgatgcgtgcccgtggagctgatatcacggatatcacgattttggttgtggctgccgatgacggtgttatgccacaaacaattgaagcgattaaccacgccaaggcagctggtacaccaattatcgttgcagttaacaagattgataagcctggtgcaaacccagaaaacgttatcaaccaattgatgcaatacgaattgatcccagaagagtatggtggagacacaatcttcgtcaacatttcagccaagtttggtcaaaacatcgaagaattgttggagatgattttgttgacggctgacgtgttggagttgaaggcaaatcctgatcaacgtgcggctggttctgttatcgaagctcgtttggacaagggtcgtggaacgattgcgacggtcttggttcaacaaggaacgatgcacgttggagacccaattgttgtgggtaacacatacggacgtgttcgtacgatgacgaacgatcgtggtcgtcgtgttaaggaagctgttccttcaacaccagttgagattactgggttgaatgatgtgccatctgctggtgaccgtttcgtcgtctttgaagatgaaaagactgcccgtgcagctggtgaagagcgtgctaagcgtgctttgattgctgatcgtaaccgtaacaacgtcgtttctgtttcagacttgtttaacaagatggctgaaaagcaaatgaagtctgtgccagttatcatcaaggctgacgtgcaaggttctgttgaagcattggctggttcattccgtaagattgacgttgacggtgttaaggttgatatcttgcacacggccgttggtgcaattaacgaatcggacgtcactttggctgaagcttctggtgcgattatcgttggatttaacgtgcgtcctacgccacaagcccgtcaacaagcggactcagacaaggttgatattcgtttgcacaacgttatctataacgcaatcgatgaaattgaagctgcgatgaagggtcaattggatcctgagttcaaggaagaaattgttggtacagctgacgttcgtgagttgttcaaggtttctaagattggaacgattgtcggtggtatggtgacatcaggtaagattacgcgtaactcttcagttcgcttgattcgtgatggtatcgttatctttgacggtaagcttgcttctttgcgtcgctttaaggatgacgttaaggaagttaagaacggttacgacttcggtttgacgattgaaaactacaatgatgaaaagattggtgatgtaatcgaagcctacgaaatggttgagattcctcgctaattaacaaaggaaatggagagctaaaatggcacaacaaaatttccgtgttggacgtcttgaacaagaaatccaacgtgaagtcaatgatttgttgctaaaacgcatccgcgatcctcgggtcgaaggtgtaacggttaccggtgttgaagttactggtgatttgcaacaagctaagatttactacagtgtcttgtcagaattggcatctgttaatcaaaaggcagctgctggtttggaagccgccactggtttgattcgcaaggaattggggtcacgtttggcaatttacaagacgccagaattgaagttcgttaaggatgaatctgtccaatatggtaacaagattgatgatttgattcgtcaactacaccaaaacgactaataatttagagaatggcgacctgctttgggtcgctattttcatacatagctaaaaatgataagaggattacatcatggatggtattttaccggtatataaagaagcaggcatgacgtcacacgacgttgtgttcaaattacgtaaaattttacacatgaaaaagattggtcacgctgggacgttagatccatcagttgacggggttctgccagtggcgctgggaaaagcgaccaagacaattgaatttttacaagaatccggtaagatttacacgggtgaagtaacatttggatttgccacaacaactgaggatttggatggcgaggtagtcgaatctcaaccattgtcacggccgtttacgactgacgaaattgcggttgccatgaaggccttgacgggtgacatcacccaaattccaccgatgttttcggcagttaaagtcaatggccgtcgtttatatgaatacgctcgagctggcgaaactgtcgagcgacctgagcgccaagcgactatttatcgatttgaacgtacgtctgagccaatatttgatgaaacaactggaacgcaaaagtttacatttgttgcggaggtttccaaggggacttacattcgcacactagctgttgacttgggtaaacagcttgacgtaccggcggtcatgagtcaacttacgcgccaaaaggctggcggttatgacttaagtcaagctcattcgttggccgatattgctgaaatgatgacaactaacgggaatgtggatgcttggttgcaaccgctagatagcgctgtggcacaatatccacatgttgcattaactgacgagcaatgggcaaaagtgaagaacgggattggtttgcctaaaacggcgttgattcctgtggcggataagattgttattacctaccaaggtgatgtgaaatcagtctttgaatggcgtgaagatcgtaatcagtaccggccttatcgaacattttcaattgaataggtcttgtttaaggcgtcgaattaccagttttgatcggtaattcgacgccttttttcgttagattaagtactgtgtaagtgtcgtacctaaaaatcttcaaattcaccacctacaatacagactaaagcagtctggcatgatcgggaacatgctaagaaatcgtgtaaaaggagacaatagatatggcagagaaaacaaacgtggtaattttaggcgctggctatgcgggcctaatggcgctgaaggtcttacaaaagcgggcagatgcgtcattcatgagcatcacgctggtcgatcaaaatccttatcactacgaagccactgatttacatgaagtggcatcgggtgcgttgacggctgatcgcattacttatccgattgcagatgtcgtaaatccagagatgacggaatttattgaagatcgggtaacgaaggtggatcgtacccagcatcgggttgaactagctaatcatgaatcaatcgggtttgactatctaattattgggttgggatttgaatctgaagattttggaattccgggtgttcgagaatatgcgctaccgatggattctgttgattcggcagaacgaattcaacaacacatcacggatgagatgtttgcgtatcgccaagataatgatccgcgccatttgcatatcgtggtggcaggagctggttttacgggggttgaattgttgggtgcactttctgaaaaccgtgagcgctatgctgaaatggcaggcgtggcacctaaccaaattcaaattatgtcagttgatggcgctaaacggccactaagtgttttttctcagcatctagttgactatggtttggcggttttgcgagggcgtggggcagttattgaatcagggaaaggcattaatgcgattgagccagatgtgatgcactatgccgaccgtgagactggcgaaagtggtgaggtgattgctggcacgattatctggaccaccggtgtacgtgggtcaagtgttatggcggcgtcggggtatcaagcaaagcgaaaccgcatgagtgttacaccatatctgcaagatccggcagatgatcgcatttatattgtgggtgatgttgcagcggccacggattcggaaaccggccaaattttaccaacgactgcacaattagcgttagtcatgggggaaattgcgggcaaaaacgtcttggctgcagtcacgggctatgaattaacaccatttacttataaatcactcggtacagtttgttcaattggtaatacgagtgcaattggggtggttggcgacgaacatgaagtccgtggctatccggcatcgatgctcaagaaggtcattatgaataaatcgttattagaaactggcgggattaagcaagtcatggctaagggacgctttgatttgtatcattaagaacttgtaaaaacaccagctaaaactggtgtttttctgtatactaaactaagaaaaaattcttagtaggtacgttatgagtaataaattaaaagcgaccggcttggttggcctggtcttattgttgtttgtcggtgttggcgcatctggtgggtcacacgatgatgcaaagaaccaatcatcacaggttagttcacatgttgaaaaaaaggcctcatcacaggcaactagtcatgctgcaagtagtcagacttcgagtgaaaagaaagcggccacttctgtaaggtcatcaagtgcatcgactaaagcggttgcagcctcgagctctgccgctacgacaggaaatccagaaactcaagtacaagggctaaacgggacggtgcaaaagccactgccttatgccagtcagcgacaaatgatcatggctagtctagatcatttaggtcgggcacgtgatagtcatattcaattatcaaacgcagaagaaccaactgcgaaacgctccgaacgactgacgtatgatccagttggttggcacaattttaagttttggtactcagagtctggtgaacaaacagggtcgaaacaagcttggttaatggcacgtggacacttggtaggttatcagttctcaggattaaatgatgaagcacgaaacttggttcctgagacagcctggatgaactcaggaaattatagtggtatggatgaaggcaataccgccagcatgctttactatgagaaccatttggatagttggttagcgacacatcctaatttccggttggattatcaagtgacaccactttatgcacaagacgagttaattccccgcaaagtgcgattagcgtatgttggctatgacgacgccggtaagcgaatccagattaaagttggtggtggacgcgaagaatctggggatgatgatgcaacggtcgtatatcttgacaatacaagcccaaatgccacaatcaactatgctgatggcacagctacaaatacagtaagtgctgcaccagcggccccggcggcatcagccccggccgcaagtagtagtgcgcctgtcgcatcatctgaatcaagtgtggcacctgccgcacaagcaccagcgacaacgaatgaccccactgtgtacgtaacgggtggtggatcaagcgctgtgtattggtatggtacggatagtatgccagccaatacaaataaggcaaatttggtgcaaatgcctgagagtcaggccattcaacagggtaagcgtcacagtatgactgaaaggtaaaccagatgaacacgagggctaacacatttaataaatgaacgctcattcttttttaaaagctgttatatcgcgaatattctgactaaaccccgccttgcgcggggttttatgttattatgaaagcattgaatttttgaaacgagaggcgctgacaatggaagtcatcacattacatcatccttttgacgctgccacaattgccgacgagccagttgtgttagccatgggcttttttgacggagttcacgcaggacatcgcgctgtgattaatcgtgcgaaagctgaagcgacggcacgaggtgtgaaattggcagtgcttacgtatgatcaacatgcgtcggttgtatttactgcgcaccaacaccctttgacgtatcttacgacattaccacgtaaattaacgttgcttgcagagatgggggttgacgtggcttacgtcgttaactttacgtctgctttggcgaaacttgcgccagctgactttgttgaacagtatatgattggtttacgtgcaacagccgttgtagctggttttgatcacacatatggtgctagcgacgcccaagccgatatgtcacacttgcccgggtacgcggctggtcgctttgacgtcatcgaagtttcacgtgttgatgttgacggagaagagagtgcgtcaacacgtgcacgtcaactggttgatgccggtcaggttgatgcgttgaatgaattgttaacgcagccctaccaaactagtggcgtagttgtgcatggtgaggcccgtgggcgtgaaatgggttacccaacagccaacatcgaaactacgccaggtgagcggttaccaggagttggggtgtacgtggtcgaattagaaatcgctggtaaatggtacggtgggatggcatcgattggttacaatgtgacctttggtgaaaaccggccaaagacagttgaaattaatctgtttgattttgcacaagaaatttacggcgagcgtgtgaacgttcgttggcatcattacattcgtggtgaagaaaaattcactggtatggatgctttgattgcaaagctccaagaagatgaatctgtgtcacgacgctttttagcagaagtgtagtctaagaaaaagaaaggagacaaatcatgtcttttgatggtctctttacgcacgcaatggtgcgtgagttgaatgaaacattggctggtggccgaatcatgaagattcaccagccataccctaatgaaattttcctggtgattcgtaataatcgtacgaattatccagtgttattgagtgcgcacccttcgtttgctcgggcgcagatttctcgtattaagtatgcaaacccgcaaacggcacctaattttgctatgatgcttcgtaagcatctagaaggcgcccagttgctgcgcgttgagcaggtggcaaatgatcgtatgattaagttcaccacttctggccgtaatgagcttggtgacgaagagaagacgtcgcttatcctggagatgatgggacgtcactctaatctgtttttgattgacgaaccgacacaacgtattttggatttgattaagcacgttcctgctgatcaaaatcgtgtacggacactaatgcccggtggtacttatgttatgccaccaaagcaagatgtgattaatccgtatgagtcacttgacggactagctaatttgattttggataacccggatgtgaacgatttggcgaagggtattcaaaccacgttccaagggtttgcccgtgattcagcgcaagaactagcagcggtgttgcaacaatccggtgatgcgatgaagttagcacaagattggtttgatcgcttcgaccagccagagccacgcttgatttccactgagaagggtgttaatttcaccccatttgagtggttaacagtacaggggaatgtgctaacctatccaacgctcagtgaaatgttggacgcgtattttgctgaaaaatcagaacgtgatcgtgtgcaacaacaggcggccattgttttgcgtgttgttcgaaatgaattaaagaagaataaaactaagattaagaagcaacaagctgaactagatgcagctgataatgcggatgaatttaaggttaaaggtgagttgttgacgacatacatgcaccaagtggagcgtggtatgactgaaattgagttgccaaattattatgacgataataagccactcaaaattgcgttgtctaaccaaatcggcccatcacaaaatgctcagaagtatttcacgaagtacaataaattgaagacgtctgtgaagtatttgaatgagcaaattgcaatggcgcaagaggaagtcgattattttgaaaacttgcttgcgcaaattgatattgcctcgccaaaggatattgaagaaattcgtcaagaattgattcaagaaggttacatgcgggtgcagagtaagaagaagcaaaagcctcaggtcagccagccagaaaagttctacgcaactgatggcacgttgattgaagtgggtaaaaacaatttgcaaaatgagcgactgtcaatgaagacggctgctaaatcagatatctggctacacaccaaggatattcctgggtcgcacgttattattcacgatgccagtccatctgatgacacgttacttgaaggggcgatgttagcagcgtacttttcgaaggctcgagattcagcgaatgtgccagtggactatttgccagtccgtcggttgcgaaagccaaacggttctaaacctggtttcgtaattttcgagggacaaacgaccatggcagtgacgcctgattttgcactggtgcaacggttacgtcaaaataagccagcacaacagtaataacaaattgttaaaacgactagcggtaccaacgtggtgttgctggtcgttttttgctttgccgtggttaaaatattaaagtctcattaaccaaaatggttcaattaacagcccgtgtctgaaatttagtaaaataagcttaaattagaaattttaaggggggttcatcatgatcaaggaaattgcactggctgacatcgacacaatgcgtgctgcgattcgtaatggcgtcgatcgcgtggaattaaatagtcgtttggatttgggaggactaaccccagacgaccagacagttgccgaagctgtggcgttggcggctgaagcgcaaattgatttggtcgtgatgattcgcccacggggtggtgacttcgactattctgaggctgaaattgaagatatgcgccgttcgttacgccgcatgcgggctttaggggtaaagacggtgacgtttggtgtggtcgacgtcaaaaagcatctagctcgggatcgcatgaccaagttgctagaagctgcaaagcccatgcaagtggtgtatcacatggcttttgatgatattgcagagcgttgccaacaacaagctttacgctggttggcgaattacggggtgatacgtgtgttgacgcacggtggtaagttaactgtgccaatcacagaaacagtatctcatttacaagagattgtccaaatggcaccaacgggtctcacgattctgccaggcggtggggtgacatttgagaatgcagggtggttagcacaacaactccatgttagtgaattacatggatcaaaaattgtgccattaccggttaataatgctttgtaatggtaaggaaaacctttttgtcctaattgtgtaatacaaaaagcgtataatctataagttatgtcaggaggttgggatgaaaaccgtcttagaagcgttacgcgatactgaaaaacagtacaagaccgtgctgacgaagatgacaaaaagcaacggactgacaattgccgagtggcagttgttgagtcatgttgccgctgggtttgatactcaagataagttatccgatgaaacgggccttgataattcgacattgtcacggcagctaagttcattactcaagaaagaaatggtttcaaatattgccgttggtcgcgatcgacgccaattaatctatgagctcacagtcaagggtaatgacgtactgacggctgttaacgaacagcatatgatctatgaagagactgcatttaagttatggtccgctgaagaaaaaagcatggttcaaatcttacttaaccgtcttgaaaagtcattaagtaagcaaatataggaggattagtttaatggcaaagcacgcagttgttatctcgttagatgcaatgggtagcgctgatttgaaggcgcgcttacaatttttgccaaacctatcagcattggtcgctggaggaacatgggtgcgtgacgtaaaaggcgtttatccgtcaattacttatccatcacacacgtcaattatcacgggaacctatccaaaaacgcacggcgttgtgaatgcgacccttatgcaacctgaacgagtctcaccagattggtattggtatgcaaagcatattaaggtaccgacggtgtatgacttggcacgcgaagctggtatgacgacagctgctttcttgtggcctgtcaccgctggtgcacatatcaactggaatattgctgagattttcccaaaccgcatttggactaatcagtacacaacgtcattgcgagcaagttcgccattgttcttactgcaaatggaccgtaagtttggtcatttacgcaatggtattcaacagccagagttggataactttattacggctgctgcggctgatactattcggaccaagaagccaaatcttacgttggttcacttggttgacatggattcacaccggcaccgttatggggttcggacgcaacaagcgtgggatgccttagatcgcttggacaagcacgttggtgacttgattcaagcaactaaagatgcgggcatttttgaagagacagacttcatgattcttggtgatcactatcaacagaacgtctcaaagatgattcacttaaacatgttatttgctaatcgtggttggttgaaggcaacacggaatggtcgtgttgcccgcaattggcaggttattgcgaagcacactgatggtgcgacctacatttatttgaaggatagcactttgcttgatcaagtgaaggatgttgtgaaagacgtaccgggtgttaaagcaatttatgaccatcatgatattgtgacatttggtgccgatccagcggcagcgctgatgattgaaggtgagaagggttactactttaccgatgaaacgcgtcgcccggctgttgtcgaagaagtgacaaacgagatgttggaacgtggcgaagtggatcgttataaaggaacacatggctaccacccagacaatgatgactatacgacgacgttgattttaaacgggccagatatcaaagctggtcaagttttggacttggatgttgatttgacagacgaagggccaacaatggcgcacttgctaaatctacgtttccaaaccccaattgctggtcatacaatcgatcaagcgtttaaggagtaatggatgcgcaaattatttagtaagactgaatggagctggatcttttatgattgggcgaattcaggttatggcattatcgtgataacggcggttttgccgatttggttaacatcggtggctgccaacaacggtatttcggcgacacacgcgacggcgtattggggctatgccaattccatcgcaacattagctggcgcggtgttggcaccaatattaggtgcgttggcagatttccaaggaatgaaggggcggttgttctacttctttacggctttgggtgtgcttggcacgttcgctttgacagcagttccgagtgacaatctgtttctcttgctagctgtctttgtggtatcatttatcgggtactcatctgcaaatgttttctacgatagctacattaccgacgtaacgaccgataaacgcatggatatggtgagttcagctgggtatggctttggctatttaggtggcttagtaccgttcatcatttttatggttggacgtagctttttctcgagctatggctcagttgagttcgcatttgtgctatcagcgatttggtgggcggtgtttacaataccgtttatgaaaaatgtgcgccaaacctatgcgttgccacgggttgaacatcaggttaaagcgtcacttaagcgactttggcataccttacgcgttttgccaaagtatccagcgttagcaggcttcctgattgcttacttcttttatatcgacggagttaatacaatctttacgatggcctcatcttttgctttggctatcggaattccaagtggccagttgattgtggtattgctagttgtacaactaattgcctttccattctcaattgtctacggatggttggcaaatcggtttggtaaccgaaatgttttgattatggggatgctgatttacatcggaattacattatttgctatttttattaatcaccctaatcaattctggctactcgcctttggtgttggttcatcacaaggtggtatgcaggcgttatcacggtcatatcttggtcagcttgtacctaaggaacgaagtagcgaattttttggctttttcaatatttttggtaagttctcggcgattatcggacctgctatttttggaatcgtgtcacaaacgacgggtcgcgtccaatacgcggctggatcattatcaatccttttcttgattggattggttattttcctacgattgcctaagaagacaacagattaaaacacaattgagaggattattgagatgaaaattgcgattgtaacggactcgacggcttatttgagccacgacgaggtcgctgcacttgatatcaaggtaatgcctattccagttattattgatggaacggtttatcgtgaaggtatcgatttaacgactgacgaattttatgagaaactagccacgtccgcaagtttcccatcaacatcacaaccagcggttggtgaatggattacgttatttgagtcgttgcaagcggatggttatgacggtgcaatcgttgttaacctagctgcaacgatttcaggaactgtgaatacggttgctggactaacggatgctgtgccaggcttccaagtgtttggttatgactcaaagatcacagtgcgcttaatggggcacttggtgatgaaggcagctcagatggctcaaaatggtgctgaacctgcagacatcattgcgacgatggatgaaatggctgccacaatggatgaatactttattgtggatgacctacagaatttggtacgtggtggtcgcttgtcaaatgcttctgctatcatcggaacgatgttgaaggtcaagccaattttaacgtttgataacgattcaaattatattgtgccctttgagaaggtacgctcaatgaagaaagccatggcccgcgcagaagagttgtttgaccaggctcgcgcggaggcaaattatcccttgcgtgccatggtaattcatgcgaatgcacctgaagcaggtgcaaagtggcgcgatgagttacaacaacgtcaccctgatatgccatttgaattaacttattttggaccggtgattggtactcacctgggagctggggcattggctctggcttggattcgtgaaccagattcactctaatttatattttgcatttattaagaaggggcatcatttgatgctcctttgttttatacactaaaatatatggttttaaatactagttgtcaggttattaaaccttattaacttgaactaaagccataaaaatggcataatggaagtacttaataaaaaataaacggggattatatcacatggcccaagtaaaaattgttactgactcaacagcaatgttgacacctgaagaagccgcagaatttgatgttaaaatcgtaccattgagcattacgattgatggcacgtcttaccaggatggtgtgacgctatctcgtgtcgaatttatggataagatggcggaggcaaagaatttgccacaaacatcacaaccagcgcttggttactttactgaagtgtatgagtcaattatggcggccgacccagagacccagattatttcaattcatttgactaaggggttgtctggtacagccgacgcggcacgccaggctgcattaatggttgaaggtgatattacaacgctagattctgaatttatcgaccgtgcggaaggattccaagttttggcagctgcgaagttggctgcggccggcgcttcgaaagaagcggttttggctgaaatccaacgcgttcgtgataacacgcaactgtatctgacagtttctaatttagataatttagtagctggtggtcgtctatcgaagacagctgggtttattgccggtgtcttaaatatcaaggttggtgcccacattgagcaaggtaatatcaacgttgaggttaagggacgtggggcgaagtcaactaaagcttatctgaaaaagattgttgagcaaatgcaagcagcccctaatggggttgcagcaattggtatctcacacgcaggtatcccagttgaagcacaggagctagccgacaaggttaatgaagttttcccagacgttaagattgtggttcagcaaacttcaccaactgtctcaacgcacactggtgcaggtgcaattggtttcagttatttattaaagtaatatagtgtttaaaatgagtgatttcacgtttttgtgggttcactcattttttgtgtcacgaaatatggtagaatagtaagtcagaataatgatatcgaggaggcgaaccaagttgaaacaatcaaaacatcaacggtttattttaggacttttggtggtatcggttgcgacgagtctcctaaacgttggccaggtcaacgcggctgagaaatcaaatattcggttggttgcagttggcgattccctaaccgaggggattggcgatacgacaaaacagcaaggctatacaaaacgcacagcaaagttattaaccaaagcttacggcgttcgggtaaaaacggctaattatggtaaggctggtgatcggtctgatcagattttgcggcgggtaaagtctgataaaaaagcggtccgtgatataaaaaaggccgatgtgattgtcatgactgtggggggcaacgacttacaacaaacgctgtttaaagcgatttttgcaaaatcagatacggctgtgacgaaagaagttgttaagagcatgccgacctacactgaaaaacttatgaaactcatgaagttcatccagcaaaagaatccagatgcacccatttttttgtttggtaattacaatcctctctatgtctatttggcaaaccgccaagacttaaatgcggatgttaaaatttacaacggcatcaatgcgaatattgcggccactgattcgcaggtgtactatgtgtcaacatttaaaacattgacttatgggcagtaccaaacgcgtgctgcgcgacagcaattagttaaggaatcagaacaggcaaaccggggctcgcttaacaacaaaatggtgcaggatacgttgaatggtaaaagtgataaggaattaaatgcttatattacaacacttgatcactatcacccgaataataaagggtatgacaaaatgagtaaattgcttgtgaagcgaatggcagaaaaagaatcagaatggctggtgaagtagatgcaacgacgtaaggtaacacgattcggatttgttatgcctagtcgtgatcgcgtacaaggtatcattacaggtgtaggtgccacgattgttgtgatggtattgattgtgattggcttgcttttattgccacaggaccgacaacaagcggtagatacgcaaccgcaactcagtcaggcggcttttgaagtcagcgtcgatcgcactgagcttaatgcgattgttgaaaaatacttaaatgatgatccgtcattaaaaaataaattccgttttgaaatgacaaaaactggcatgatggtatatggtacatacaagctcttgggtcaaaatgtcgattttggtatgaagatgacgccagaagtaacaaaacacggtggcattctattgcatgctgattcggtcgccgttggacaactaccattgcctgttaagtacgttatgggctatatcggcaacatgatgaacttgccagactggttaaacattaacacgtcaaagcaaaccattctcatcgatctcggtaagacgccgaaggttaatgatatgcggtttaaagcggtgacaatcgacccggcccagaacaaatttgttttccgcggaggatttacacgataatgcgacgtccatttttttcatggttgatgacacaacgcaatccggtaacgtttgacgaagtgcaaacatttgccaatgccgcgttttacgaccatcaatttccaaaacaagcggaagattttgaaagcttgtctcgttatttagaagaaaatgcaagttacttgcatagtatgtcgatttttgatgaagcttggtctcgttacttggcatcagaagaataggacgaattggtgggttaccaccatacatagaaaggagtctattatggcccaaattattcaatggttccctggtcacatggccaaagccttccgcttaatgcgtgagaatttaaagtacgttgatattgtgtttgaattggtggatgctcgtatcccagtttcatcacgtaaccctgaactggatgaggtgttggggaacaagccgcgtttgttggtgatgacgaagacagacttggctgatcctgagcgaactaaggcttggactaagtatttcgtggatcaaggccttgaagtcgttgcattagacactcgtggtcacaaaacgccacaaattatgacgaaggctgcgcgcaaggtattagccgataagtgggccgcccttgaagaaaaaggcgtcaaagataagccaattcgtgcccttgttgcaggaattccgaacgttggtaagtcgacgttgttgaatcacttggtcacgaagaatgttgcgattacaggtgatcgtcctggtgtaacaaagaagttgcaatggttgaagacaccgaccaacttggagcttttggacacgccgggagtgttgtggccaaagtttgaagatcaacgtgttggtgagcacctggcgatgactggggcaattaaggaccaattgattaaccaagatgatattgcgttggcgactttaaagtttatgcggacatataatccagctgctatcgtggcacgttatcatttggcagacgacgcttgggaaacgaataccgacgttgaactgttattactgattacccaaaagttaggctttaaggatgattatgatcgcgcggctgaacggatgttgcttgatttgcgtcgtggcaagttaggtacatacacggttgaaatgccagaagatcacatcggagaagtggttgatgactaaagctgagacaatttcagccattaagctagccctggcagcgcagccaacggtagctgatttagtacgctggcgacaggatgaccgaatcggtgtgcaaaagttacttgatcgttacgaaaagcagcaacagaaacaagcagaaaagttggcagcctttcaggctcgactctcatttgaacgcgatgcttggtcggaggggcttgtcttagctggggttgatgaagttgggcgtggcccattagccggtccagtggtggcagcagcagtcgtaattgatgagcaatttgatttgttggcggttcatgattcgaagcaattgtccgagaaagcccgactggccttggatgcggcaattaaagaagaagtggttgccttcgcgtttggtgttgttgatgctgctgatatcgacacattgaatatttatgaggcgtcacgggtggcgatgaaacaggccattgagaatttatccgttcaggtcgatggtttactgattgacgcgatgacggttgatttaccgttgccacaagagaagctaattaaaggtgatgatcggagcatttcaatcggagcagcgtcaattttggctaaaaatttccgtgatgacttaatggcggcgtatgcggttgactatcctggatatggctttgatcacaatgctggttatggtacagctgagcatttggcaggtctagctgcctacggtgtcacaccaatccaccgacgaacgtttgcgccggtgaaacaatacttggcataaacggacttagaaaccgttgaaaaaagaaaaatcacgttgtgtaacgtctttcctggttaggagggatatgatgacacgacgtgattttttattatgggttcgattattaccgggaattggtttaatggggcgtcataaaatttggcaatttttgcaagaaacacagcgccagcgaatgacgttgcaagaaatatttacattgacggaattgtctgctgatacccaaactaaaattagagacgcgatacggtcgggagaactacgccgtgtttacaatttggtcaaacaatactcagtggtcaccttggctgatgatgcctatccagaactactcagagaaattgcccaaccaccactctgtcttttctttcaaggtgatttcgccttggtaaatcagccatgtgtggccattgtgggggcacgtgaattgacgccgtatggtcagcaagtattggcgacgtggctaccgcacttggttagcgcgcaattggtcaccgtatcaggtttagcacgaggtacagacgaagctgtccatcggggcaccatggcgcatggtgggcaaacaatcgctgtgattggaaccggcgttgacgtggcttatccaaagcggcgtgataatttgcaaactcaaatcagtcagcagggactcatcttaagtgagtatttaccatgggagcccccggcaaagcatcactttccggaacgaaaccgcattattgccgggttagcccaagcaactgttatcgttgaagcacgccaaaaatcgggatcgttaattacggccaatgtagctcttgatgaaaatcgggttgtgatggcggtgccaggtccagtgactagcccgctttcggcagggactaacgcattaattgtagcaggcgcaataccgcttatttcgccagcccagattttggcagagtacgttaacgcttggtaaatgtttcacagatgacctagttagcatttgtcaaattctagacaggtagtgtatagtactttagtgatagagcattttaactgctatatatagaagaaaacaaaaaactaacagaaaagaggtccacgccatggcaacagaaacagaaaaaaagccagctaaaaagcgtgcgacgactacgaaagccaaaacaaagtctaaggcgaagccaaagaaaaacttggtaatcgttgagtctccatcgaaagcgaaaacgattgaaaagtatctaggtagcacatataaggtggttgctagtattggccatattcgtgatttgccaaagtcaaccatgggtgttgatatcgagaatgattacgcaccaaagtacattaacattcgtggtaaaggagatgtgatcaaggggctaaagaaagatgcaaaggccgctaaacatgtttacttggcatccgacccggatcgtgaaggtgaggccattgcttggcatttgtcacacattttagatttggatttagagtctggtgaaaaccgagttgtgttcaacgaaatcacgaaagatgcggttaaggacgcttttaagcagccacgtaagattgatatggatcttgtagatgcccaacaggctcgacgtgtcttggatcgtttggttggttactcaatttcaccaattttgtggaagaaggttaaaaaaggcttgtctgctggccgtgtgcaatctgtcgcactagggctcgttattgcacgtgaaaatgaaattcaggccttccaaccggatgagtattggacaatggactcagagttcaagaaggacaaaacgacctttaaagccactttttatggcgttgacggtaagaaattggaattgcccgataatgaagctgttcaagatatcttacgacgccttaatcaaaagagtgattttgatattaccaaggttgaagctaaggaacgcaagcgtaatccacagccggcctttacgacatcaactttgcaacaaactgcgaacacccagttaaacttccgcacccggaaaacaatgatggcggcacaacagttgtatgaaggtatcaacttagggggtaaagagggtagtgttggattaattacctacatgcgtaccgattcaacgcgaatttctgaaatcgccaaggctgatgcgtcaacgtttattcatgaagaatatggtgctgagtacgcagcaactaagccagtccaaggtaagcaacaagaaggtgcccaagatgcccacgaagcaattcgaccaacgtcggttttccggacaccagcgtcgattaaggataagttgacgaatgaccagtttaagttgtatcaactcatctggtcacgttttgtggcaagtcaaatgacgcctgaaattttggataccatggcagttacgattgagcaaaacggggtgatgttccgtgccaatggttcaaagacgaagtttgctggatttacgaaggcgtatccggctgcgaaggaaaaggataacaagctaccaacgttaacggttggcgacttggttcagttggctaaaatgtcacctgaacagcactttacccaaccgcctgcccgctatactgaagcggccttagttaaggcacttgaagagaatggcgttggtcgaccatcaacgtatgctgcgacgattgaaacgattcagaagcgtggctacgtccgaattgatgcgaagaaatttgtgccaaccgaactaggtgagttggtccaaaatacagtgcaagaatttttcccagatgtgacaaacattaaatttacagctgaagttgaaacgagcttagataacgttgaggcaggcaaagaaaattgggtcaaagtgattgacgatttcttcaagccgttttctaaggagttaacgaaagccgaaacggaaatggaaaaaattgtattaaaggaccgtttggctggcttcaattgtgacgtctgtggggcaccgatgcttgaaaagatgggacgctatggtaagttctacgcttgttctcgattccctgattgtcgtaacacacaaacgattgttgaagaaattggacttggttgcccaaagtgtggtatcggacaaattgttgagcgaaagacgaagcgtggtcgcacattttatggttgctcacgttacccagattgtgattttgtctcatgggacaagccaactgagaagacgcgcgctgatggtacgacaccaaaggacgacgaagaagttgcagatactaaggctgaaaaagaaacagagcaggcaaaataaagatggatacggcaacgttgacgggcttgtttttggactatttgcgggttgagcggcaatattctgaggatacccaaaaagcatatcaatcggatattactgaatttgttgcattcttgacggattctggggatggtaaaccagttgatttaactaccatcgatcagtatgatgcacgtgtgtttctgtcgatgctttacgaaaaaggtgacgtcagccggacgattgcgcgcaaagtgagctctttacgggcgttttatcgatttttagagcgcaacgcagttgttacgacaaacccgtttgcaggtgtacaactcaaaaaggctgggcaacatttgccacgatacttttatgagaaagaattgaacaaactttttgacgtcgtcatggctgatacgagcctgctcggattgcgcaatcgattgttactcgagattttatatggcacgggtgcccgtgtatcggaagcagcaggcttaacgttaggcatgctagatcaagctgcccgagtaatcacgataactggtaaggggaataagacgcgcattgtaccatatggtcaatatgcggctgatgcgctagcgagttatttacgtgatgcccgcccacagttgcttgccaaaagtccggttatgcatgacaaactattcgttaatcaacgtggtcaggcattaacggctagcgggattgaatacattctgaagcaattggccaagaaggctggcttgacgcagatgatttccgcgcacatgttccgccacacatatgcaacggatatgctgaataacggtgctgatttgcgaacggtgcaacaactattgggccacagcagtttaagtacaactcagatttatacgcacgtgacaacggatgctttacaaaaaagttaccgtgatttttttccacgagcaacagaataattactttgaggttcatgttacttggcatggacctctttttttcataaacctgtcgattatttatgaaaatcatttacaattcgtgcatagattttatgtaaaaaatttgctatgataaaaatattgaagaaaacgtttacagaacggactgggggaagaagagcatgtcagtcaagctagaaaatgacagtatcaccgtcgtcatttcagaaatgggtgctgaattagtcagtgtgactaataaagaaagtggcctagaatatatgtgggaagccgatcctaatttttggggccgccacgcaccgaaccttttccccattgttgggcgtttaaagggtgatcgttacaagtatcgtgataagacgtactttatggcccaacacggttttgcacgagataatgaatttgatttagttgagaagactgctaatacagcacgcttccgtttggttgataatgatgaatcgttttcgatttatcccttccatttccaatttgacgtgttgtaccgtctgacagagcaagatacgttgggcattgcctatgtggtgacaaacaccgacacgcatgacatttatttctccgttggtggtcacccagggttccgtgcgccactagaagcgggcgaaaagtttacggattactacatcaacgttgaaccacaacgtaagtacaatcgtgccaagttagtcggtccgtacttggacaataatttagaatcaacgtttgacacgcgcattccattgcgtcttcgtcgagatgattataaggacgatgcaatcattctgcgattggaccaaaatccagtgtcgattgttttggccaagttgagtgagtcacacggtgttaccatgcatatccaaaacgcgaagtacgttggtatttggacgccatatgctaaagaggcaccatttgtggcaattgaaccttggtggggaatcgccgacacagttgacgcagatggtgagttgcgccacaagtatggcatcaacacactagcaccagctcaaacatttaccggttcatattcactgacatttttctaacgaacaacaaaaaggagagccaaacggctctcctttttgtttacttattattttgctgacgccaatagccaaaaccaaaatgaaccaatgattctgtaccatttttgatacggacaatattttcacgatgccgatagaacacgaaaatggtcagggcaaccgcaataacagatagcagccaatcatggagccagaagattgaaatcaagctgacgagcgtgaagccgatcattgaggccattgaaaccatcgacgttaacaggataactgtcaaaaagatagcaaaggcaacgacgaatagcagtgggttataagtcaataaaacacccattgaagtggcaactgctttgccacctttgaacccaatccacattgagaaagtgtgaccgagaatggcaccaaggccaactaccatgtgggtccaagcaggagccggtccccaaatcattgccattgacgcacccacagatcccttcaagatatccagaataaggactgccacaccggcttttgtacctaggacacgaaaggtgttggtggttccgatattaccagagccgagttgcaagatgttctttttaaaaaaaagacgtccaatccagtagccaaacggcattgaaccgaaaacataggctaaaatgaaactaataataaaatgcgtaatcgtcacgattaacactcctttgatatgcaattttaaaaagtgaataagtgcatgttctgaaaaacagaacagtttcaattttagcatgattttagtcggccggcctttaataatttttaactaaatccgtgcagattcttggtatgtcactaattattcatgactaagtcgatactagccggttggaattttgactaatttgcgtgcctaactgtcggaaatggtgtatgattaaatcattgaaaaaacaaagaaattggagatttatctgatggctaagatgttggttttcggacaccaaaaccctgatacagacacgattgcttcagcattcgctgcatcatactttttgaacaaggcatacaaccaagatactgaggctgtggctttgggaataccaaatgcagaaacgcaatttgcattgaattactttaaggttgacgcacctcgtgtaattgaaagtgctgacacagaagaagttttcttggttgaccacaatgaagctgcgcaatcagttgcgaacattgcagacgtaactgtttacggtgtgtacgatcaccacaagattaacttctcatcagctgctcctttgtacttcatcaacaagccatggggttctgttgcaactgttttgtactatgagttccaaacagccaacgttgagattcctgctgaaattgctggtttgatggcatcagctatcatttctgacacgttgttgttgaagagcccaacgacaacgccaatggacaagcctgctttggaagccttggctaagattgctggtttggcagattatgaggcttacggtttggagatgttgaaggcaggtactgacttgtcatcacgttcagccaaggaattgattgatggcgatgcaaagtcatttgagttgaatggttcaacggttcgcatcggtcaagtaaacacagttgatgttgaggatgtcttctcacgtcgtgatgaagtggttgcggcgatggaagctgagttggctgaagatggttataacacttttgttttcgttgtgacgaacattttggactcagattcagatattttggttttgggtgataacctggataaggttgaagctgcctttgacgttaagttggcagacggtcgtgcatcattgcctggtgttgtatcacgtaagaagcaagtggtaccaccattgactgacgcttttaacgcttaatatgaatgatagtatggcaaattgttgcgttgatagtttgcctaaaaagacctcatcggtttgtcgatgaggtcttttttgtcatttcagttaataagcgactgtttgcttggattttctcgagacgttggagacgtacctggctttggttgtgccaatggataatctcttggacggagatttcatgcacgacatcttggcccccggaatgaataatgaatgagtgtagtgtcacaaagttgtcagacacactaaaccaattcggcatgaccattttttgatcggcagttgcttgcttatctggccaaacaaagtagcgtgttgtgccagaaacgaggtgcggttcaatttgccaaccgtttgacgggtgcttgacttcttgccaacggccatcggtaatgtttgacgttgcatagttgatgattgcggcaaagtaaagcaactggttatcgtgtagttgcttggttgtaagcggggtgcggtgggactgtgttgattcgggtacggtggttgttgttttttgggttgtcactggtttttctgcctcgtaactgaacagaaaagtgccaaatagtaatagtccaataacggctaacctgactaatattcgcatcacattgttctcctagataagaaatagctggctcgttcaaggattcctaaattcgagccagctattttagttttgataaaagaagtttgaaacactctgaacactgttttgatcaccaacgaagtagagtgtatctccctggaatactttcgcataaggaccgggtgagattgttaatttatcttcatgcataattcccactaaggttgtgcccgttttgtgccaaaaatttagttcacgtagctctttttcaaacatggccgatggtgcggttaaagccaattcaaaaggtgttaagggattgtgctgttgataatgttgtgactgatcgataaatgattgtagggaagtgcctaaagtagctagcgctgcttgttgggctttaatttgatttttgaggtcttgttgtagcgattgtaagccgttcacttcttgttcagtattgacgtagtcttgggctttttgacgggatgtcacaaccacgccgctaccatgacgtgtttcaacaatgcccaaatccactaatacgctaatcgcacgtcgagccgtttcagctgacacaccaaaagttgtggccagagttgagcgagcatgaattttatcacccaccttcaattgattggtgctgattttttctgcaattcgtaatgcaataacgcgatatcgcggttgtttaattgctgccatgggtttacctcgaatttaactgtttatcactgcaacaattggcgaagatctagaacctttaccatttatatgttgccttcgccctttcagaatagcacacttgttttctattggacaacttttcccgtgcgataaataaaattggtataccatcaaagcgttagcttaatgatagcatttgtaccgtatatgcaacacggcggtacaggcgtttgaatttgacctaagtgacaactttatgtttacaatagagttgtcacttagcgaaagtgagagtattcgatcaagtaggaggagagttatggctaaggtagaaatagagcacttaaccaagatttttggtaagcgaatcaaaccagcattgcagttggtagaaaaacaagtaccaaaaacagaaatattaaagcgtactggtgcgacagttggtgtttatgatgctaacttgtcaattgaggaaggtgaaattttcgtgattatgggactttcagggtctggtaagtcaacgttaatccgcttattaaaccgtttgattgaaccaacttcaggttcaattttccttgatggacaagatgtctctaaactaaacaaggaacaattattggatgttcgtcgcaagaagatgagcatggtcttccaaagtttcgggttattcccgcatcgaacgattctagaaaatactgagtatggtctagaagtgcagggcgtgccaaaggccgaacgtcgtgaacgcgctgagaaagcgctggacaacgcaaatttgttggccttcaaggatcaatatcctaagcaactatcaggtgggatgcaacaacgtgttggattggcccgtgctttggcaaacgaccctgaaattttgctgatggacgaagcgttttcggctttggatccgttgattcgtcgtgatatgcaagatgaattgcttgatttacaagcaaagtttcaaaagacaattatttttatttcccacgatttgaatgaagcgcttcgtatcggtgatcgcattgcgattatgaaggacggacaagtccaacaagttggtacgggagaagaaattctgacgaacccagcgaacgattacgtgcgtgagtttattgaagatgttgaccgttcaaaggttttgacggctgaaaacattatgattccaccaatttatacgaacatcgaagttgatggtcccaatgtggcgcttaagaagatgcgtgttgaagaagtcagtggcttagttgccattgatcgtggccgtcatttccgtggctttgttaccagtgaagatgccttgcgtgctcgtgcggaagggttgccattatctgaagtggcgactgaaatgccaacggttgcgaaggacatggttgtggcagatattatgccacttatttatgattcaccaaccccattagcggtggttgatgaaggacgtctacgaggcgttatcatccgtggtcgagtgcttgaagcgctggcagagacatcggaaacggaggacaactaatttatgacattattaattggaaaaattcccgtcgcgggttgggtcgagtcggccgttaattggttaacgtcaaacctgagtggcttctttgacgccattcaaaccggtggtaatcatttgatgaacgggatgacaaatggcttgattgctatgccatcttgggcagttattattggcgttaccatatttgccattttatcttctgggaaaaagtggggctttgcggcctttacattcctagggttattgtttattgccaatcaaaatttgtggtctgatttgatgaacacattgactttggttgtggtatcaagtttagtatcgattgttatcggtgtcccattgggaatctggatggcaaaaaaggaaacagttgctaagattgtgcaaccggtcttggactttatgcaaaccatgcctggatttgtgtacctaattccggcggttgctttctttggaattggggtagtgcctggtgtatttgcgtcagttattttcgcattaccaccaacagtgcgaatgtcaaatttgggtatccgacaggtaccgaaagacttggttgaagcggccgattcttacggttcaacacctaagcaaaaattatttaagttagagttacctttggcgactgggacgattttagctggtattaatcaaacgattatgttggcattgtcaatggttgtgattgcctcaatgattggtgcaccaggacttggtcgtggtgtattgtcagcggttcaaaacgctgatattggtaagggattcgttaatgggctagccttagttattctggccattattattgatcgctttacacagaagttgaatgttgacccagcggctaaacaacaagcgtcaaagggtcgttggaagatgtggacagcattagcagttgctgtggctatggttggaaccggcgttatcaatgcagttacttcaactaagtcagccaaagaatctgttaatttggtttatgtacaatgggattcggaagttgcttcaagcaatgttttagccgaggcaatgcgtgaacatggctataacgttaagttaacgccacttgataattcgattatgtggcaatctgtggctaatggacaagcggatgcatccgtgtctgcctggttacctaatacacacgctgcacaatataagaagtacaaagatcaaattgatttattaggaccaaatttgactggcgccacaactggttttgtcgtgccaagctacatgaatgttcagtcgatttcagacttgaccacacaagcaggtaagactgtaaccgggattgagccgggggctggtgtgatgaagtctgctgacaaagctctggcagactatggtcttaaggaacagggatggacggtcacgccatcatcatcaggtgccatggcagttgcgttaggtaaggcgattaaagaacataaggacatcgtgattacggggtggcagccccactggatgttccaaaagtatgatttgaagtatctgaaggatccaaagcaagcatttggtaaggcagaatcactcaatacgtttacgcgtaagggattgaaagctgataagccagacgtgtataaggttttgaagaacttccattggaccaaagaagatatgggtgaagtaatgctcgcaacttcaaatggtaaatcagcgaaggaagctgccaaggattggattaaggcacaccctaagcaggttgatgcttggttcaagtaataggaggatgtatgaccgaacaaattgaggatgcctgtatctatttcgtggtactggcagtagtgattattatcagtatgacgttattagcagacaagtctttgtttgcacaagcaatgttgcttttaggagcaatgacgggaaccgtcatgcttgttaaacaatggcgtgacaattaatgaggttataaaacccgagacaaggaattcgcttgtctcgggttttttcgtctactcatttaaaaaatagcttgacgtatttgctcagtaagttacaattagtttgtgagttatctaatttatcggacttatttacacttgtaaatggaacaaacggttgtttcatcagtgggtttagttgtgaataatgtcgataaatagttgttgataattgcacaatgataataattgaaaaatattgtggggtatataacatgaaaattgcagtaattggtagcacacacgcaggaaccttttcagcgacgcaaattaaacaattgcatcctgaggctgacattacggtttatgaacagcacacgacggtgtcgttcctgtcatgtgggattgctttatgggtaggtaatcacgtttcggatgaacaacgtatgttttatgaaacaccagcttcaatgactgaacaaggaattacaatgaaaatgcaacaccaagttgttgaagccgacttggtaaacaagcgtattcgggctaagaatctattgaccggtgattttgcagatgagacgtttgataaaattgttattacaactggttcaaagccattagtcccaaagattccaggcatcgataatgataaaatttatatggtgaaatcttgggaagacgctaaccgaattaaggaagtggcggatgatgtgaaacgtgtggttgtaattggtgcaggttacattggggccgaaattgcagagcaattttcagtaactggtaagaaagttacgctaatcgatggttttgatcgcgtgttgcctaagaacttcagtccagtaattactgatcgtctggaagcggcgttccaggacaacgatgtcacattagctttgcaacaactggtaactggctttgaagatgccacagatggtggtattcgagtgacaactaatcaaggtgcttacgaggcggatatcgcggtacttgggattggtttcttaccaaatacggacttgtttaagggccaagttgatatgctgccaaacggggccatcttaacgaatgcttatatggaaacaagtttgcctgacgtttatgccgctggtgatgccacgactgttttctacaatccaacgcaagcctatgactatattccattagccacgaatgcgattcgccaggggatgctcgttgcacgcaacattgatggtcatcacctggcttactcagggacgcaagcaacgtcggcagtggagttgtatggttatgctatgtcagcaacaggattgaacaagggttctgctgaggcgcggggcttagatgtcgttgaaacagttcatgaggaagattatcgacctgattttatgttgtcgacgacaccagtgttatcaacgttaacttgggatcgcaaaacacgacgagtgctgggggcggcctttatgtcaaagcatgacattacgcaagcggcgaatgttgtctcattggccattcaaaatcaaatgaccattgacgatttggcgatggctgatttcttcttccaacctaactttacgcaaccggttaattttgtaggtgcaacggccttacaagcggttagtgatgcacaaaacaaaaattaatcctaataaaagcttgacaataaaatgaggattgtctaatataatactcatagaaaaaacgaataaatagttagtaaaaacaagatgatcaggaaagtacgattactagcaaagtgcagagagttacgggtggtgagacgtagcgtgcggtagtactcagaaaatggcctgtgattgggtgttgtgaatggcaagttcataagcgacacacgggtggttaccgttaacaaacacgcgtatcgacatagcatcatttcgctccctgtccgcacgttgtgaggcttttcaggtgactgaccaagcgaatttagaatggtaccacgggcttaaaccgtttctatacttctcatattgagaatgtgtatagaaacggtttttttatttacaactaggggtggagattatgacaattaataaaaagcaagtattagtatcagcagtggcagtggctggtttagcagctgcagtggctttgtatgtaacaaatgatggggcagtttccgctgcgaacgaaaagactgtaaccgttggcttggttggagattccgaccgtcaattatgggaatatgtcaaaaaagatgcgcagaagaagtatggcatcgatgtgaagttgaagttgttcacggattacgttaagccaaatcaagcattagttgatggttcgatcgatttgaattcattccaaacgattaattatttcgatgtgcaaaataagcattttaagaataagttagtggggattggtaagacgtatgtgacaccaattcgcatctattctgataatcacaagtctttgaaggatttgccagaaaaagcaacgattatcgtaccgaatgacgcatcgaatgaaaaacgtgcgttggatgtcctagaggccgcgggattgattaaatacaaccatgacgccaagttgccaactgctcaggatgtaacggagaacaagaaacatttccaaattaaggaagtttcttcagaccaaactgctgccgcattgaagagtgctgatgcggcagttgttaataccaattacgcccttgatgcaaagttggatattgacaaggcgttgttcgtggaaccggttaataaagctaacaagggttacattaacatcattgctgcacgtaagggtacgcaaaataaaaaggtgtacaagcaagtggttaaaacctatcaaaccgaggctaccaagaagcacatgaagcagctatacggctcagcagaaatccctgcgtgggatatcaagttaaagtaatttagggggataacaatatggcagaacaaacagcaatttttgcaggtggatgtttttggtgcatggtccaaccgtttgaaacattaacaggtatttcactcgtccgatctggctacacaggtggtcataaagataatccaacctatgaagaagttaaggcacaccaaacaggtcacaccgaagccgtaaaagtttggtttgacgatgctgtaatctcatacgaagatttggtcgccttatattggcagacggcagatccgactgatgcgatggggcagtttgaagatcgcggtgacaattaccgacctgtgatttttgttaattcacctgagcaacgacagattgctgaggcgtctaaagccgctttgcaagaatcgggcatttttggagatgatttgattgtgacaacgattgaagatgccacaactttctgggaagctgaagaatatcaccaggaattctatcgtaaaaacgttgaacgctacaacgaagaaaagcaatcacgtgatgcatacaaagagaagttctggggtagcacaacacactaaccacgtaacagaccacacaactcggctgggttgtgtggtttttttgaaggaattatgatgagacatggatgttgctgactaaatcgtatgaattttgtatactatctaatggagtaaatgaaagagagatgacgatagcatgcattttacgtttttggtcaacccagcggcgagttctggacaagctgttgcaagttggcaagtgcttgaatcgtacctgaaggagcaagcaacggactacgaagtgcgcttttcgcaacgcacaggtgatattaaagaatggacacgcctgtttgcaaagtatcaacaggcttcggatcaaacactcgtcatcgtgggcggggatggttcgctcaatgaagcaataaatggtgctatggcgtacagcaatgcaaatcagttaccgttggcttatattcctgctgggtcaggcaatgactttgcacgagcccgtcaattaccaactgacccagttgcgggctttaaacggattctgaccaacatgaccgctggtacaccagaacgaatcgatattggtgaatatgtggatgcgattaagcgggaacatcgctacttcgtgaataatgttggcattgggtttgatgcaacaacggtcaaattagctaacgcatccacacacaagaaaatattgaataaattaaagttaggtaaattagtctatttgtcagcactcttcaagacatttagtctgcaagatactttccaaatcgagttagatgttaatcagcgccggcattactttaatcgcggctacttactgacattatcaaatcatccatattttggcgggggcattaaaattatgccggatgccgatgaaagagacggtttaattgacttgattgtgattgagcgtcccaaagtgtttattaaactattcgtcattctagcgcaattgatacgcggtaaacactatcagtacaaggaagttcatcgctttacggctacccaaattcgcattcgaacagcgcggttagaatttggccatgccgacggtgaagaacttggctcgcgggcgtttgatatggtagcaacaacgcagccttatccattttggtaatattgaccggaattttggacatttcattaaaatgtgaaaaaacagtgttacactgattaagtgagtttttgtgcaatttttttagaaagaaggcattcgtatggcaacgctcttggagttgttcgcgacgacgcttgtgctatatctcttgacgtatgcatatgttaagtgggactggcataaggcctaacgacttaaaaaacaggtagcttttggctgcctgtttttgttacactgagaatatgaaagtggggtcgtgatagtgtataaacatttgatttttgatttagatgatactttattggatttccgtaaaggcgaagaggttggtttgttgaatgtttttcgtgatcacgaagtgccagatgttcgccaagcgtttgataagtatcaacaaattaatcggggattatggtcggcttatgaacgtggtgaaattagtaaggaccaaatccacaatacccggtttgcaacgctgtttgatcaatttggtcgtgatgtcgatggtgttgcacttgaaaaagagtaccgtggatatttaaatgagaattactatgttttggatggcgcggaggcgctattgcaacaattgaccaagcaaggatataaattgattgcgggcacaaacggggagcaacacacgcaggaacaacgtatggcccataccggctttatgaagtactttgatgatatggtgacatcggatgaaattggccatgctaaaccggccacggagtttttcgatgcgatatttaacaagcaaccggctatgacgcgcagcaacacaattatgattggtgatggcctggcatcggacattcagggcggcaaccgttatcaccttgatacgctttgggtcaacttacaccaagtggcaaacaacacgccatatcaagcaacatacgaagttaatcaattagacacaattccagacattgtgcgacgataattcaaaaatatcaaaccatccccttaaataaagtggatggttttctttttggcagcatacagcggtcaaacacctggcatataatgaatgataaagaaacatgctaggaggggattccgatggaacaaacaaatggggttgttatttatgcatcaaaatatggcacaactgagaggtatgcgcaggctttcgcaacgctgatggggttacctttgtgtgacttgaagcaatgtcaagccttagcgagtgagccaggtattgagaaagtttatgtctttgcgccaatttaccgacgggttattatgggactaccagagatttcgcatgtgttcgatccggcgaaggttgtcaaagtgtttgtcgttgggatgacatcaccagaagaccacgccacgattcatttcttacaggaacaaatgctggattatatgccaaatgccaccatgcaacttttgggtggcaaaattgtctttgacgacattagtatgtcagataagatgttgctgcgggtgatgtacggttttgaaaagcgtaaggcgctagcagatcgcacaccaactgaacagcgacttgttgaaatgtttgaagagggtaaggctgatatgaccgatatgactaaaattcatgatgcggtatcgttgcttgaatagggagtcagttagggtggtgtttacatgaaacgttttgcgtcaccaattgtatatggcgggttagatggcattattaccacttttgcggtcgttgccggctccgttggtggagatatttccaatgtggtcattatcatcttgggtttttctaacttattggccgatggattttcaatggctgcaggtgcctacttatctgcaacggccggtaagacaaaacgggcggcgtttgaggatggcgtggccacatttttgtcctttaatgtttttgggttaattccgttgagtgcttacttaattgtaaatgctgtgattcatagtccaactgtggcttttccaatctcgttcctgattgtaggggtagctttggcgctgctggggatggtcaaagctgaattgaccaataaatcaaaacgggctgaaattgggttaacattactcgttggttatgtggcagccagcgttgcttatggaattggcgcattattaaattatttgctatagaaaaagcgagtttaccggttatgggtaaactcgctttttgttattaacggcctagatcaaaatgaacataggaagaattaatgggcgacgcttagtcttctcgtataagaagcgttgtagttgtgacacaaccgcattgcgaatactgtgctcgctagcgtttggttcacgcatcgctgttagaatcgcgtggaaaatttccttgcgaccttcattgatcaagtcttctgactcacgcatgtagataaagccacgtgacaaaatatcaggaccggctgtgatttcttggttcttcaagtcaattgttgcgaccacaacaaccaaaccgtcttgtgacaacatttggcgatcacgcaacacggcagaaccaacatcaccaataccgtttccatcgacatacgtgtcttcggcaggaatgtggtctgcaacgcgagctgaatcagcggtcaaagcaaggacatccccgttatcaaggacaaacgtgttttcctttggcacaccaacttcatgactcatgccttcgtgaaccttcaacatccggtactcaccgtgaacaggcataaagtactttggcttaatcaaagataacattaacttttgctcttcttgaccaccgtgaccagaagcgtgaatgttgttgattttaccgtggataacagtggcaccagcttcctcaagttcgttaatgacgcggttaacagattgtgtgttaccaggaattggtgaacttgagaagataacggtgtcatccggttggattgaaatctgcttgtgtgtaccgttagcaatgcgggccaaggcagccattggctctccctgtgatcccgttgacaaaatcaagacctcgttagcaggaaggtgattgatttcgtgcgcatcaaccaacatttcttttggaatatccaagtagccaagggccaaaccattcgttacggcgctttccattgaacggccgaagacggcaatcttgcgtccgtgggcgagggcagcttcagtcgccatttgcacacgtgacatgtttgatgcgaacgtggcaaaaataatgcggccatcgatttcatcaaacaacttgtcaattgtcttacccacccaacgttctgactttgaaaactcagctcgttcggcgttcgttgagtcagacattaatagtaggacaccttcagaaccgatgcgggccatcttttgtacgttaggtggctgcttagttgttggggtgaagtcgaacttgaaatcaccagtctcaacgattgttcctgatggcgtatgcactgcaattccgaatgtatctggaatcgagtgcgtcgtacggaagaattcaacactcatgttgtcaaacttaagaacagtatcttcatcaatttcgtgaagttcggtactgtttaacaatccgtgctcatccaacttgttcttaattaatgccaaggcgagagggccagcatatacagggacgttaactgcgttcaagaaaaagtgaatggccccaatgtggtcttcgtgaccgtgggtgataaccaaagctttaatcttgtcgcggttttccttgaggtaggtgtaatcaggaatcacataatcaattcctaatagttcatcttctggaaacttaacaccggcatcgacgacgatgatttcatcaccaaattgaataccataagtgttctttccaatttccccaaggccaccaagcgcatatactgcagtctcgtctggacgaatatccagattcatgaccatattagaactccgtcaacttaaagttggggctttgttgctcgtaagccaaagccttttctgacaattgttcaatcaattcaacattgtagtctgtgtttgactcaactgctaaacgtgcagcgggttggtcagcagcatcaatgtaaagtgattgcgtgttttcacgctttgggttttgtgtcttagtaggttggtagtaaaccttaaaaatcataatcggttaatctccttaatttattactgtcttgtaccgaacaatcttaaaactaattttatcagaaataccgtccaaataccatattcaacgaaaccaaggcacatgtatcctaaatatatttgaaatcatgcatcagatttgggtagtcgttttttatccgcttttcggttaaacttgaggtaatgaagacggaggacagcaaagatgagtaagaacatctggggaaaaataaaagataatgtccgcggcgtacaaggaaagttcaagcgttcttatgtgccaacaacgacaccagaagaagtggcgctggctaatcaactgaaaatgacgttaccatcaaccattgcaacttacatttatgtcagtggggaatgggataccatggcaaatcgtgcactaagtggttcagtcatcttatcaactgatacgccggctgaacagaatgccgtgcgacatcaagcaatttcatccgcctatgaggcagaattgtttgcaatggtcgatgcgttgtcagccattgatttggttaagcgtcaaacgggccactttgttcttgtaactgggttaacagatttcgttcgtaattataacgatttcacgttagcgcaacatttttcagaattgccagaacgaccaacttcaacggatcgcctttatcatgattttgtccaattggcggcgacgtaccaatcgttacgggttgttgctggtagtgaaaaggataagcaacaaacgaatttcgtggcccaaaagttaaatcgtatgctggcgggctaccgcgattcacgaggtaagtaatcatgtggttagtttgggtggctttattagttgggttactgttggtggcattaaccatctaccgacgatatggacgtcgtttgactgaacgacagattattgcctcacaacaagttgttaatgctggtatgaccgtcgcgctccaggaattagccaatgacttgctgctgttcacaatggaacgaccaacttcaacgttggtggctaatatttggggccatgaagtcatggcattcgaattcgaactaccataccgggagcgccaagaagttgtcgtggtccgacaagcgttgaataatgcgctacgtgactatgcgcaggatgaaaatctagtcagtgcgtcagagaccgatatggcgttggttgtgacggacgtctggtatgacaaccgtaagccaatgttgcacgtcgatgtcgcacatattgttaatgaagaaacggctgcgtatttacgagatttacgtaagttgaatcaaccggtctagagtttgctatactagtattattaataatttttttgtaggagatgagcagatgtatttgatgaaagatatcgtccgtgatggcgatcctgtgttgcgtcaacaagcagctaaggtgactttccctttgtcagatgaggtaaaggaagcaactaagaacatgatggagtacttagttgtctcacaaaacgaagaagagaacgagaagtatggtcttcgtccaggcgttggacttgcggcaccacaagttggcatttcacaacaattttcatcaattttgattcctgatgaagatgttgacgatactgacatcgatgaagatgcggccccaacgtatttctttaaaggaacgatttataatccagtcatcacgcgtcagtctgttaagcaaacggctttgtcaatgggtgaagggtgcttgtcagtcgatgaagatattcctggatatgtagagcgtgcttaccggattaccgttaagtatcaagatgaaaatggcgatgcgcaagaattgaagttggaaggctacccagccatcgtattccaacacgaaattgaccatttgcatggcacgctatactacgatcacatcagcaagacggcgccatgggatgaaactgatggcacacgttacattgggtaattcgtatggcaaacggtgattcgaattttaattacccaatgttagacggttggtcaacggctgatattattgccgttagtggtctatattctgctgtagctacggcctatgaatctgggattgatcgattgaaattattagcggcctacgatgcgtttaagcaagttgtccctagtaaagctgaagaaaagcaacttgatcgggaatttggtggtgagtcagggtatagtatctatcgcaccatccaagccgcaaagcaaagtgataagaaacagctaaaaatggaaggctaacggtatgaatgaagcgcaattaaaaaagcttgatcagactgtattaggttggttggacacggtacacgatacggtgctcaaacgcgtcacgcagcgcatgcgcgtggatacaaaagcaggtcatcgcgatttagtcactaatgtggaccgcgagacagaacaattttatgttgatgcgattcgtcgttttgatcctaaagcaaaaattcttggtgaagaaggttttggggatgcggttaacgacatggccggccgagtttggtttgttgacccaatcgacgggacgatgaattttgtgaagcaacaggcagaatttgcaacaatgttggcattgtatgaagatggtcagccagtgatggcttggattatggatgttgttaaccatgacatcgtccacggtggtccggcatacggggtgtatcacaacgacacaccgctggcgacaccaaaagatacaggcttggctgacggattgattattttgtctggtgcacgcctgctatatgagcaatttgggtttcctgaagtggcgaaggccgctttagggttccgtgtgtatggctcggcgggcatttcttatctacatgttctgacgggtaaggccgttggatatgccagcaatatgaagccgtgggactatgctgcggggacattgcttggtgaagctttagggtttaaagtcggaaaaattgacgaccaacctatgaatatgttaatatcaggaacagttctagtggcaacacaacaagcatatagtgatattatggcaattgaacgtgacctttaatgcttatttctataggtgggccgcgtgtaagcggctcacttttgttagttgttacaccgattagagtaaaaaagtgacgtatagtcaaggagaattaggattttggcaaagcgcgaaaacatccgtaacattgcaattattgcccacgtcgaccacggtaagacgacgttggttaatgaattgttgaagcaatcagacacgcttgatatgcgtactgaacttggcgatcgtgccatggacacaaacgatcttgaaaaggaacgtggaatcacgatcttggccaagaacacggccgttaaggttggcgacaagcaaattaacatcttggatacgccagggcacgcggacttcggtggtgaagttgagcgtatcatgggtatggttgacggtgttttgttggttgttgatgcctttgaaggtacgatgccacaaactcgtttcgttttgaagaaggcctttgagcaaaacttgacgccaatcgttgttgtgaacaaggttgaccgtccaggtgctcgtcctaacgaagttgttgatgaagtgcttgatttgtttatcgaattgggtgcggatgaagatcaattggaattcccagttatcttcgcttcagctatgaacggaacatcatcattggatgctgacttggctacgcaagagcacacaatgacaccaatcttcgacactgttttcgaaacgattcctgccccagaagataactcagacgagccattgcaattccaagtttcattgttggattacaacgatttcgttggacgtatcggtgttggacgtgtcttccgtggtaagatcaaggtcggagataacgttacggttatgaagcttgatggtacgcaccaaaacttccgtgtaacgaagttgtttggtttcattggtttggaccgtgttgaaattaacgaagctattgctggtgatttgattgctctttcaggtatggaagaaatttcagttggtgaaacggttgttgatccagcccacttggatgctttgccaattttgcgtattgacgaaccaacgttgcaaatgacgttccgtacgaacgattcaccatttgctggtcgcgaaggtaagtttgtgacggctcgccagttggaagatcgtttgcgtcgcgaattgcacactgacgtttcattgcgtgttgatgacactgatgaagctggtgcatggttggtatcaggacgtggtgagttgcacttgtcaatcttgatcgaaaacttgcgtcgtgaaggctttgaattgcaagtttcacgtccacaagttatcttcaaggagattgatggcgttgaatcagaaccattcgaagcagttcaaattgatacacctgacgagtactcaggttcagttatcgattcattgaaccaacgtaagggtgaaatgcgcaacatggagccaactggtacgggtacgactcgtatggagtggttggtaccttcacgtggtttgatcggttactcaactgagttcatgtcattgacgcgcggttacggtatctacaaccacacgtacgagacgtacgcaccggttgttaagaactggaaccctggtcgtcgtaacggtactttggtttcaattaaccaaggaactgcaacgacttacgctatcatgggagttgaagatcgtggaacgatgttcatccacccaggtgatgatatctatgaaggaatggttgttggtatgaacagccgtgacaacgatatctcagttaacgttaccaaggccaagaaccaaactaacgttcgttcatcaaacaaggaccaaactgcctcaatcaagacgccacgtgatatgacgcttgaagagtcattggaattcttggatgacgatgaatacgctgaagtaacgccagaacacgttcgtatccgtaagcaaattttggttacggctgagcgtgagaaggctgctaagcgtcgtaagattgcccaacaaggctaatctattaaaatagactaagaaaactcctgtggaccagattgctggtcacaggagttttttgtaatttcatgaaggcctgagaggaactgctagttttgtgctaaaattataagagcaattaaagacagtaaaggggttctcctatgcaaaaaattaacgcacggcggggcagtctatctgtcttttggcgtgaagtgttaaaaatgattgtgaaacaagttaaatacatggacatccagatgttaatcgcaatcgttgccttgatggtcttcgggacgggaatggtattcacgtcgagtactaacatggcgagtggttccgcgttaagcttttttggaaaacaagtcctttttgcaattattgcattgatcgcaatgattgtgatgaccgttatcccaattcggtggcattcaaaaggtatcagcaagataattgtgttctcagtttatattttaattggtgtactgatttacacgttcctatttaccgaccctgtgtctggggccaagggctggattaattttgggtttctatcatttcaaccggtcgaatattttaaaattgctttgattttatggtttgcttaccgcttttcacatcggcaacttgattcgagtcgaacctggcatagtattcgtgagcgattgaatattcatgatattttgccaccgttatttggtgtgattctatctgttgcgatgcctgacatgggtggtgcggctatcttaacatttattattctgacgatggtctttacgtcagggataaaagtacggggcttgagtttctatattttggcaatcgtcgcctttttggttgctttaccgtatttgctaccgataattagtaagactggcttgatggcttaccaattaaagcgattggaaacatatgccaatccctgggcagatttagacagtggtcaccaattgattaattcttactatgccattagcaatggtggcttatttgggcgcggccttggtaatagtattcaaaaaacgggttatttgccagagccgaataccgatttcattatggcggtagttggtgaagaattgggggctgtgtcaattttgattgtgttagccgtatttggtttcatcttatggcgactcattcactttgcactccagacgccaagcatgcagtaccgcttgatgttgtatggtatctcagcctacatcaccattcaaattttaattaatttaggtggggttgtcggattgctgccaattactggggtgactttcccaatgatttcgtatggtggatcatcattattgtcatggggaataacgtttggcattgcatttaatgttatcggtttgattaaacaacaacaagaatacgaaaaggagcgtgcgtcggtatgacatttgaagttacccagcggcgcagtgtcattgtccacctaaagaatgtgcgacaggcacgccaattacggcgctttggcgtggtgagttatatttcagaaaaaatgaagtatgctgtcatttatatgaacgaagcagatgtcactacaaaatctgcgttgattgagcgattgggttttgtgtcatcagtagagttatcacactggccagacgtggataccacggtaggtagccaaggtgacggctttgaattatctgttgatccatcagaattggctgatgaaccagctgaagaagaggaattataatgcgtattgttagtggggaatttggtggtcgtcctctaaaggcggtcccaggtgatgcaacgcgaccaacgacagataaggttaaagaagctatttttagcatgattggcccttattttgacggtggacgctcattagatttgtatgccggttcaggaggcttgagtattgaaggcgtgtcacgaggcttagatgaagcggtattggttgatcgtcagtttgcagccattaagacgattaatgacaacattgcggttacaaaggcaccagaaaaatttacggttattaagagtacagcagacgctgccattcaacgtttgatgggatcgacaccatttgatgtcttatattttgacccaccatacgctaagcaaactattttggccgatttggccaagctgcaagccgcaaacttgattgcaccagatgcgttggttgttacagagacggatcagttcgcgaatttaccagaggacataccagggttcagtttcattaagcaaaaagattatggcatcactgttgtgacgctttatcaatatgagggggagtaaatatgcgtcgggtattgtttccaggaagttttgatccatttacaaatgggcatttagatgttgttcgtcgtgcgtcgaagttgtttgatgaagtggtcatcggcgtaggtacaaacaaaatgaagaagtatttattttctcctgaagaaaagattcggttaattgaggcgtcgacggctgatttacccaatgtgtcagtacgcgaaatgacaggcctcacggttgactacatgaaagagattgcagccgatacattggtgcgtggtttacgtaacgaaacggactacttgtacgaacgtgatattgcagaaatgaatcactatttaggcacagttgaaactgtttttttgatggcacgaccagaacaccaaaatatctctagctcaattttgaaagaagttgtcagtttcggcgctgacgtacatgaccttgtgcctgcgccagtagccgctgctttaattgaaaaagtgcaaggtaagtaatatggcgaaagcaactcataagaaacgacgttggcttaaaatatccggcattattgtcggcattttaatgttgctagttttagtttgcccattacccttgtatgctgaaacgcctggagaagctgatgatttgagtcattacattaaagtcgatggtaaaaagccaaaacttgatggtcagtttatgattacagcagtttacatgtcacaagtgaacggtattggtgccatcatggcttggctagatccaacggcatcgctgatgacatcttatgaggcgaacggtggcggttcatctgcagataacgtcgccattaacaagatttatatggattcagctgtcaacgaagctaaggcaacggcctataaagcagcaaaaattccttataaacgttcctttaacggtatttatgtgatggcggttcaggacaattctaattttaaaaaggctttaaaagtgggtgatacgattacttcagttgataatcatcacttcaaatctgcgaagggttttcaggattacattcggtcaaataaagttggatcgaaactaacaatttcctatgagcggaataagaaagctaaacaggcaactggaaagtcagtggcactagccggtactaaaaagttgccaggaattggtatcgccctgacagatgatgtgtcggttagttcagcacgtaaagtctcagccaacatgggcgatatcggtggcccatcgggtggcttgatgttttcgctggaaatgtatgacgccttgtcgaaccaaaatctagccgccggccgtaagattgctgggacaggtacaattgataaggacggcaatgttggtgaaattggtggtatcgataagaaagttattgttgcccatgaggcaggtgccaaaattttcttcgcaccatatttaaagccaactaagagtaacttggcgctggagtcagatggtttaaccaattatcaattggctgttaaaacggccaagaaatatgcaccgaatatgaagattgtgccggttaagacctttactgaagcagttaactatttgcaaacccattaaattaagaatgactgtgtgttttgacaggattggaaaattctgttaatttagtacaagttgtttcgtacagatagctcgttaagagccgaacacagaggcgtaacatcattgcgattagcagtggtgtcgcgccttttttattttttttaggaggtcgataggagatgcaagcaaaggaatggcacgtacttagagccgtactagctgccgggattatgagttttagtggtgttttgattgaaacgtcaatgaatgtcacgttccctgagttgatgcatgagtttagcacgacagcaaatggtattcagtgggtaacaacgggttatttacttgcgattgcagttattgtaccggtgtctgcatttttgattcgtaattttgcgccacgccgactttttattattgcgaatttagcctttattctcggggtgcttactgacgcctttgcaccaagtttgggtgtgctgttagttgggcgtgttttacaaggtattggaacaggaatcgcgctaccgctgatgtttcatattatcttaactaagtcgcccagtgatcgacgtggtgtgatgatgggcattgggacgatgacaacttcgattgcccctgccatcggccccacgtatggtggtgtattgctaaatagtctaggctggcgtgctattttttggtttttgattgtactcttagtcatttccctggtgatgggattaaccagtatgcccattgaatcagttgaaaaaactgaaaaatttgccttgccggcctttataacgctaggtctcgggttaggatttttgttaattgcaatcgaaaaaatgtcactgctatggattatcattgctttggttgtgttggtaatttacttccaattcaataagcgccagcccttgcttcgtttgagtattttgcgtaaccgcaagtttaatgcgtttctttacagctttttggtttaccaagccattttgttggggctgtcattcattttgccaaactatttgcaacttggtatgcacgttagcgccacggccgctggattgtttatgtttcctggggctgtgattggttcagttctggcaccaatttctggtcgcttgttagatcgggtgggcgctacgaaaccaattttgacgggtgtaacgattgcaacaatcgctttgctgctaatggcggggttgtttggacaattaaacttctggttactgatggcagtacacatgttattgatggttgggattggactgtcatatgccaacctgatgacgattacattggcaacgttgcctgctgccgataacgccgatggcaacagcattttgaatacgttaacccagtttattggcgctagtgccacggcggttgttgcccagatctttgcaagtgctgtggcagcgcatgcgaataccggggtcgtccgcggatcgcaactaggtgtggtcgtattagcagtgcttgtagttgtatcattagttgtatttataattaatcgtccccaaaaataagctgaaattcgactaaatacacggtataatacgggtaggcaattaaagctacgggggacaggaacatgacaacagaaaatgaattggattatcccattatcttggcagctgtggacgactctgagttaggtcaattaacgttggctaacgctatccaccaagcccatgaggatggtgcagtgctgattatcgcgtctatttttgaaaaagatcagttaaatgtgtttgatgcgctttcaaaggagcgcaccactgatgcgcgcgccgacgtcgaaaatgccctgaaacgataccggcaagaggcccttgatgcaggtgtcaaaacggtcgcaactgtcttgcgtgacggtgagccaggtaaagtgattgtccgtgacatcattccagttattaaacctaatttggttgtaatcggggcacactcgaaacgaacgctttctgatcgctattttgggacacagtcgggctacgttgcagcgaatgcgccggttacggtcatggttgtacggcaataaacaaattatcagctaactgtggaaaccggttgataaatttctaaaaggcaccaattgttgttttgagacagtgggtgtctttttttctggcgtcgctatgacttaaaagtttgcaaaatggcaaaagaagtccatactattacttactacaaagaaatggcaggtgttttaaacgatgaaattacaattagcaattgatcttgaagacgtacaaggtgctatcgcattgattgagaagacaaaggatagtattgatattttcgaatatgggacacctctggtaattaacttcggtctagaaggcttgcaaaagattcgcgagactttccctgacattacgttgcttgctgacctaaagattatggacgtggcttcttatgaagttggtcaagcctttaagtacggagctgacatcacgactattttgggtgttgcggaagaccaatcaatccaagatgcggtcaaggctgctcacgaagcgggtaaggaacttttggttgatatgattggtgtacgtgatgttgcaacacgtgcccgtgaaatcgatgcgtttggggccgattacattggtactcacacgggttatgacttacaggctttgggtcaagatccatttgaagagttcagtgtgattaaggctaatgtcactaacactaagacagccattgctggtggcatcaagttggcggcagctgacgaaatcaaggcagccaatcctgatttgttgattattggtggtgcaatcgcaacggttgatgatccaacagctgctgcggctgaatttaagaagttgctaggctaattaaacagattggaggcctttagatgaactgcaaacagttttaacggagttggcacaaaatgtagatgatgtgaatgacgaagcgctactcggtctcgtaaatcaatcagaacgcattttcctggctggtgctggacgatcaggtctggcgctaaagtcgtttgcaatgcgtcttacgcagttgggtaaacaagcgtttgttgtgggtgaaacaacgacaccggcaattacagcgtctgatttgttagtcattgcgtcttcttctggtgaaacaacgcaacttgttcaatttgcggcaactgctagtgacgtaggtgcgacaatctggctatggagcaccggtacggatagtacaattgcacgccagtcacaatttgtgacactgctggcaggcaaaagcaagtttgctgatgccgatacagctacgaaacaaccgatgggcagtttatttgaacagtcggtttggttgtttggtgacatctttacgatggattatatgcaacgctatcaaattacagagtcgtttatgaaagcacgtcacagtaatcttgaatagtcgttagacatttcattgctttgaaaaatgaaccgcattgtttgcgtgactggtcgattcgattagtgccaaacaatgcggtttttactagtggtatttgtcaaatggaacaaccccaaaatggcagataatttacttgaaatatagattgcgttagtttacataatattttaagctgaaatacaaaatgttaatataccggccttttactagattataggggcttgacaagctacttgcatattgtacgttccggcgtataataataagagctggaaaagttcattttaagagatgggggtgatgactatcgcaacacgtattccagaacaccttgtcgaagaaattcgcgagcgtgtcaacattgttgatgtcatttcgccatatgtacaactgaaaaaacaagggcgtaatctgtttgggctgtgcccgttccacgatgaacgtacgccctcgttttcagttaatgaagataagcaaatttatcactgcttctcatgcggtcgtgggggcaacgtgtttagctttatcatggatattgataatgcaacgttcccacaagcagttgcgaaggttgcaccgtttgcgggcgtcgaccttgatgcatcctacacggcagatgagccaactgaaacagttgatccacaaacaaaagccttacgatcattgtatgcagatgcaacgaagctataccatcatttactcgttaacaccgacgctggtgatactgcactgacgtacttacacgagcgtggtttagatgacggcacgattgatgcctttatgttagggtatgcccctgaaaatgatgttttatacaattatttcaatgaacagggcgtggactatcaattattgcgagcgtctgaactatttattgagtgggacgatgggtcattgcatgaccgtttcacgaatcgtgtactatttacaattcgtgatgctgcggggcacccaatcgccttttctggacgtcgtttatcgaatgacgattcacaggcgaagtatatgaattcgccagagagtccgttatttaataagtcgcaagaattgtttaatttggatttggccaaaggcgccatccgtaagcaaaaacaagttgtcttattcgaaggatttatggatgtcattgctgcattccaagcaggtgttcaaaatggtgttgcctcaatgggaacatctttgacaacggaacaagtccaggttttgtcacgaatggccgacaagattagtatcagttatgatgctgacgacgctgggcaaagggcgacaaaacgagcactcgacttagtggcacagaacggtaaaatgacagccacggttgtgcatattccagataaccaagatccagatgaatttttacgtgcgaatgatgtgtcagcatttttgaatgtgctatcacataatacggaagatccgattgcttttaatatccgttatttacggatgggtcgtgatttaacaaatcaaacagaaatgtttgcctatgttagtgatgtgttagggacgattgcaactgtcactgagccgattatgcgtgaaacctatttgcgccaaattggtgaggagtttaacatcggtttggatgccttacaggatcagttacggccgttgttattgcaacaacaagctcggcggtctaatccgcgacgttcgaataacaagcgtccacgccaaagtgagcgcgttgcagatgctgattttggtgcaacaccatatgatgagtggcaagatagtgcgcctgcgcctgtcccagcaccggttgcaccgacaatttcgcgggttgaacaagctgagcgaatgttgctagcttggatgttgcaggataatgatgtctggctacaagtaaccaacacaccagatttcacttttgctgatgtgccgtatgaaacgattatgatgctcgcatcaggttaccgatcagagcatggtaaccagccaatcaccgatatggcgggctttatggactacgtacagaaagcggatttgactagaatattggccacgttggatacttacgcgcctgaattattcacggatcgttcgcaagttgatgaatatattcaatttattagtcatgacgcaccattatctgatagaattaataggttacaacgacaaattaaagaagctaatcaaatgcacaatgatgcattagttgctcagctaagtgttgaatatttggctgcgcttcgtgaacaacaaacacacaagtaacttaaggaggccgctatggcagaaaagcaagcacctatctcagctaagtttgatcaagttgagtttgataaggcagtgaagaacatcatcaaggagttcaaagctgataaagaaatcaaggaaaatgccctccaagatgctttggttaagccaatgcgtttgaatgctgatcaaatcgatgaattatacgaaaagatcgaatccgcaggaatctcaatcgttgacgaaaagggagagccaactgcgcgtgcattggaaaacaagaaaactaagttatcagaaaaggagttgaagcaagctgctgatgcgccaactggtatgaagattaatgaccctgtccggatgtacttgaaggaaattggtcgtgtctcattgctgactggtgacgaagaagttgctttggccgagcgtattgagcaaggcgatgacacagccaagcaagaattggcagaagctaatttgcgtttggtggtgtcaattgctaagcgttatgttggtcgtggtatgcaattcttggacttgattcaagaaggaaacatgggattgatgaaggcggttgaaaagtttgattaccgtaagggatttaagttttcaacgtatgccacatggtggattcgtcaagcgattacacgtgcaattgccgaccaagctcgtacaattcgtattcctgtgcacatggttgaaacgattaacaagttgattcgtattcaacgtaacttgctacaagacttgggacgtgagccaacgccagaagaaatcggtgccgagatggacatcgtaacagacaaggttcgtgatatcttgaagattgcccaagagcctgtgtcattggaaacaccaattggtgaagaggatgactcacatttgggtgactttattgaagataatgaagccatttcgcctgcagattcagccgcttatcaaatgttgaaggaacaattggaatcagtgctggatacgttgacggatcgtgaagagaacgttttgcgtttgcgttttggtttggaagatggtcgtacacgtacgttggaagaagttggtaaggtatttggggttacgcgtgagcgtattcgtcaaattgaagccaaggcacttcgtaagctacgccacccatcacgttcaaagcaattgcgtgatttcttggattaaaattaaaactaacgggccggggcgaatgcctcggttttttagtaacggcagaatacttattttttcacagttaaacataccgagccgggcaattttttgcgggcatcgcatcaggagagggaaatgcgacgatttttattaatgcttttggggagcatccttttgtttggtggcagtattcaagctgccgaacgtgatttttcagttgcaatcgatacggctatttctgaacaacggcaaccgtctaatacggcatactatgatttgttattagcaccaggtactacaaaagagttaacttttattctaactaaccatacagatgacgatctgcggattgcggttaatccgagtaatgccactacatcaagtagcggtcgtgttacatatcaaccattgacggagaatcgagcgccgacgattcagatgacaaattacctacaaatcgcaaagaccgttgtcatccccgcagacggccaaaaaacggtcacagcaacgcttacaatgcctaatacagcggacattggcttgatggcaggcggggtgtcatttacagcggtcaaagcgaaacaggatatcaatgacaaaattcagttagcgcacgccctgtcatatacgattgctgttcatgcccgtgcgcaggcgcaactacctaaagtggcgttgtcgttgtcgcagccaacggcgatttcgttaccgaatcggacaggcattgcgtttcagattaataataaagttggacgatttgtaaatgatctctcaggtacggcgtcactaactgatattgcaactaataaaccgatcatgacggcaacgttcaaacaaatttcgttagcaccaaatacatcgtggccactaacagtctcccgtaaaaataaacaattaccgccgggaaagtatcgtctagccgttcatgtgaaaacatcagggctgacccagtcctggaatcaaccggtaacggtcaggatggcgcaccaggagcagcaagtacggggcttttcggtgtgggtagtcggaattggtttgataagcattggtgcgattgcggctattagttattgggtgatttccaaaagccaaccgaatggctagttaatgactaacaaattaatggtatttgccatggctactgcgtgcattttattagcagacattctataattaatctttagttagagaaaattaggggtacgggtttatgaacttgcgaacagcaatacttgctatcgcatcaacaattacgattggtgcggttggtgtgacgggtcatgcggatgacactaaactgccggattatgatataacggcttcgattccagctactcagattaataagaataacttatcagcgattgatctaaagttggcaccaggtcaagaagaacatgtgacattctatattacaaataacacaaaaaagccgattgacttgcagttaacaggcgggacagccactacccgtgataatggcatcatcaattatgtgacgggtagccaaaacgtgacaggtcaagtgccgtataaagttggtgattatattaccattcaaaatacggtgactgtaccggctgctggtgaaacgtcagttgctgggacgattaaaatgccggaccatgcgattcaaggtcagttagttggtggggtgtcattcgtccggacgacgagtgcaaacactgcctctgagatacctgttattttgcaaaatgatacaacgccggtatcggcagatgtgaaaatcggccgtgctgcgttgacacaattgacgagcgcacgcgtcattggtgttaagttaacaaataacgctaatcagctcgtgaatgatgcaactgtggcaaccaaggttcaggacaataacggtaaaacagtttttgaaaagacatcacatcgcgttgacatggcaccaaagtcaacttttaactttgaaattaaagacaaagtgaagtcgattaagccaggtaagtataccgttaaggttcaggttaaaacagctgatatgactaagacagccactaaaacgttaacagtcactgccgcacaggtagctgagttaactggatcggcagtcgcgggcaatgattggcaacaaccacgtaattggtggaaattggccgtgggaccaattattgtgttcctagccgtattcttacttgggcgatacttactgcctgcccgaaagcgtcgtggtggcacacgggaagatttgaaacgaaaagataattaaacgtaacacctgacgtatggtgtttagacgatcgctattcaatttggtttgaatggcgatttttttgattcgctgaaacaattaacggagattcttttcacaagcttgtgaagactttatgagtgaacggttgctagaaaccctatcgatataagagattgaaattgaaaaagaaccaaatttcacaaactcgcttgctcaaaatgcttgcatttcattttcaaagaactacaataataaagcaataataattataagtaagtttcgaggagaagaattgtggttcttgtatttctaggtttgtcactctttgctggttttatgttggcaaaccaaaatccaattaacgctgacatgaagaaggtggttggttcaccattcatttcagcggcaatttcatttttgattggttcaatctttttaggcgttttgagcgcgattatgtcacaccgtgtgttcccatcaggagcgttcatcagttcaaatccggcttggatttggctaggtggtgtacttggtgctgtctatttgacatcgaacgtgttgctattcccacgcttgggtgcaattcagacggttattttgccaattttgggtcaaattttaatgggtaccattattgatacctttggttggtttggtacggcacaaacacctttgacattaatgcgagtcatcgggctaattgtgttgattgctggtgttgttgtagcggttgttttgcccaacgtcctaaacaaggatgtggaagcaatggataaggccattcaggagagtgaaacaaagccagtcttgcttggttggcaaatctgggcaatttttactggaacgttgtcagcaatgcaacaagcaattaacggtcacttgggagcgttattgcaagccccagcacaaggctcattcatttcattctttgttgggtttatcttgattaccatcgttgctttggtggttgataagcgcttgcctaaggtgtctgagttaaagcaagctaagtcgtggaactggcttggcggtatcttgggtggtctattcgtcttcgccagtgttttgtcagtgccaaagattggtgctggtttgacgattacgatgggattgatcggtcaaattgttggttcaatgcttgtacaacaatttggctggtggcgttcagccaaggctagtgttaacggtattcaaattttgggtgttgttgtgatggctgttggtgttgtctttatcaagtttctttaattaatacgataaaaagaccatgtgtgcggtaataatactgcgtacatggtctttttttcggtgttactgatgtgtgagctatgatacactggagagaattataggtaggaggtgaactgatatgattgaaaatgataagcgcttagcgaaatttagttttccactccttgcgtcgaattttgcgtcggtgtttggagatggtgtctatcggtttggcctgaattggtttttagtgtctagctatggcaatgcaaaaattttaggttggctaacaggtttcggctttttggtttacttattaaatgatgtttatgttggttcagtgctggatcgctttaatcgtaaatgggtgttgttaggcgcagatttatttggtgccatcggcgctttaacattatcgttgctgattgatccgactaagccacagctctgggtattatttttactaactttcattttgaatgtggatgtctcgtttgcgtacccagccgcgcgcgcaattttgccagatgtcattaagtcaagtgccttggcccgttttaacgcatgggctagcgcagctttctcgacgggacaagcatttggaccattagttggtggtctcttgcttcacttaaaatggattaacttgcaaacgtttttgcagttgtttggtgtgatgcttgtcgttacggtcttgttgaacttggcgattagatatcagccgcaaccaaaagatcctaatatgccatcggagtcatttctagccagtttagttggtggatacaaatacgtgttgtcccaaccaaaattatttgaatcgatgttactaacgatgtggagcaatttcttctttgaaggatttattattgcgatgccatttctgattcagcataattaccatggctcagcttcgtcatattctacggccttaactttggcggcagttgcaggtattattgcgggcataattttagcgcgcttaccaaaattcaattcgttaaatacgctttattgggatctgtttgttctaggtggggcttttatcatcggcacatttattcaagaaatatgggtatttatcggtctggttatcttgaatgggtttgctcgtgcatcgtttgttattaagattaatacggtccgtcaacaagagagtgcgccagcatacttgggacgggtatttggtatttctttctttgcgacagatttatttgcgccgattataacaattgcctttggatatggggtgtctgaattgggcgaatggacagtctttttgcttgggatgatgatggttgtcggtatgatcgcaattaagtttattagcaacagacatgcgcaacattttaattaacataatatctttatggttgatgaattgacagttagtagctgttaattcatcggcttttttgtatttacttgtgctaccaataacggtggcttgtgaaatatcaataattaatttttgtatgttttttatatttcatatatattagatttacagttgtaaactagagggtacccgtggaactaatgttctgagtaaggctggggtactgtgacttaaggtaatttggataaaaagcactaatttaactaacgagtctcattatgcttgcatatgaataaaatggaaccggttctaatatgacattgtgaaaaaattgacagagagattatgtccgcgttaaggtgaaccctacaccaaggccttggggatatgaatagaatacggggatataattttgcaagacgagtcacagaagtttagaaaaaagatgtacaagtccggaaagttttgggtagctgccggtgctttgtttgttgggctggcattcgctggtaacacgcaggctgatactgtattaccaagtgaacaacgtgcaacggagacgacacagaccagtgaagacacgtccgccactaagacgccggcatcggcgtcgacttcaagctcagtcaatgttgacacgagtgacctgcctgacagttcaagtacggcagttgatagtacaagtgcaagtgcaagcgtagtgagtgatagcgtcgctgtgccagatactggatcacaatttacgagttcgtcagcgtcaatgtcatcatcatttgttaagtcatcactagcggcaacaactagtgatgcttctggcagtcagtcggcggcggtgactagcgcaaccgttagttcggtggccacgagtagttcagcatcttcagtgacaacagccacaagcgaatcagcagtgataagcagcgccgtgtcagatggttaccatgatgaaggtggtgattgggtctattatcgagctggaaaaaagttagtcggtcgacaaacgattgatacgtttgcggtttactttgacgccgatggcaaacaagtcaagggtgattggcgtgaaagtgatggtaaacgtgcgtattatgatggacaagaaggacgagcattaacgcaaacgcaagcagtcaatggcgttatctacggttttaatcaaagcggctatcaaatcaagaatgatttcggccaaacagcgaatcgagatacgtattatttcgacgcacaaggtcatgttgtcacgggaatacaaacaattgcaaacaaggtttatgattttgatgagcaaggtcgaatgctgaaaggcattgccacgtcagttgatgacaagatgatgtattttgatgatcaaacaggtgttggacaaccggctgatcatcctgaattcaaccctgaaacggaaccggttcctgacgacaatatcaaacataatgcagcacatggtacgacaccagcagattttgattcgatggctggctacctgacggctgatacttggtatcgcccaaccgatattttggaaaatggtgagacgtggcgcgaatcgcaaccaactgaatttcgaccactgttagcaacttggtggccaacaaaacaaactcaggccgattacgtgaactacatgaatcacgcattagatatgtcaaatgcaagtgtgtcagatgccgattcagaagccacgctaactgcggcaaccgatgctattcaagcggccgttgagcaccaaattacggtgcgccaatcaacggcctggttacgtgaattaatggccgcgtttgttgtgacacagccacagtggaataaaaccagtgaagatgttaatgatgatcatttgcaaggtggggcgctaacatttgagaataacggcgacacagacgctaattcggattatcgcctcatgaatcgcacgccaacaaatcagactggtgaacgcttgtatcacattgatgactcgcttggcggttacgaattattgctggcaaatgacgttgacaattcaaatccacaagttcaggcagaacaattgaattggttgtactacttgatgcattttggggatattacagctgatgatccggatgcaaattttgatgccatacggattgatgcggtcgataatgtcgatgctgatttacttcaactagcagctcagtatttccgtgatgcctatggcatggccacgactgacgcgacatcaaataagcatctttcaatacttgaggattggagccataacgatccggcgtatatgcaagcacacggcaatgatcaattaacgatggatgattatatgcacacacagctgatttggtcattaaccaagccagaggcacaacgtggcaccatggcacgctttatggacttctatctcaccaaccgtgctaatgatgatacagaaaacacggcgcaacctagttattcgtttgtgcgtgcccatgatagcgaagtgcaaacagtcattgctgaaatcgtgacgaagctacatccagaagcaggaaacgggttaatgcctacggaagaacaaatggcagaagcgtttaagatttacaatgcggaccaaaagaaggccgttaaaacttacacgcactacaatatgccatctgcatacgccatgctgttaacgaacaaggatgttattccacgaatttactatggtgacttgtacactgacgatgggcaattcatggcgacaaaatcaccctattttgatgcgatttcggctatgttacaagcgcgcacgaagtatgtagctggtggacaaacgatggcggttgaccagcacgacgtcttgactagcgttcggtttggtaagggtgccatgacggccagtgatttaggaaatgctgagactcggactgagggtgtgggattaattattagcaacaacccaaagttgcaattgggacaacaagataacgtggtgttacacatgggacttgcgcacgcgaatcaagcattccgagcagttgtactaacgaccgcgaccggattaaccatttataatgacgatgatgctccaattcgttataccgataataggggtgatttaattttcaataaccatgacgtatatggcgtgttgaatccacaagtgtcaggcttcttggcaatgtgggtgccaactggtgcaccagcgaaccaggatgcgcgatctactgcgtcaaccaacagttcaacggatggatctgcctaccattctaatgcggctttagatagtcaagtcatctttgaatcattttcgaatttccaggctatgccaacaagtcatgacacgtacaccaacgttgtgttagccaatcatgctgaccagttacacgattggggaataacttcggtacagttagcgccacaataccggtcttcaaccgacggaacctttttggatgcgattattcaaaatggctatgccttcactgaccgttatgatttagggtttggtacgccaactaagtatggggatgatacggatttgcggaacgtcatcaaagcattgcatgcaaatggcatgcaagtaatggctgattttgtgccggaccaattgtatacattaccaggtaaggaattggtacaagtcacccgaacaaacaatatgggtgagccagatacacactctgacatccaacatattttatatgtgacgagcactcggggtggcggtgagtatcagaaacagtacggtggtgagttccttgagcggttacgtgcgctctaccctgatttatttacgacacgtcaaatttcaaccggacaaaccattgatgattcagtaaaaattaaagaatggtcagctaagtatttgaatggtaccgcaattcaaggccgcggagctggctatgtactacgtgataatggtacaaatgcttattacaaggtgacggcaaatgacggtaatgtgaacttaccaaagcaattactcggacaaccagtgatgaccggattctatcacgaggcagacggttatcattttgaaacattgagtggtacgtcggccaaagatgccttcattatgggtgacgatggggcactgtattattttgatgatcagggcgtcatggtaacgggtaagcaacgtgtgcaccaagaccagtatttcttcctaccaaacggcattgctctgacggatgcgtttgtacaaagtgcggatggtcaacgtcagtactatgataaaacaggtcgcctggtcattaatcaatatgtgactgaccaccaagcaaatgcgttccgggttgatgcagacggtaacgttgtccgtaaccaagctttgactgttgacggccatgaacaatatttcggcacaaacggtgtccaagcgaaagcagtgctcattcgaactgacgataaacaggcgcgctattacgaagccaatagtggtaatctcgtgaagcaacagtttattcttgatacagatggacattggctgtacgccgatgctgcaggtgacttggcacgcggacaaattacagttggccaagacacgttgtattttgatgataataatcatcaggtaaaagatgattttgtctatgatactaacggtgtgcattattttaatggcacaacaggcgctgaaatcaaacaagattacgcgtttcatgatggcaaatggtactattttgatgatttgggacgaatggtaaccggtttgcagcgtattaatggtgagtatcgctattttgatgctaatggtgtgcaactaaagggtggtaccgtgaccgatccactaacgcaccaaacgtacacttttgatgcgcaaactggtgttggtacgttggtgacgatttaactgaataatggactagaaaagacgattttgtatcgtcttttttagtttcgataactaaataagtgctcatttttgcattgggactcagaattagcgggcgcgcaagcgtcttttcgtgttaaacttattagtaattaatattttgaggagtctgttatatggcaacaattttagttgtagatgatgaaccgtcattggtgacgctactgtcatacaacctgactaaatcaggcttcgaggtcgtgactgctacatccggtgacgaggcacgaaatcagctggcgaatcatcctattgatttgatgctgctagatgtcatgttgcctggtaagagtggcgttgacttaacacgagaactgcgaggcgaacagaatcgtattccaattattatgattaccgccttggatgacgaagttgacaaaattttgggtctcgaaattggggcggacgattatgtcacgaagccatttagtccacgtgaagtgattgcgcgcgttcgggcggttttgcgtcgtttggataaacaacaagaaccgcaagtagcgaaaacaccaacgaaactaaaacaatttggtaatctaacaatcgattttgataagatggttgtgcaacgacagggtgaaattgtaaagctaacaccaaaggaatatgagctattggcttatatggcagatcgtgaaggacgtgttctagaccgtgaaacaattctgcacggtgtttgggggtacgattatgctggccccgatacacgaatggttgatatgcacttgtcgcatctccgcgataaggtggaagacgatcctaaacacccagttcatttaaaaaccgtgcgtggctttgggtaccggtttgatgatcaagcggtagattaggaggctcggatgcatacagaattaatgcaaaacgccaaaaagtttgttgctttttggtttttatatgcagttttaatttggctgattttgtttgtggcgtctgcgttaggcgaccaagttgtctcgttaaaattccatgtgctggtattactctcgatgtttttgtcaggtgccacgactttggctttggatttacaacaacaacgtcgtgatgcccacatggctatatttattgataaactgcgtgatttacatactgataatacgcgagctgggcatatcttaatgcgacctgatgattcgttagcaccgctagcggaagcgattaatgacgtgcaacgcttaaatcgcgatcgcatcaaattattgcaacaacaaggtagcacgttagctgccttaatgacaaatatgccattaggcgctttgcgtattacaccagaacgcacgattattcaaatgaatgcccaagcacaggagatgcttgctgttgaccgcgacgcattaggacgcgattactcggatgttattaagcatcaccgcttaatttcgttgttggagcaagctttaaaaatggagacgcaagttcgcgaattggttaagtttgataatcgcatgctcgatgtgtcattagtttactatgaaacccgcgaacgacaccacgaactattagttttgttatacgatatgactgaagttacgcagatgcaggacatgcagagtgcgtttgttgctaatgcatcgcatgaattacgaacgcccttaacggcaatcgctggtttcactgagacgctattagctggggccaaggatgatccggcggctttggatgaatttttgcatatcattcaaagtgagacgagtcgcttgttggcattgactgaagacatactagcattagcaaaatcaccagagcgtttgtcgaaggttgcaccggtgaatgttgcgaatattgcgacagaaatatttgaggcaaataaaccagccgccgatacgttaggcttacaactccagaatgaaattagtccgtcgtttacagttaaccaggacgaaagtgtcgttcgacaaattttgacgaacttaattgttaatgcaattaagtataatcggccaggtggtctcgtaaaggttgccgcgatgatgacggctagtgaatttgtgatggccgtgaaagatactggtttaggtatttcaagtgaagaacaaagccggatttttgaacgcttttatcgaattgacaagtcacggaaccaagcaatccctggcaccgggctgggcttagcaattgtgcaggatttggtctcaaaatcgcaaggaacgattgaacttgacagtcaagttggcgttgggtctaccattacggtgaatttgccactacaatagtaataatataaaaagtgtattgaagaaagaggattgaaaaatgtctaactcacgtccagttgttatcggggttacgggtggttcagggtctggaaagacaactgttagccgcgaaattattgaacgcttgaagggcgagtctgtggtcatgattccacaggatgcatattataaggatcaaggtgataaaagtatgacgcaacgtgttgcgacaaactatgatcacccagattcattagataatgacttgttgattgcacagcttaagcaattgttgcaacgtgagacaattgagcaaccaacttacgattacgcagcacacacgcgttcagacaagacggtgacagttgctgccgccgacgttatcatcgttgaaggggttttgttattcacagaacctgaacttcgcgatatgcttgatattaaggtttatgttgatacagatgatgatttgcgtttcattcgtcggatgcaacgtgatattgtcgagcgtggtcgtacaacagaatcggtggttaaccaatatttggcgacagttaagccaatgtatcatcaatttgttgagccaactaagcgctatgcagatattattttgcccgaaggtggtgcaaatgttgtcggaatcggcatgctggaagcacagatacgtgcaattttagacttacacaagtaattagataagaaagtgtgattgcaagatggaagaacgaatttggaatcgaattgttaagtataccgaactgcaaggcacatcaggtcaagaacatgccattagaaaggcatttcgtgatgatttgacgcccttagttgacgaagttgtgcagaatggtcttggtggcctatacggtatccgtaaacatacggatgcagatgcaccacgtgtgatgtttggcgcgcacctagatgaagtgggctttattgtcacagcagttacggctcgaggtatgttagttgtggcaccggttggcggttggaatccttataccgtttcagcgcaacggttcacgctttttactcgtgacgcatcgtatccagttgtctcttcagcagtctcaccgcacttcttacgcgaaggtggcgtaaacggggcaccgaagattgaagatattctttttgatggtggctttacatcgcatgacgaagcttggtcttttggtattcgtccgggtgactttattgtgcctgatgtcaaaacggttatgctggctaatggtaagcgggttgtatcaaagagttgggataatcgctttggattagtgacaattttgaacgcgcttgaaaatttgcaacatgacgcattgccaaataccttgattatgggcgctaatgttcaagaggaagtcggcttgcgtggggtcggcccagccgtcaaccaactacaaccagatttgttctttgcattagattcttccgccgctgatgataccaagtcagatcaggcgcaaggccaaatggacgggggcgccttgttacgcgtctttgatccgggtgtcattatgccattgcgtctgaaggaatttgtgcttgatacagccaatgatgcccacattccgttgcagtactttgtggcgaagggtggcacggacgcacacggcgcgcaatcacaaaataacggtattccttcagttgccttgggggttgcttcccgttatattcacacgcaccagacagtttggtcagtggctgattttgaggctgcccaagcgctggttgagacccttgctcgtaaattagataagacaaccgttcacgatattgtgtacggtgattaattaataatagaaatggagactgacaatatgttgattgccagctataacccagccggaatgggtgatgtattagttgtgttaacggccccagctgctgagcacacgtttgaacaaaaagagaatgttgtccgcattgcagatgagcagaacatgacgcttggttttaattttttgcatgcgtcaacgatgttggatttgcccgaaacggctggtcaagtgtttttgacgtcagatgctgttgctaagctaaatgctgctttagttgcagccggttttgaagcagagttggttgctgatgaaacgcctaagtttgtcgttggctacgtcgaaaaggccgaaccacatccagattcagatcaccttcaaattacaacgacggttgttgataatgatgaacgggttcaaatcgtgtcaggttcacctaacatgcgtcaaggcattaaggtagttgttgccaaggttggtgcgatgatgccatctggcttaattatttggccgggcgccttgcgcggtgtcgcttcaaacggcatgattacatcaggtcgtgaattgcggttgcctaacgcaccacaagtgcctggtgccttgattttgccggatgattttgctgaagttggtacgccatttgacgcaagttcagctgaagcacaagcattatttcaataaggtgaggtgataccgcatggttgatcgtcggcctatcgttttttatgagcgcttaatgaacacctatgatggtcaggtagcagctctaatggcagctaaaacctcatatatcttgttagcaactgaagacacagatgctgttaatttgtcatcggcttcagtcacggttgagacgccggctcaagcaactatggttacgccacggcaacaaattgcggttgaagtcttgcaaccacgtgttgtgccaacaatgccagaattgccagaagtcgaaacgctagtagagcagtcaaagccggttgacccagcaccagtcaagcaaacacctgtagcgtcaacgccaactaagccacacaaaattaaaacaggcttaggattaagccttgatgatatcttgtcggaagaagcaagtgttgctgcgcgtggtgatagtcaatattttgaaaactgataagtaaaaattatgaaaagagctctgaggcacccgtgccgaatagctctttttttggtatcatagtaagtacttacaaacagattggacagaatagataatggacaaggatacgttatactactttattgggattaaaggatcaggcatgagtgcattggcacttattctgcatgatcaaggcttgcaagtcgcgggctcagacattgatgaatacacattcacgcaaaagccattggcggcagctggaatcccaatgtatagtttcgatgcagctaacattaagcctggtatgacggttattcgtggaaatgcctttaatgatgaccaggtggaagtcgcggctgcgttggcgttgggtgatcagattaatttggttacttacccagacatggttgaaaatctagttaagcaattcacgtcaattggggttgcaggggcacacggtaagacatcaacaacaggtcttttggcccacgttttggctggtattgcacctacatcatacttaatcggcgacggtacaggtaagggtgtgccagatgcacggttcttcattttcgaggcggacgaatatcgtcgacacttccaagattacacaccagattatgcaattatgacgaacattgactttgatcaccctgattattacacaggtgtcgatgatgttcgtagcgcttttgaagacttcggtaatcacgtcaagaagggcatttttgcttggggtgatgatgaacaattgcgcaagatgcaagttgatgtgcccgtctatttctatggtacaaatccagagactgatgatttttacgccaaagacattaagcgttcaacaactggttcaagttttgacgtttactatcatgatgagtttttgggtaactttgaagtgcctttgtttggacaacatggtgtcttgaattctttggctgtgattgctgttgcatactttgagaagattgacggcgacttggttcgcaaggagttgttgtcttttaagggtgttaagcgccgctttactgaaaagcaagttggccccgtaaccattatcgatgactacgcacaccacccatcagaaattactgcgacgcttgatgctgctcgtcaaaagtatcctggccgtgagctggtagcggttttccaaccacacacgttctcacgtaccatcgcgtatcaagatgattttgctaagtcgcttgagctcgcggataaagtctatctaacggagatttttgcatctgctcgtgagcaagcgggcgatatttcatcaaaggacctgggtgcaaagatttcaaagtttggtggcattgtatcaccaactgatgttgcaccgctattggatcatgaagatggggtctttatctttatgggtgccggcgatttgcaaaacacagaatttgcgtttgaaaagattttggcaaatacgcaaacgaatttgcagtaaaccaaattggtttttaacttaaaaaattatttaaccttagtgcgacttttaatgttgtgctaaggttttttggtataatgatagtatggggttagtaattgaaacaccaaaccattgccgaatggggcaacgaaagaggtagcatatatggataattttggttttgaacaacaaggaccacgtttggtaaacccagacgcaacggggctaaatgatttctttaaaaaggtctacacgtacatggcgttggccttgttagtgacagccgcgacggcctatcttggcgtaacgctgtttgccgcccaaatcgccgctatatttagtagcacaatgtcatcgctggtgatgtttgccgtgatgatgggatttgtctggttgttttctagtcgcgtgtacacaaatccggggcaggcattcgggatgctaatgggattctctgtcttgaacggcgtaacctttgcagtcattggattgacaactagcttggggatgattgcttccgctttcttcacaacggctttgttgtttgcgggaatggccttgtatggctttacaacaaagaagtcaatgtcgtcactttcaagcatcttgtttggatcggtaatcgctttgattattggcggtatcatcaatttgtttttctttaacagcattgtttacttgttcttgtcagttgtcggtgttgtcgtatttgcgattatgacggcttatgatatgaaccgacttaagacgatgtacattgagtatggttcacaaggtgacgccacattgacgcaaggattggctgtgtcaggtgccttgtcattgtacatggacttcatcaatttgtttatttatattttgcgtttgttcacggctttcgggggctcacgcgattaagcttaattttattaacggcatctctgcggaggtgccgtttttctgttactatattaagtatcaaaacgtttgggggcatccccggaaaagagatgaaaatggcaaaaccaacattacttttaattgatggtaattccctgggttttcgggcattttttgcactgatcaatcaggttgaccgctttgtaaatcacgaaggccttcatactaatgccctagttggctttaataacctattagatgggattgttgatccattcaagccagatttggcgctagttgcctgggacgctggtaaaacaaccttccgtacgggtaagttcgatgattacaagggcaatcgtgataagacaccgcaagaactggttgaacaatttgaaccgttacgtaagatggtggaattacacgggattaagtcatacgagctaccgggttacgaagctgatgacattattggaacaacggctcggatgggtgagtccgctggttatgcagtgaccattgtgacaggggaccgtgatatgacccagttggtgactgatgatgtctcagtttgggtaactaagaagggaatcagcgaaattgatcattatacgcctgcaatggttgcggaagtctatgatggtctgacaccagctcaaattgtcgaagtgaaggggttacagggcgacacaagtgataattatccaggtgttgctggtattggtcctaaaacagcaatcaagctgatgaaggaatatcacaccattcctgaaatgtatgaacgcatagacgaaatgaaaacctcgaagcagaaagaaaagttgattgccggcaaggaggatgcactcttgtcgcgtgatttggcaacgattcggacaaatgcaccagttgattatgatttatctagtttgacgtacaatggtcccgattacgaggcgattattccgttctatcaacacctagattttaaggcccagctagtaaagttggctaatcaggggcataccattccagcacctacgggcatgcagaatggggacgatggtgaaccggctcatgatatgaacaatacaccattagaagtccgttcattaacggccactaatctaacacatattgagcaacttggtgatgagattagtttttatcttgagcttgacgatgaaaattatcatacggcaaacccagttggttttgtgattggtaacaacgaacacggctattttgtgagtcgcgacattgagctactggtacaaggcacaccggttaaccgaattttacaagatgcaactgttaaaaagaacgtcttcaatgcgaaggggacgattgttgcattacgtcgcttaggcctaacattgcctaacgtcgcattcgatttgttgttagtggcatacttgcttgacgcaaatgacaacaataatgatatgggggctttggcccatgaaaatggttactacgccgttcgtacggatgaagaagtttatggtaaaggcgctaaattcgcgattcctgaggctgatgaggatctgttcgaacacttggggcgcaaagccatggccattcaatatttgaaggacccattgatggcgaaattgacagaacacgaacaaacgcagttgtatgatgacattgaattgccactgacgtacgtactggccgatatggaagcgacgggtattacagttgatgcgaatacgttgcttgaaatgcgaagtaaattaacggagcggctagcggaactcgagcaaactatttaccaacaggctggccacgagtttaacgtgcagtcaccaaagcagttaggtgtggtcttatttgaagaaatgggttacaccccaatcaagaagacgaagacaggttattcaacaagcgtagaggttttggagcaaatgggcgatgtaccgctagttgcctcaattttggcttatcgtcaaattgcaaagattcaatcgacttacgtagaggggttgctacgtgtaattcacggttcggattctaaggtacacacgcgttatctccaaaccctaactcaaactggtcggttgtcgtcagtcgatccaaatctgcaaaatattccggtccggattgaagaaggtcggcggattcgtaaagcctttgtaccacgtgagaaggggtggcgaattctaagtgccgattattcacagattgagttgcgtgtcttggcgcatattacaggcgacaagcacttacaagaagcgtttatcaatggtgaggatattcacgctgcgacagcgcgtcgtattttcggtattggcccggaagagacggttgacggtaacatacgtcgtcaagccaaggcagttaactttggtattgtatatggcatttctgattttggcttagcaaaaaatattggtgtctcacgaaagcaagccaagcaaattatcgatacgtactttgagcaatatcctggggtgaagacgtggtctgaggaaattatcgccgcagcacgcgagcaaggatatgttgaaacgattgcacatcgtcgtcgttacttgccagacattaaggcgaaaaatttcaatttacgtagttttgcggaacgcacagctatgaattcaccaattcaaggttcggctgctgatattattaaaatcgccatgattaacatggaaaaagcgttgcgtgacgctggtttgcaagctaaaatgctcctgcaagtacacgacgaattgatttttgaagcacctgagtcagaattgccaattttgcatgagttggtgccacgcgtcatggattcagcaatgcaattggatgtccctttaattgtggcatcgcatgaaggtgaaacttggtatgatgcaaagtaacgtttaacagcatactgacactgtaagcattagtttcggctaatgcttatttttgtatttccaggttaataagtcacatgaaaaatggtagactagaagataccgaaaacataaagtttgctttaatccatgggtgctagcctaggaataaagtgttaatgagcacatgccaaagggggatgaagacagatgccagaattgccagaagtcgaaacagtccgacgcgggttaacccgcttagttgttggacgaactgtacaaggtactgccgtgcggtgggagaaaacagtcgacggcctatcaccggaggaatttgatgctgaactagctgggcgacgaattgaggcgattgaccgtcgcggtaaatacttactgttccgcttttctggcgggatgacgatggtgtcgcacttgcgaatggagggggcgtattatactgtgccggcaggaaccgagccgggtaagcatgatttggtgactttccacttagatgatggcatcgatttgttatatcgtgatacacgtaaatttgggcggatgaaattagtgcccgacgcggaggcgttacaagttgctggtttggccaaaatcggtcccgaaccaactgagtcaactttaagcttagcctatatggtggcagagtttggtaaatcacgcatgcatgtgaagccgtttttgcttgatcaaagtcatattgctggattagggaatatttatgttgatgaaacactgtggcagtcaaagattcatcctttaacaccagcaaataagctttctgaagatgaattagcagttcttcgtgataatattattgccgaattagcacgggcaaccgagcatcacggcacaactgtgcatagttttaccacagcattcggggaagccggcgagtttcaaaatgaactgcaagtctacggtcgggttggtgaaccttgtttgcgatgcggtcatccactagaaaagatgaaagtcgcccaacgtgggacaactttttgcccggtttgccaagtagaaaaggattaaaacatgtttaaattagggttgactggtgggatagccactggtaagtcaacagtatcaacacactttaaagagcaacacatccccgtgttggatgcagacgtcattgcacgtgagatcgttatgccaggtgagcctgctttagctgagattgtggcaacctttggggaagagatgttgctagctgacggtacactcaatcggcaggcacttggctcggttgtctttggtaatcccgccaaattgcagcaattgaatgccattacgcatccgcgggtacaggcatccatgcgagcgcaaattgccgcacatgaagctgcaggagcaccactaattgtattggacattccactattattagaaggacataacgctgccggcgccgatgcggtaatggttgttagtgtaccggaagaggtgcaaaaacaacgtctcatgacacgcaataatctgtctgaagaggctgctttaaagcggattaactcgcagatgcctttggctgagaaacgccaattggccgattatgttattgataatgctggcacagttgctgaaacctatgcacaagtggatgccgtgttagcagaaattttgcattaagaaggagcaaatgggatgactgaatttagtattcgtcagcgctatcgtttgatttacgatgaacctatcaatttagctgccgttcagtcattgactaaggtttatttgccaatcattggacgagacgcatttactttgtacttaaactgggcgatgcttggcgaatccacggatgccgccaatcaacatgctgatttgttggatgaattagccatgagtcagcaaacgtttttgactgcccgtgaaaagcttgagggaatgggactactgaaaacctatcagcaagaaaccagttttggcgtgcagtgggcgtatcaattgttcccaccaatggcaatgaaagcatttttagcagatatcatgttatcaagtttgttgcatcactatctgggggatgatttattcgagcggctaattgctgaaactaagcccaatgaaacgacaatacctggtcagaatgtctcaaagtccttcttcgatatgatgggacaagaatccttccaacgattgccagccgctccgttccagagtgatgataccaagtcaacgttgcaacgtgaaattgccgcgagtgatcagcaactgaatattaccttgatggctgatatgttgcagtctttcggtattacacaaaacgacctacgtcaaaaccaagcggatttaattattcaaaagagtctctatggcttgagtgatgtcgaattagtacggttgattcaggggacggtcgatgcttccggtaagctaagcattacgaatttacgccaaacattacggcgaacgtacgagcaaggacagcgtgtttcagatgctgtccaacaggtaactgaaagtcagcctaaagcgacaacgcctaatgaaccggtggcgactggcaatccggcagctggtattattcaaacagctcggacaactgccccgttggtttttcttaagagtctccgtgagaatgcaggcgggtttgtgactgataatgaagtgcgggctttaaatgatattgcgcagctggataagattaagccggaagtccttaacatcatgttgttcgaacttacggtcgtagaaaagcgaacaaatctcagcaaagcgttgctacaaacaattgtgaacgactgggcgcaagctggtgtcacgacagcagttgatgcgatgacttatcttcagaagcgaacgaagcaacgacaagaaaagacacaacaaagtggtaagtcaggggcaaagcgttggcaacgtaaggaaccggttgttaaggagacccgtccggattgggaaaatcaaaaagcaacggcggtttcgaatgaagatgcaacggcggctaaaaatgcgcttgccgaactgcgtgcgcgaagacaacaatcaaagaaggagtaataacgtatggcagatgaaccatttaatgtaggcgaagcgttaaatcaatttatggataaaaaacacttacatgctcgttatgcagcaattcaaaaggaagtgttcgaacaaccggatattaaggatttttttcaaacccataaagatgaattatcacgcgaactggtgaatcgagacttctcagttttgtatgaatactatacccagcaaaagaatgctgcggcgggtaagccagttgtacatactggatataagccagttcttgcgctagctgaaaatcgcattgttattgtctatcaaccagatgaagcgactttggcagcgcaacgattacgcatgcaagctaacttggtccagtcaattggcatgccgaagttgattgagcgtgcccgtcttgatgatttttcagaagcggatgctgaccggagcgcggcattcacagctgtgattgcttttgtgagtgcatatattgccagtcctaagcaataccatcgtggtctctatattcatggatcatatggcattggtaaaacccacctgatgggggcaatggctaacgaattggcgcaggaagggattccagtaacgctcgtgcatttcccaagctttgcggttgaaatgcgtagcgccattggatcaaaggaaaatccgcaagataaaattaacacgattaagcaggtgccaattttggtgcttgatgatattggtgctgaatcaattactgcttggattcgcgacgatattttaggtgtcatcttagagtaccgtatgcaaaatgaattaccgacattttttacctcaaatttctcgatgaatcagctggaaacagaacactttaccgtgacaaaagacggcgccgagccagtcaaagctgaacggttaatgcaacgcattcgatacctggcgaaggaaattcaaatggcaggcgagaacagacgagtgattgattaatgggaaagtacaagcgaattttgccatgggttattctggtctttatcagcctgctgtcagtgattgtcctacgtcataacgccacgatgtacaacaccccaattggtgaggtaactcatgtgcaaaccagcaaaacaggtcgttcaagtgaccaatttggtaataatgtcaagacaaccacacagcgtgtaacagtgaagctgttaaacacaacacataaaggacaagtgttgacgatagttaatacgtacgacagtgcgatggccattaatcaaccggtaaaaccacataatcaaattttcctatcgcgggctgatgatgcaacttggcagttcaaaacccttaaacgtgacacggtttgggtgcctgtgatgatatttgtgcttggtattcttattatttcaatggggcgggccggtcgactgacggttttgtcacttgggattaatattttgttgtttattgttacggtcacgcttgatttggtaactgacaatgggaatatcttttggctgtttctgatttttagcgttattgcggcagctttgacgcttggactagtaatggcctttaaaaatcgacaaatgtgggtaattttcttaacggtgttgaccgcgacggcattagcgctcttaatttcggagattgtctttacggttaccaagcaaaatggcctgcactttgaactcatgtcatatattacgcaattacctaagcctttgtttatggctatgacactcgtgggtgtgttaggtgctgtgatggacgaagcaactgatatgattgcgacgttatttagtgttcagaaagaacggcctgacatgacaattcgggaaattattgcaaccggacgtcacgttggtcaagaaatttttggcgccttaagtaataccttgtttttaatttttatggccgaacaaattcccatggcaattctgtatttgcgaaatggcaataattggggctttacgtatatgatgaacatgtcattggggatgattcaaacgttaatcagcgccattggaatcgtcttaaccgtacctgccggaattatttgggtattgattgtccgtaaatggcaacgacgaaaggaggctttgtcatgagtgtcaccttaatgttgtcgttaattctactcgccttgatgattatcatcgggggcatgaagggcatcggcgcgtttgtcagcctctggattaattttgccattatggttgtgatgattatgctgattaatttccagtttaatgccttggccgtcctattggtgggcggcgcgtttttattgacggttacgatcctaagtgcaggtgctgacgaacggacaacgaccattgcactaatggccagctttatcgtcatgttcgccttagtcattttgattctgccagctgaacatttagcgatggcacaaggatttgctgaggagaattctgaagaactcgaaggcttatcgctgggtatcaatattaactttgtcacactgggcattgttgcagcattgctagccaccctcggggcaatcgctgaggctgccatcgcaattgcggctggtattggcgagttattggctgatcaacccaacatgtcgttggctagtctggcccaatccgggcagcatttgggccaacaaattattggaaccgctgtgaatacggtgttgtttgggtttatggctgattttttgagtctggccatttggtttggtaaactacactatagcttaggtgaaattgtgaatgcgaaattatttacctcatcaatgttgagtttgctctatgctatcttaggtgttattgtcattttgccgattacgatggccatttttttgtggcaacagcgtcgtcaattgcagacggacatggggacaaatcacgattatgacggcaaataactaggatttattagaaaaccatgttatgctagttttaaatatgtcatgactttttgggaatgaccatatcctgtagaaagtaagatgaggtataacacatgagtagtgtccttgttattgaagatgaagtaaatttggctcgtttcgttgaacttgaattgcaacacgaaggttacgaaacgcatgtggaagataatggtcgtggtggcttacaagctgccttggataacgactatgatttaattttattagacttgatgttgcctgaattgagtgggctagaagttgctcgtcgtttgcgcgaagtaaagaatacccccattattatgatgactgcacgcgactcagtgattgatcgtgtttcaggcttggactatggggcggatgactacgttgtgaagccttttgcgatcgaagaattgttggcccgtgtacgtgcgttgttgcgtcgtattaacattgaaacagaagagcacagtacccaccaaagtgttgtccgttaccgtgacttaactgttgaaaaagaaaatcgtattgcccgtcgtggtaacgatattattaatttgactaagcgtgagtacgagttgttgctgattttgatggagaacattaatgtcgtccaatctcgtgaagagttgctgaagaaggtttggggatatgattctcaaatcgaaaccaatgttgttgacgtgtatattcgatacttgcgtaacaagattgatcaaccagactcacgagcatcttatatccaaaccgttcgcggcacaggatatgtgatgcgtcagtaatcacgggggccgctaatgggtagtgaaacatccattattaaagaaacaccgcaacggaaggggctctcacttaagtggaagtgggccctgggttctgctgccggtgtttttttaatatttattattttcgcttggttcatgattcaagcattttcgacacagatgctaaagactgagcgtcagcaagttagttcgtcgcttgaagttgtgacaacacggttgcaaaatttagatgaatctaagttgctacctgctaatgtcgatgacatgttgcgtccaaagtcaaatgacctagataaagtggttaatgatcctgtgttgcaacaaatcacacggcaagactacacggttcgcgtctacaatgcgaacggggcacaagtttatccgattggcgggcagggcgttgcttttcgtaaggtgacgcatcaggaaatcacgctacaacacgatcatggtccagcgatgcttgttggtcgacaggaattacggaacacagccgataaagttattgggtatgtcgttattgagaaccatttgactagctatcatgcgacattcaatcgcgtttatatgattattgttattctgattggcttaggcttgtttttggtagccttgtggggttactggctatctgattatctactacggccagttaacaacatcaaacgcgtggtggatgagattcagtcagatccgcaatcacaagcgcgggttgttaatgaggatcgaaaacctgatgaattaacggatctatctgatttattgaacgatatgttgaatcgcatgcagcgttttattttgcaacaacatcagttcgttgaagatgtctcacacgaattacggacgccggtggccattgttaagggacacatggagttattaaatcgttggggtaaggatgatccgaaaattttagatgaatcaattacggcttctttgcaagaaatgcgccgcatggaaggacttgtctctgagatgcttgacttaacacgtgcggatcaggttgagttgacattccgagacggtgatacggacgttaaggatatgattaacggcatttatatgaacttccaaatgattcacccagactttacgtttggactggatgatgatttaaagggaccaacaatcgttaatatgaaccgtgatcacttagagcaaatcttgattatcttgtctgataatgctgtgaagtacagtcagaatcgtaaggaaattcattttgcggcatcgcgttctggtaatatggttgagttggccgtgcaagactttggtgaagggattagcccagaagatgcagcccgcgtctttgatcgtttctaccgtgtcgataaagcacgttcacgtaaacaaggtggtaatgggcttggcttgagtattgcgcaaaagttggtcgagggttacggtggtcatatcgaactcgaatcagcaattggacaagggtcaattttcagaatcacgttgcctattaagcaacaaaaatagtaaactatgagttgcgactgttttccggtcgcaactttttttacagaaatcgagagcattatgatactaaagcacgttattttacacattttggataaagacgctggcaatctaattgcctcacaggctgaaattgatttgacacagccaggcctacacgattatctggaaaaaatcattctaaaatttcagaccggtgattataagccaggcacattaaccggtgaagattatctggcgcaaacaattgatgataataatgggctaacgtttgccgaaaagacgacacaattggctgaaaaattatttgataatattgccgctagtgaggccgtaccggctggtgacttattaagttttgaatttgctgaagggactgacgactttttcggcctcattaagttaaattttgcgccacgttacgcccacatcgtggactatcgtgatgatcaacttgttaacaacctagtgcttaaccaggccgtcttgccgggtgctaatcaaaaagcggatgaaggtattcttgttaacttaatgacgggcgattatatgctagttgaaaagcaatacttgattgatggtcaccgcatcaattatttctcagagcgttttttgcaattggagcccgaggtctctactaaagacaatatcaaaacaatcaagcgagccgtaaaaacagttgctgataagtttgatgtgcctgaacacgaagcaatggctgccacccagagtgcgatttttgattccgttcaggaagatggtcaaattaataccgctgatattgccgaggcagtttttaagggtaatatttccgccaaacaggcttaccaagaagtcattgcagacaaagagattgaaactgaaattgccgtgccaaatgtggaacgttatgaaaagaaataccggctccaacgtttcaaattagactcagggattgaaattgccattccgatggacatttatcaagaccgcagtaaggtggaatttgtaaataatccggatggtacaatgtcgttggttattaaagatattgaatcaattgtcaacaaattcacctcataaagtaattttgaattgattatatagtgatagttcttgattttgtcatggttatcacacctgttttacgcagaagcgcgttataatttatgtattgatattaaataggggaacatttattatggcctggccttttaagaaaaaaatcctgttagctgtcgtgccactgacgctatttagcgctggtgtgacgacaacgctaactgtacacgcagataaaaaagtacaacaaaaacctgctacccaagattttgacttggatgctttttcaacggatctcgacaagatggacatgacagtcggtccggttaagttttcgtcaagctcagtttcaattcatgtcgcgaaactagcaaaggggacaactgaagcgagtccgattccagagtcaccattagcaaatggtacgttacccgcggcggcaatgcctaagatgacggatggtaagtttgacatccgcgcgacgctttggaataaggaagctgacgatgcagaaacgttctttaatacgattgcgccagatgcacaacgtgtggccatttcatatggtgtgcgcccatccgtcttgatggcccaagccgcactagaatcggactttggacgctcatcattagcctctgtctatcacaattatttcgggattaaagccgttgatgggcaggatagcgttgatttaccaactaacgaagaagttgatggtaaaaccgtccgagtgacggctgcgtttgctcgctatgattcagccgttgatagtatgattgctaatgctagtttgttgcgcaatcatgatatgtactcgggaacttggctagagaatacgagttcttattacgacgaaacaaaggcgttaacaggaacgtacgcaacaagttcgtcatatgcacgaagcttgaatgcggttatcacaacttatcgtctagccgctttggacatcaagtaataaaaagcaccacttaacaatacttgttaagtggtgctttttatgtttaatcttcagtttcgtctagctcggcagacttttgtagcagtgcctgaagttcattcttacgacgatcgcgtggaataaacaacccgagcatgtcttcattaatacctgccataacgtggataacttcaccagcgtcgttcgtctcaacagtcagtggtgacttcaatgacttgttaggactagcaatgacatcattgatggtccaatcatcaattgacatcccgcgtggatttttgaaaatagtcgcttctggatcctcggcagcgcaaatagcacgcattgttgggatagaaacggggagggcagatgagtcttttaattgaaccaattcatatgccaagttgttacgttcgaaaaaactctcaaccgactttaacgcattaagcgctgatgtgcggtgagaaaatgagtataccgtgacagtcatggaattccctcaattcatgtaattactaatgtatctattgtttcacatattaaaaaacagtcaagtgtttcaattgaataacaatgatttctttgtttcaattttgttgtttatgaaaatacgattgtaatcgaatgacatttcaatttgatttcacgagttgaattgtcatgacctggaaacaagcgtaaaatacctatctgtatatttatgaatttttcataaacgataatcgaatatttaaggagttttctcatggataagaaacgtattggccttggcgcccttgtcatgatgatgtttaccaccatctttgggtttgccaatggtccagttgcgttcgcacgtatgggctacgcggcaattatttggtacatcctgggagcattgctattcttcctcccaacatcaatgatgtatgctgaatttggggcatcatttaaagatgctaaaggtggtatctactcatggatggaacgatcacttggtaagaagatcgcgttcattgcgacgttcatcggacttgcctcatggattatctggatgatttcagtctcacaaaaagtctggattccattgtcaacgttgatcttcggtaaagacatgacgaccacgtggtcactatttggtatgaatggtggccaaacagttggggtacttgcggttgtcttcgtcattgtggttgctttctttgtcacccgtggtgttaagtcaatttcacgtatttcagccattggtggtatgtttgtaatggccttgaacgttattctggtattggcctcaattgtcgtactaatcggtcacggtggccactttgctgagccattacgttggcactcattctttgtttcaggtaatcctgactacaagacaattgggcaaatgatttcattcgctttgtatgctatttttgcctacgctggcttggagcaaatgggtggtatcatggaggacgttgataacgccgaaaagacatacccaaaggccgctctaattgcgacaacaattattggtcttggttacgctatctcgattttgctttggggtgcctcatctaattgggcacaaatcgctggtgataagagtgttaatttgggaaacatcacgtacgtcttgatgaataaccttggtacacaattaggcgatgcatttggcatgagtcatgctggtggcgtcttgcttggatcgatttttgcccgctttgctggtatttcaatgttctttgcttacgttggttcattctttgtcttgacgtacgcgcctttgaagtcattcattttgggttcacccaaggaagtttggccaaagaagttcattgctttgaacaagcatgacgtgccggctgttgcagtctggtcacaagcaatcctagtttcaattctaatcattttgatttcattcggtggaaagagtgctacgcagctttacttggttttgacaaatatgggtaatgtgtcatcaacactaccatatgtcttcctggttgcagctttcccattgtttaagcgtctcaatgatgttgaacgaccatttgtgttctataagagtcaaacggttacttggattattacaattctagtcgaagcattgacgattatttcaatcattttgacgattatctcaccattccaaactggtgatctgttcggtggaatctggacggtcgcaggaccaattttctttggtgtcttggcttgggtactatttacacttggcgaaaatcgtcacggtaagttgtaatatattgaaaaacgtgttcattctggacacgtttttcttttgcaaaatttcgaagacgtgctatatttttagacaacattaatgacggtgaaggaggttacacatatggctgaagaaaactataccccaatcgatgaattaacgagtgaagagcacacctggtatgcagttcgcatggttggtgaagaaatcgacacgttattaacggctgccccagattacaacgaggctgttgggattgcacatcgaacatcacagcaatttccagactttaaactcactgttcaaaaggtcattggtgtattcatggataatacccggtatgataaaatgactgatttaaactggtatggggttatgccagctcgtcgtaaggataattacattacccagattttctcaaatttcaaggatctgaatgattttttacaagataatcgtgctgaaaaatttagatttgttagtttgttagcagaataaaattaattaaagggttgacggtttcaatactaacgtgtaatatattatatgttgttgaggcaataacatgtaatatgtgcggatgtagtacaatggctagtgctccagccttccaagctgggaatgcgggttcgattcccgtcgtccgcttttctgaagtagcaatcgttgattgctacttttttaatagataaaaatctttgtaaagttagtttacaaagattttttgtgatataatggattattgtaaaaaagagaaataggtaaggatcgatattccatgaaaattaaaggcttaacgcccatcttgtttattttgttgattattttgtttgttactggtcacgcagactttttggaaggtccgttgactagtttcatgcacatgtcagaggactggattggtggtacgaatgcagttggttggtcaattgttattttgacatttgtggtgcgattgattttgttgccaatgatgattcaccaacaacgtggcgcaaccattcaacaagaaaagatgcgtttgttgcaaccacagatgagcaagattcaagaagcgcagaagacagcacaaacacaagaagaaaagatgttggcttctcaagctatgatggctgtttaccgtgaaaacggtgtttcaatgcttggtggtatgaattttgcgacattgattattcaatggcctgtctttatggggttgtacgctgctattaagaattcacacgaaattgcacacgctaccttctttgggattaacttaggctcacaatcaccagtgttagcaattgcaacagcagttgcctatggtgtccaagcatacttgtcattgattggtattccagccgaacaaaagaagcaaatgcaatcaatgatgttgatgatgccgatcatgatgttgattatgacttgggttacgaacggtggtattgcgctgtacttcttcgttggtgcgttggttatgattattcaaacgttgatcatcattgtttggcggccaaagttgcgcgcgcaagttgcggaaacgttcgttgttaaggatgtcgttgacgatgcattggccggacgtttgcaatcagagccaacgggaccatttgctgaagccatgaaggcagcgcaagcgcaacaacaagggacagaacgcaaagatattacaggtaatgtcagcgaaagcgatactgattcatcaaagtcaaacggtcgtaatgctggtaaacaaaagcgttaattaaaatttttaatcctaaaaagaccaaacacttactgttgtttggtctttttttggttcatccgatattaaagattattcatcattagcaataggttatgacgtacaatagtcacatggagggtgatatctatgacaattaatcatacgactgatacaactcgctatcccgatttacgtggtaaaaccgcagttgtgacgggtagctcgtcaggtatcggtgaagcgatcgcgcgtcacatggggtcagaagcgatgaatgtggtcattaactacatgagtgctgatgaaaaggtaatcgacgggctgatctacctaattgaacaatcaggcggacatgccgttggcattcgggccgatgtgggcactgaagccggcgtccaagcaatctacgataaggcaattgaagcgtttggtgatattgacgtatgggtcaataatgctggcttcgagattcaatcagctacgcacgagacttcgtatgaggactggcaacgtgtgctgcacgtcgatttagatggggtattcttggggactaaaattgctgtgcaacactttttgaagcacaataagcaaggtagcattctaaacacgtcgtcaattcacgacattattccttggcctacctatgcgtcttacgcaacggctaaagctggcgtgctgatgtttactaaaacaacggctttggaatatgctgagcaaggtattcggattaacgcgatttcaccaggtgccctagaaacgccgatcaatgcacaacgatttgcagatcctgccgtccgggccgacacggaaagtatgattccaatgaagaaagtcggggacccggttgatgttgcgaatgcggcggtttggttaatttcaaacgaagcttcttacattactggtacaacactttatatcgatgggggaattaccctctataatgaattccaaggtggtcgtggctaacgtcatggtcgattggttgatgctaaccgtgacttttgaattggtcacggttttttcgttatttttaaccgattaagcaaatttttggtacacttaaaataatacggccggttagtcttatgccttaatttagaggaggggtaaccgattgccaaatgataatttattcagattggggattgtgccatggcagaacaaacaatggccacgcgagtgattgaaaaaattcgacttcgcgatttcatcatctttacaattggaaccagcatgtatggttggggactagttaacgttaatattccaagtcacttggcggagggtggtgtgaccggaattacgctgatttttagagcgctattccatattaacccggctctatcaaccttgttctttaatattcccctgttgttgctcggtttacgaatgttagggaagcgagccttgatttatacattgtacggtatcattggcttgtcattttggctgtggttctggcaactgtatcccatgcatttagatttgcaccatgatttgcttatttcagccattttagccggtttctttggtggccttggttctggtttgatttatcgttttggaggcacaacgggcggaacagacgttattgcgcgtatcctggaacaaaagttaaacattccgatgggaaaaacgttatttgcattagatgtggtggtcctaacagtgtcactagtctacattaatgtggtggaaatgatgtacacactgattgcggcgtttgtattcgcccagcttgttaattttacccaaaagggcgcctatgcagcgcgggcattcctgattttcaccaattaccccgaagaaatttcacatgctatcatgcaagagcttgaacgaggcacgtcactgttgcatgcagagggtggctttacgcataacgaacggaaagttgtctatgctgtcgtcgatccctcagagatgaacattgtgcgtcggctaatcaatgatattgacccgcaagcctttgtgactgtgatggatacacaggagacattcggtgaaggtttcagttacgcgcagcctaagaagcgccggttcaaccttctaccttaaactaaaaagacgaggtaacctcaaatgggttatctcgtctttttagttaactcgcacaacaacaattataggtttgcgtgttgtgcatcagtcatttctgttgcaatccgtgccatctcaggtactgattcatgcatccccgtggcaatccagcgaatagctagtgccaacatcccagatgccgtaaagtcagaaacataatcgatagatgtcgaatggtttgcttggctgcggaacaattctgcatacaacccatgcaaaatatcgcgcaaaggtgggtaaaattgctctcgtaatccggcgttcaacaaaacggcaatcgccattccgtttgcttggataaagccaaagaaggcactcgcaatttgttcactttccaaaggcagagcaacagcttccttcgcaaagtcatctgttagttgttcaacaatagtcttgatgaccgcttcctttgtgccaaagtggcgatagaaagccatccgtgacacgcctgccatgcgggtaatttcagtaaccgcaagttggtcataggactggctttgcaacaaagtcagcgttgcatcaatgatttgatcgtcagtctgctgacgaatactctccgttaacatgttcttcatgcttccaatataccgacttttaaggttgaacggggtgggttatcgataatcgcaagctgacctttaacgcctttaacaatcatttaactttgccactgaaatttaagactaatcaaataaaaaaatcccaaaacaataccaattgattgctttgagattaaagactttgtttaccgacgttgatcgatatagtttttcaattcgggtgataggactgtttgtacgtgttgtaaatcagcttgccgttcagcaccgaccatcgcgtaaagctttgcgagatggttttgccaacgctgaatttcagtgatgacaccatcagttccctcgttcaagaccgtgtgtaggaaatgtcctgcgacaccgaccgcttttgcacccaaaatttgagctttcaaaacgtcgagggggtcttgaataccgccagtggcgaggagtgttggtgcatctgcgactagttgcgcttctaacaaactttcggcagttgtttgaccccagtcatacaaatagccgtgctcagcagtcatcgcccgattacgacgatcttcgataacggcgaagtttgtccctgaacggccacccagattgatatattgggcgcctaaatcacgtaattggccaatggtttccttagccatgccgaagccgacttctttgataatcactggcacggaaaccgtctgaattatattggctaattcatcttgccaaacatagtcacgatcaccctcaggcatgaccacttcctgggcgacattaatgtgaacttctaaggcatttgcgccaatcatatcaacgacttcttgggcatgagccgcggtatgaccggcaccaatgttggccataataaagccatcggggttgatttctcgaacgactttaaatgtgtcaatcgcattttcgtcctttaaggctacactttgtgaaccaacagccatcgccaagccggtctcttttgcagcagttgctaactgcgcattaatcttaccggttttttggctaccaccggtcatcgcttcgatataaaaaggggtcttaaagttgaaaattgggtcatcaaccgttaagtcaacattagcgaccctcgtttcaggtaacccttggtgaataattcgaacctgatgtaaagatgacactggcgcatggcgccggaattcggcttctgccaatgacaagtgttcatctttacgatgtgcgtgtgcagattccataatactttctcctaattaaatgcaattgctaaaggtaacggcgtaattccagcacgttgccaagcatctctaattgcggttgcaactgtcgcatcatttgtcagggcgatgccattatcaccaccgccagctcctgatattttagcacctgcaccagcttctgtggcgattgataggagtgataggagtgccggtgtgacataggcgagtccaacgcgactggcataggcaaataattgttcctggctcaattgcatggccgcacgaactttatcaaaatcggcttggcgcaatcctgtttcgatcataccaactaaaggggcagtgttctgtgctaagagttgtttcgcagcatctcgatcagttaggtcaccactttcgagtagcgcttgtgtatccgcaggcgatccagtccaaccgaccaagagtgaccaatcggctggcaacgctaacggttcgattaccaaatccggccaggttgctgccaacatttcagaaacatagcgatgttggtcaagccagtcgaatataacaggtgatgcgaatttttgatagcgaataatgccgccaaatgtcgcagcggccaaatcccccatagaccccgccttaaaattaggggtcgttaaggtagctaatgcacccagcttatattgttgtaatggggacattggtaactcgctgagcgcaacataagccttaatcaacgccatcacaacggcggctgatgaaccaagccctaatttttgtccggccatggttagttggctatcaatagaaacggtcaacccagtaaaaggttgaccgttttctattgcatacgtctggattaattgcaaggtgcgaaggactagacgccagtcatcatccaaagcgaccgtcaacaattcagaacttgataattcacggtggccaagtaaattactcgtcacactgattaacgcatccgttcgtgggtcaagattgaccgtgacaaaacgatcgactgccatgataatgctaggttgcccaggcaatgtgactgcatattcaccggctaaatataatttgccgggggcttgtgccataaccattaaatctgatctccttcaacgattttgatacttggacctggcgttgcagtacgaacgacgacaccaggaattgcctcagctaaagccgttgtgatgacctcagtatccgctggtcgtgaaattaacttgacgtttggtccagcgtccattgtcgcatagacggagatgccctgttcacgaagcgtggttgctaggttaatgacctgccatgaggaatcagttaagtaattaaacgctggctgggcagtggcatttgttgcatgcatttgtagcgcattggcttccgctaattgaccaatttgatcaatgtcgtggttcgcaatggctgtttgcataacaggcaccaaggcattcgaccggttaacccaatcatcatagaaaggtgaggttgcttttgcatgttgcataccgccacgtgaatctatttttttaggctgatcgttaataatcactgttaacaattgtattggccagtcaattgtctcgaccaagggcttagcaactgatgttaggtcatcatgaccgcgatcccattgggcgaaaccgccaaaaatagaccgtgatgctgacccggacccacgacgtgctaatcgtgacagttcagctggtgataaagccaggccagctgcgcgactagccgcaccagctaaggcagcaaatgcagaagccgaagacgccaagccagctgccgtggggacgtgattagccgaatgaacgtgtgcataacgtgtttcaccagccatttcacggaccaaatctaagaagcgggtgactttgtcgtagcctttaccagtcatgacttcatcatcaagcgttacgtcatccgtaatcaatgcggcatcaaaccaaacagttgtatcggtataaaattcatccagggttagcgaaatcgacgtcgttgttggtaacatgagcgttgtatctgctttaccccaatacttcagtagggcgatgttcgtgtgcgcgcgtgctgtgtagtgtgtcataactgcctcctagatttgcgggtactgttgtgaccacacttcttgcgcaccagctgcttccaaagccagcataatgcggtgggcatcagtatcatccttggctagtgctaacatagcaccaccaacaccaccaccagttaacttagcccctaaagcaccagcttcacgagctgcttgcacaagggcttcaagctgggggtgtgagacgccaagagctgccaaatgttggtgggctgcattcatgtgattacccagggcaatgatgtcatcgtgagctaagtcctcacgtgtatcacgggcaatggcacctaatgcatcaatatgggcctgcgtttcaatgggctcattggctagttgttcgcgaacaactgaaacagccaaaccggtttgaccatgaacgcctgtgtcagcaatgattaaggtaccatgtagggccattgacattggttcaggcgctgaacctttcacaaaccaaaccgggacgtcatgggcagttgttgccgcatcgatgccggaaggtgaaccgtgggtaatggcctcttccacattagcccagcgttgcaattcttcatccggtaagggcgtatcaaaaaatgcgaaaaacgccctaataatggcgatcgccgatgcagcagaagaccccatcccgcgttcttgggggatgtttgattgaatccgtaaggtaaacggtgcatctagcgcgtcgaaatgacgcaagagacgcagaattaattgtcgaacgccttcatatacttcagccattgttgccaaagggccttgatacccttgcgcaattacgacttgtccagcttctcgagcctcgattgttgctgtcattgccaagtccggtaaagggagggcaatggcaggttggccataaacgaccgcgtgttcgccaagcaagatcactttggcgtggctagaaccactcgctagcttttccactattagaaaccaccaatccattctcatttttgtttttaaactgctactatcataccaaacccgcctataaatagggaaatgaatcagtaaaacgtatggtataatttaaatattataaaagaaggtcgtggtacgctctgatgctaaatagagacatctatgcggttgtggacttagaaacaactcgtacaacgagcgaaacgggccgtattattcagattgcggtcgcattcgtacaaaacaaaaaaatcattaatcaattttcaacattggttaatccgggtgagcaaatcccccgcaatattacacaattgaccggtatcacccaaaacatggtaaaaggggcaccgttctttgaagacgtcgcaatgacacttcatgcgatgctacaaggcacaatctttgtggcgcacaatgttaattttgatttaccatttttaaatgcagaatttgaacgtgttgggttaaccgctcttaaaagcacggccctagatacagtgccacttagtcaaattctttggccaactgcaccaggttaccgcctcgtcgatatgacaaattacttgtcactcgaacacaatcatccacatcaggctgatagtgatgcattagcaaccggtgaattgttaattgccatcttaaaacgggccgaagggttaccaatgattacgcttcaggcgttagctgatttgccattggtcctaccacgcgacacgaaaaccgtatttgaaaaagcgttagcaaaaaatcaagcagagccacaaccattacctagtcacttacaagtgatcgatagtttggcgttacgtcgtttttcagaaccggcgccgttggttactggtaaggcgacaagctatcctgctaaaaaggctgcgaaagagcaactttacggcaaggcgttgacataccgtgaacagcaagctaagttgatgaatgccatttacacgcattacactgaggctgaactgtcagaaacaccaggggagacagcctttgttgcggaagcgccgacggggatgggcaagacgttagcttatttactaccctacgcatacctagctgatgagcagcgcaagcaagtggtcgtcgccgttccaacaattacgttgcaacagcaagtgaccgaaacaatcaatacaacattgaaggatattctgccgtttgaagttcgtggcgccagcttgaaggggcgcacacattatttgaacttgcagagtttcaagcgcgcactccgcgttgatgaagggtcaacgtccctccaatttattaaggcgcaaatcttagtttggttaactgaaacgttaacaggtgattttgacgagttgaacttgattaacccgcaagtcgatttcatggcaaaattagcccagccggctaataatccagcaggatcaccttactacggtcacgagtttagtgaacgccaacacgtcttggcgcaaaacgcccaattcttggtcgttaaccacgcctacttggcggaatatgccgctgaattgggtgacagtattgatacaccatatttaattattgatgaagcgcaaaatttgccaaatgcagtcttagaacaaagtcgccatcaattaccatttcaggtttggttgacacgtgttcagaacgcgacaaatttggttttgcgcgataacgaaccttcaattggcattattttgaatcggttagttggtgggcaacagctcaagtcacgttttctacagagtcttgaagcattgtcttcagagttgcccaaattacaagtggcattctaccgtcgtttcttgctaaacggacacacaccggcaacagaggggcattacgaggttgagctaccaatttctgatttagcccaattttgggtcgaccaaacacatcgtttgcaaagtatgcgacaggccgtacgtgatctagcagactccttggattatttgttagcccaatttagtaacacgaagaatgccttctcactcagtgaacggcaacatctagctgatttccgccggttgcttgaaagtattgcgaaatacgagcaacgactaaccactttccaacaggatttggttgattttccagatgcgagtgtgttctggctaaccgaaaatcaaaatcacgataacagtaatttaaagttgagtggtgggttgttacacacgcttgatttctttaaagacaaggtttatccgcatttcatgccaccaaccgtgattggtgcaactttgtttacttcaacaaagtcggggtacttatatgatcggttaaatatcgatcgcgagacggtttttgcccggcgttatcctgaagtcttcgattttgcgcaccaagctgaattggtgatggttgaaaatgcgccatcgccaaccgatggtggctacgttagctacttagctaagcagttggttcagttaaccacgacggtgcaagaaaacacgctggtattgtttaactcattagagacgattcaacaggtctataatcacatgcagtcaaatcaaacgtggcagcagggtaatatgactttgttggcacaggggatgacaggtacgcgtagtaaaattatgaagcgcatggccaatgaatcacatttggttgtgcttggcgcgaatagtttttgggaaggcatcgatttgccgggtgaccaattacgtttagtcgtgattgcccgcttaccgttcgatcaacctaataccgtcctccaacgtgctgaagaagccgttttgatggcacatggtaaacagccgttctaccaaagtaccttacccaaagctgtcttacggcttcgtcagggagtagggcgtttaattcgcaagccggatgactttggtgcggttgttatctatgacccacgcatcctaacaaagtcgtacgggaagactctgcgaaatatgatgccagatcaaatgccacagcacgtttcgcaagaccgagatgttgtccctgaattgaagaaattctttgaccaacaccgctaatattggtaaagtaatagatgattttgttttgcattgacaaaacagctaaaggagccacgtaagatggagatgcgtacaatgtcccgttctcggcgtcgtggccacggtcggcgttggctgattggcttaatcgttgttctggtgcttatcgcaggtggtgcaactattgcgtcaattgcgctacgtcccgtgaatactgcgcgggaacgtgtgacggaattggcgattaagcgaaataagatcacctcagcaactcaatttttccgagtttctcgacaacatacgtactacagtgtgattggtgagaataagcagcatcaagaaattggtgtcattgttaaggataagtcgaaaaagataacaaccgttcaaatgaagaatggcttatctgctgctgaggtgcgtaatctcgttaaatcaaaatatcagccaaagcgaattaccagtttgggcctcgccatttatgagcaggtcccagtttgggaagtaacctttactgataggcaaggtaatcttaatttaattaccttccaattctcggatggaaaagcagttcgaaccatccaacacttataagttgatattaattaagggagttcatagagatggatacaattcgcattgaagacgcgaaaaactatgtcgaccaagaagttcgtctaggcgcttggctacgtaacaagcgtggttcaggtaagatgcaattcttgcaattacgtgatggtacggccttcttccaaggtgttgtttcaaaggaagcagttggtgaagaaatcttcgccaaggctaaggctttgacacaagaaacaagcatgtacttgattggaacgattcgtgaagacgaacgttcaccattcggatacgaaatgcaagttaaggatttgacggtagttggtgaatcggatggttatccaatcacgccaaaggagcacggtactgatttcttgatggaccaccgtcacttgtacctacgtcacatccaaccatttgcagttttgcgtattcgtaatacaatcattgctgcaacttatgaattcttcaacaaggaaggcttcgtcaagattgattcaccaattttgacaggttcagctcctgaaggtacgaccgaattgttccacacggaatacttcgatacggatgcctacatgtcacaaactggtcaattgtatgccgaagcaggcgcaatggcctttggacgtgtcttcacatttggaccaacgttccgtgccgagaagtcaaagacgcgtcgtcacttaactgagttctggatgattgagcctgaaatggcctggatgacacaagatgactcattggaagtgcaagaacgctacattgcctacttgattcaagctgttttggatcgtaaccaatacgaattggacttgttgggtcgtgacaaggagttgttgcaatcatacacacaacttccttatccacgtgtttcatacgatgacgctatcaagcttttgcaagaaaacgactttgacgttgagtggggtgttgactttggttcacctgaagaaacattcttggctaaccactttgcaaagccagtctttatcacaaacttccctaaggaaattaaggccttctacatgaagcgccaccctgatcgtgacgacgtcgttatctcagctgaccttttggcacctgaaggatacggagaaatcattggtggatctgagcgtgatacagattacgattaccttgagcaacgtatcaaggaacaaggtttggatttgaaggaatactcatggtacttggacttgcgtaagtatggttctgtgccacactcaggcttcggtcttggtctagaacgtgctgtcacttggattactggtgaagagcacattcgtgaggcaattctagttggttaggacgttcgcctgtcacgcgaaagatcacgggttcgaatcccgttgtgaccgttataatggctcggtagctcagttggtagagcatacgattgaagctcgtagtgtcggcggttcgattccgtcccgcgccattaccttaaaacaaaaggtacagatagttttgcggatgtagtacaatggctagtgctccagccttccaagctgggaatgcgggttcgattcccgtcgtccgcttttttgttttatgggactgtagctcagctggttagagcgcacccctgataagggtgaggtcggaggttcgagtcctctcagtcccattggttaaaagatttaacttttgacatggggacatactcaagaggctgaagaggcgcccctgctaagggtgtaggtcgggaaactggcgcgagggttcgaatccctctgtctccgctctgataatggtaggcgattgtctaccatttttatttgcaaacgatattgataaacgtgattctgtattctacagagtcacgttttttattttaatcgattaggagtatgcaccgagataggatcacatgccaggtcaaccatattagccatattgtgttatgagatgaagtttttgcatattcaaaataaatgtcgcgaccttgtcataatggcaaggttgggtggcaatgctgatgtacagtatatgcggtcaatgatatctttcgtaattgcctatgaaattaattagcgtgcctgttaacagttaacagggtgcgcttgtaagttgatattctccccgttaagataggaatatcttatggattattgggagattatgtaatgaaggtattaagtggtgcactaaagcgtcgacgtgaacaattggggatttctcaagcagaggctgctgaaggaatttgtcatcagtcgttactatcacggattgaacgactagatgaggtatcgaatatcacagttttacaaaagctatgtgatcggctacaactaacggtatccgacgtcgcacgcatggataatcgcatgctgacgacgttgagtgtcgtgcgtcaattgattgaacgtcgcgaaatcgagcaggcagcagaagcactggaaaatccggggttaatgagtcgtatcccagtctttgcctatccggaatacaatgtcttgtcagcccgggttgcgttagcagaaaatcgcattgcggacgctatgcaattgttgcagttagccttaggagatgtcgaaaagcatcagtatgagttgacggtcgaaattttcacggagatgggtgcgacttggctagcgcagggtgaacacattaacgcgtcggaatgtttcgaacgggctcgcggtattatccatcgattaccacgggatgtgcaactcagtatggcacgtgttattgcgcatacgaaccgtcatcgagcagagatgtatttggctgttgaagatccgcaacgagcgatggaacgggttacggaagcgattggtatcctacccgcacctgaagtgacagactatcatgaaatggtagagctacaaatgttgcggtcgcgttgtgcggatgctttatcgttagaagaagaatcaacgaacgctaagatgctagtatatgcagctgctgaattttctaaggatgccaaattgcaagatgatgtgaagcaatatttggccccagttatgcctgaagaggtatagctattaatgaataccaaaaacccccggcaaaaattttgctgggggttttagtattagtaaccgcgtgttaaatccacgacattgactgatagtggctcgtttgctaagtaacttggtaagttcttcataaataaggggaacaggttgccagcacgtcccgcactagaatgttctgcccaagttgtatgttgcgttaatagtaggttgggttgttgccacaatggtgaatcatcaggtaatggttcaggcagcgtgacatctaatgctgcctgacggatagtccctgcttgcaatgccgcgattagatcagcttggttgactgtcgtgccacgaccaacattgatgaacaaatacaagtcaccaagggttgcaaaccgttcagcgttgaaaaagttaaccgttgtgtcggtacccggcaagacgtcaacaacgacggcaatatcatcgggtagtgcaccgagattgtcgattgcgacaacgtcatcaaagccgtcaactgggtgaccagaggtgttgacgccatacacacgtccaccaagcgccttcagatagtgggcgatttggcgtccgatgttgccagttccaaagataacggtaggtaactcgctaatcgtatattgatcagtgaattcttgccagtgagtttgggtttgataaacatttaacccccgggcgaaatataggatataactgatgacagattgggcaattgggacagacttcaagccgctggcgtttgttaacatcacctgtcggtctgcaagctctgctaaaggcatgtaatcgacaccagccgacatggtttgaacccaccgaagtttgctagttggatcagcaaggatttttttaccgatttctgttgaccagccgtaactaatttcaatttcgctgatatcagctgcagtgactgtgtcaggtgtcacaacagtaatgtcgaggtcatgtaagacggcgatgtcttgcggttgtaattttgtaacttctaagagtaagcgtgacataataaattcctccttgatttgggttgcttacgataagtgtatgtcatttataggagttcgtctattaatagtgtattcccttttctccactgtcagcacagatagcctgctataataaccgcattaataaatttagaggttattggaaatgacaaatacacgcttgaagactcgtcaaatggtattgacggcgctattcattgcaattattttggtacaatcaattattccatggttgggttatttgccacttggtgcttttgccgtgggtgcggcggtgcaaattattagtgtgacggttgctatcggtgcacttatccttggaccagcgcgtggtgcgttgcttggttttgtttggggagcatacgcactatgggatgcttggacacacgcacctgtaattggtggactgatcttccgcaacccaattacggcgcttgtgccacgtattctggtggggttggttattggttatctctattggcgttttgtaaggaaccgttcactggggcaacaaacaatttggcttgttggtcttggtgcattgtctgcctttattaacacgttctttgtacttggtttcacgtggattggctttaccgtgatgcacacgacctttaccggcatcccacaaaccggcttgcttggttggttgattgtcggagttgctggtttcaatggtatttttgaaattattgtgtcagctattttggtgccgttaattggcgtacctgttttgacggtgttgcgtcgagcagaataattcatatttttcagataagggcgacttggtcttagaccaaatagttgcggtgtaaatcccagtttcattagtgaagctgggatttttttagcgacaaatgtccggaaagggtgatttgtatgaataaattctaaagtgacataaataaagtggcaaaaataggacatactctgtacaattagaactatgtaagcatttattcattgtttagggataatttaatattttataggaggcaaacagtatggatttgacaatgggcctgtctattttagacttggcacgtgtgcaatttgccatgacaactgtatttcacttcttcttcgtaccgctgtcaatcggactaggtttggttgttgcaattatggagacgatgtatgtcatcaaaaaagatgagcaatacaaacgcatgacgaagttctggggtaagattttcttacttagtttcgctgttggtgttgttacaggtatcgttcaagaattccaatttgggatgaactggtcacgatattcacgttatgttggggacatctttggaccagctttggctgttgaggccttggtagcgttcttcatggaatcaactttcttgggtttgtggatgttcggttgggagcgtttcaataaaggtcttcacctggcctttatctggattaccacgattgggtcagccttttcttctttgtggattttggcagctaactcatttatgcagaatccaattggtttcaaggtggatcataagtttgaccgtgccgttttggttgattttccagctttgctacagaatcaccaattatggctagaattcccacacgttatctttgggacgttcttggcaggatcatttgttgtgatgggtgtatcagcttggtcgctgctacgtaagccaacacatgagctagatttctttaagaagtcaattaagattgctgcaattgtggcattggttggaacagcgggaattggtttgacgggtgatcgtcactcattgtacttgcaagatgaccaaccaatgaagttcgctgcaactgagggacttgataaaaacgttggtggtaagaacgaatcggcaccatggtcggtcgttgcttacacgaatccaaagactcacgaagttgaatggtcattggacgtgccatacgtgttgtcaattttggcgcaccactcgcttgttggtggaagccaaggttggacagaaattaataaagaattacacgaaaagtatgatcttaagtttggtaaggatatgaactactacctaccaaacaatacgatttattatgcgttccgtattatggccatgtcggctggggctttcggcctcttatcagtcgttgctttgtgggctgttcgtaagaagtctaagcttgatattacgaaatacaagtgggcattgtggattttcggactagcaatgtacttgccattcgttgccattacggctggttggctggttacagaattaggacgtgcaccgtgggttgtttacggcgttttgacaattgctgatgccgtatcaccaaatgtgtcatttgcttcattactaacatcaaatattttgtacttcctaacgtttgctgttttgggtggcttgatggtgatgttgtcacgacgcgtgatgattgccggacctgattctgaagaacgtgtggccgaagaattggttgatccgttctctgcaaaagcatttgaagctggcaaggaggcttaagcatgacagattttcaaattttatggtttgttttgattgccgttctgtttgctggatttttctttctagagggatttgatttcggaattgggatggcactgaaaggtgttgcgaaaacagaacatgaagaagatgctttgattgcatcgatcggtcctcactgggatggtaatgaagtatggttgattactgctggtggtgccatgttcgcagcgatgccattttggtatgcatcactattttcaggtttctacttaattttatttgcgattttgttagggttaatctatcgtggtgtttcatttgagtttcgtgagcaaatgaagacagccaagtatcgtaatttgtggacaaccatctcggcggtcacgtcgttctttgtaccgttcctatttggggttttgttcgcagatgttgtgcaaggcatgccattggacaaagccggcgacatgtcagcaacgttctttgattacttcaacgtcttctcaattattgggggtgttgcagtagcgttgttgtcatatgtccacggtttgaattacttacgtttgaaggtagagacgggcgtactacacgaccgggttcaaacacaaatcaaagtgttgtatccagttttgttggttggtgaagttgcttttgcggcaggcttgttcttgtttactgacttctttgctaagaagccgttgattacggtagcgtttctagccgtgattgtcctactgacaatcattgcgtggttgactggtttgaagcggcgtaatgtttggtcatttatcacgttgggattggccatcattgcagtcgtgttactactatttaccggtttgttcccacgtgtgattgttggggatgtaccaagcatgtcattgctgttgaagaatgcaacatcatcagcatacacactgaagtggatgacaattatttcgttgacggctttgccaattgtcttggcataccaaatttggagtttctacatcttccgtcaacgcattgttgttaagaagtaataatgcccggcacgtacggacatggaaggggatcaaggttaacttggtcccctttgtacatatcgagaaaatggagagtttgtcatgttagataaacgattgtttaaatttccgggtgcccggcaagcgctcggcgtgttatcactactaacgttgattcaggcgattgccattattggtcaagggcggtttctaagtgtcgccatcactgatttgtggggtggccatcaattaacatcaattggcatggtgcttgtttggtttatgttggcttatttgttacgacaagtgacgggggtcgctaagcaatacgcgttggccccatttgccgataaaacgacggctagtttgcagactcaattaacacagaagtatgcggctttagggccgcgaacggtggcaaatcaaggtactggtaagtcagtgacgttagcagttgaaggaatcgaccaagttcatgattatttaaccttggtgttggtaaaattatttgatatgagcatcaccccgtggctcattttgctatatattgcgacgattaattttaaacaggcagtatttttatttgtcatttatccagtgatcgtgattttcatgattgtactgggattggcggcccaagctaaggctgaccgagagtatgaaacatttaaccgtttatcaaatcatttcgttgattcactccgtggcctaacaacgttgaaacaattggggttagccaagcaatatgcgcaaaatatttacgatgtttcggaagaccatcgtaaagcaacgatgagtacgcttaaaattgctatcttatcaacgtttgcgttggacttttttacaacattatcaattgcggttgttgctttgttcttggggttaggtttaatggatggggcaacacacttgttgccggccttaacgattttagttttggcgcccgaatatttcttgccaatccgaaattttgctaatgattatcacgccacgctaaatggtaagaacgctttagcagatatcatgactttgttagaacaaccggttgcgccagaaacgaatcgatatgtgcgacagagtcaacgttggcaagcaacggatacgttgactttagaacaggtttcatttagctatcccaatgctgatcgaccagcacttcagcagattaacttaaccttgaccggtcatgccaaagtggccttggttggtacttctggttcaggaaaatcgactttgcttaatctgttaggtggattcctagttggcgatggtgatgtaaagattaatgaacaagcattgccacacctgcagcagcgacaatggcaagagcaaattcaggtgttgccgcaacatccgtatatttttcatgacacactacgagctaacctggcattttatgcacccgatcagcgtgatgaagatctgattgcagtgttacaacaagtgggacttgccgattggtttgctagtctacctgatggcctggatacgttaattggtgaaggggcaatgcaaacgtccggtggtcaagcacaacgaattgggttagcccggattatgctcgatgaagagcgtcgcgttcttctgctagatgaaccgactgcgcacttggacattgaaactgaagcgctattgaaagagacgatgttaccggttttcgacaatcgattagttatttttgccacgcaccgattacactggttgcgccaaatggattggattattgtgatgcgagatggtcaaatagctgaacaaggaacgctggctgacttaattgcgaataacggctacttcgtgaccttacaagcagcgatgcgaggaacgacacatgcgtaaaatgatattactgatcaaacgagacacctgggtatttccatacctcaggtcatataaaaaattattagccttgattatttttttaggatttatgacaacgttctctgggacagctttgatgtttacctcagggttcctgatttcacgttcggcacagattcctgaaaatattttgatggtctatgtcccaatcgtgttgacacgtgcattcggaattggacgaccatcattccgctacgccgagcgactcgtgtcgcacaattgggtacttaaaattgtgtcgaccttccgtcggcggttatatgagttagttgaaacggggacaaaatcggtttatgcgaaaacgcaaacgggtgaggttttgaatgttttagcaaatgacctgtttaaaattgaaaacttttacttgcggacgctgtttccaactgtgattggattagttatctacgtcctaattgcgattggtgttggcgtatttgattggggatttgccttggcaatcttcctaattttggggatgacaaccattttagcgccaatgattacgctagcggtcaacggggcacgtgattttaaacaacaacaactagaagctgaattgtatacagacttaactgatacggtcatgggcttgcaagattggattttagctggccgaacagcagaactggctgagcgacaacaagctgacttcaatgccattaatcagttgaagtctaaacaggctcattttaattggtggcgtgattttagtggtgcgatgataattggctttacggcaattgtcttgctagtttttgcaactcgtcactttgggggtagcagctttggtgttaattggattgcagcgtttgtgctagctattttcccggctgaggatgcattgacatcaattagcactggggtaggtgagtggccacgttatcaaaattcgattacacggttaaatgaaatggacgaacaggctcaagctgaagcacagttgcaaacgacacagcaggctgcacagccaagtaatccgacaattgtgctcaatcaggtgacgtttggttatgatcaaacgccagtgctgcaggacctgtctctgacgattccagatggtcaaaaaattgcaattcttggtcaatccggcgcaggaaagacaacccttttgaaactattacttggtgacgaaatgccattggctggtacggttaccattggtggtacggccgtggctgatttaagtagccaacgtgcgacgttaattgcggtcttggatcagcaaccgtacttattcgctagtacggtcgccaataatttgcgtttgggaaaacttgacgcgactgatgaagagttgtgggacgtgttagaacaggttaatctaaaagaactcgtggtacaattacctgacggcctagcaacaccaatgagtgagatgggaagtcgtttttccggtggtgaacgacaacgattcgcattggcccgtatcttgttgcaagatacaccgattgtcattttagatgaaccaacagttgcgttagatccaattacggaactagcggtattggagacgatttttaaaacgttgcatgacaaaactgtgatttgggttacccaccacttgaccggaatcgagctcgttgataaggttatttttatagagaaccagcaaattgcgatggcgggtacgccagctaagttgatggcaactgagcatcgtttccagcgtctactagctctggatcatggcgatttaatgtcggaataggagggaaatgtgatggcaaaaagaaaaaagcgtcagccacgacggccaaaacgcaattttcagttgtcacattttttcgttaaaaaagggcgactgcaatggccacgtgtgattgtactagttgtccttattctaggtgtggctgtttggcaaacggatatgcaacatcatgaagctgccgcgcagacgccgacggctgatttaccgttaaatcaattaacccgggaacaattcattgcccgtattgccccagaagctcaaaatttgcagacggagtatggcgtgcgtgcgtcaattagtattgcgcaagctgccttagaatcggattggggacgatcggaacttgctgcaaagtataataatttcttcggggtgaaggcttcacctggtatgccaagcgtgacgctggctactaaagaatatgtcaatgacgaatgggtgaccattaatgcgagtttcagaacgtatcaagattggcgtgcgtcgatggatgaccacgcgtacctcttggcccatgggacgacggataatgcccagcgttatgcggctgtgatttatgcagccgattataaagcagcagcgcagggattagtcagcggcggttatgcgaccgatccaggttatgcgacaaaaatcgtgcaaatgattgaaacgtatcatttaaatcaatatgatgttaattagagttacgaaacgaagtgagaaaaagtatgagtcttgaatttttaccaggatcaacaattggtattttaggtgacgatatgatgagccagtatgtcgcccaagtggcccataatatgggttataatgtggcggcatatagcacgaaccctgaggcgccagtgttatctgaagcagattatcgtttcgttgaaacagccggtgatttaacagcactgcaaaattttttggcactatcatcaatggtgacttatacgtcatcctggttaccagccaaagttatcgatgcattggctgaatcacggttgccacagggaacggatttattacaactgactgatgatcatgctctgggacgggcttttgccgaaagccagtcattgaacattttgccgtatgaaacagtgagttcattggacgaggttgcacatgcagccgcagaccttggttacccagtggtggtcaaacctatttttaaacacaagcatcacgacgataccgttattctgcgaggcgattgggatttagggctggttgccccgatgattgatggtggcacgttgattgttgagacgtggctcgatgatgtccaagaatttgccatgacggcagtccgtggcgtcacaggggacattaaaatttacccgctacgtcaaactgcggttgcgatggatcacatgcggcgcgcatggactattggcgacatcgccgatgatttgatgacggttatgttgggtgtaacagagcaagtcggtgaagctttgcagtacattggtgcttataacgtggcattcttctacagtagtacgggtaacctttatattcgtgatattgcagcaggtgtgcaagaaaccgctgccgtttatacagcaacgaccaatgtttccgttgctgagcaacatgtgcgggctattacgggacaagcactttcagacattttaattaatcaggcagcaatctatatgccgtttacaactgaacaagtgccggcattgatgcgtcattgggaaattcaagctaattggcagatttatttttatcgttttcctgatacaactggaaaagcagggtacgtcttagcttgtggaccgtcagtgacattgctgtttaatcaattacacgtggccggtgtctggcagtttgacgattaacattatcaaataaaaaaactacctttacgtttacgtcgtaaaggtagtttttttaacccatcataacttggaacagcgtgatgaacacacccgccaatgagagtaataacataaaaataacaaagccttgaataatcttttgcatcgttgacttttcttttttcttagccatatggatttccttttgattgttgattaattctattgtaccatttgccgatatgatagaatagacaagtagaacgactgttagacagttgttaaaattagtgtaggaggacaaccatgctgacagtttttaactggcccattacggtcgccctggcttttgttatttggggtctcctgtggattggtcaacgcacggtcttcctgtatagctggccgaaacatttgcgggcaattgatttagcaacatttgtaacgtggtggagtatcgaatcgatgacgtttcaaatttggcatcaatcaattttagcgccaattttattgatgtttgtcctctggggcattggcatcgctctgtatcaaggttttgtgcgcgaaacgtttgagacgcgcaaattctggattatgtggtggcgcgttgttggtttgggcagctttgtagtaatgattgcaatggcaatctttgcttttgttgtgacgaaatagaaagagataataattatggaaaaaattgaaggttacgttaagacctggaatgctgataatggctttggttttattgaattgaagggtgaagaggatgtcttcgtccacttttcagcaatcgagacacctcgtgttcgtgatttagaagttggtgaaccggtcaagctagttgtcgtacagggcgttcgtggtccacaagcagcggctgttgaggttaaagtgactggggaggcataacatggcatcacaatatgacgataagtttcgtgagcgcgttatttctgaagaggaacaatatgacggtcatatcgttcgggtaaccgagcagacggttgttttgccagacggtcgccaagctaagcgtgatgttgtttatcatgccgacgcaattggtgtattagctttgaccgccgatgatgaaatgattctggaacgtcaatggcgtgcgcctgtcaaaaaagtgaccctggagataccagccggtaaaatggatgaccgtgatacggatccgttagatacggttaatcgtgagttaaatgaagaaacgcggttacaagcgggccacgtcgaaaaaatcgccggtttttatacgtcgattgggttcgcggatgaattcatgacgctgtatttagcgactgatttggtgccagtcggaaccgaactgccacaagatgacgatgagcaaatcgatttagtgactgttgactttgctgaggcaacacgtttgtttgaagcaggcgaacttgatgacggtaagaccgcaatggcttatttgtactggaagacgcttcatttggcaggtaagtaatatgttttggcggaaggaaaagacccctcaaggtccagctgattatacgaccgatggcaatgacgatgggctagggagcgtaccgttacagtcgcaacctgagcaagtaaacgatcatttaacgcgacgagagtatcggttatcgggtaagggtcgttatgaactcgacccgataacgcatgaattgacgccggtagggaaatctgcccggttaaagcatcgacttaatctcacgattattgtgttagtggtgttaatcattgtgacctatttaatattatttttgttgtagtagagtgattttgaaagtgagagtttaacaaatatgcgttatggaattattaatgccatggctgaagaaaaagcagccttggtagcagcaatgacggacgaaaagcagacgacaattgccggcaaactttttcaccatggtaagattggcaacgttgatgttgttgtggttgagtcaggaattgggaaggtcgcgtcagcattgacgacaacattgttaatcacaaactttgcggttgatgccgtgattaattctggatcagctggcgcattgggggctgacttacgcatcggggatgttgtggtcgcatcagaattggcgtacgccgacgcagatgcccgtgcatttgggtatgtctacggacaagtaccacaacaaccagcacgcttcgtgacggatgaagccttatcagcaggcttagcagctgtgtacggtgatgtgacagatgctcgtttggttcgtggcttgattgtgacgagtgattcatttatctctggcgaagagcaaaagcaaactattttggcaaactttgctgatgcacaatctgctgagatggaaggtgcgtcaattgcccaagtggcacattacttcgatgtgccatttgcagttgttcgtgctatctcagataatgcgaatggtgaagctggcccaacgtttgacgaatttatcgtcgatgctggtaagcaatcagcacaagtgttgattgatttctttaacaagcaataataatggctaaagagcaacgttgcaggatgatgcaacgttgcttttttcggatgatgataatcctgcgaccatacaggttgtgtcataacgggttataatagttgttaagcacattaacttacaaaaagtacacctttttatttccatttcaaaaatagttctgttattctaatatcattcattaagagaattacatgaaacgaaggagcatccgaatatgactatccgtggaattcaccacttgacgacgattacgtcagattcaccaaagatttttgatttcttttcaggggttttgggtcttcacttgattaagaagaccgttaaccaagatgacgtacgtacgtaccacttgtactttactgatgatatgggatcagctggaacggttttgacgttcttcgacttcccaggtatcaataaggccatccacggtacggatgaaattacgcgtacggcgttccgtattccttcagacgcttcatttgattactggattaagcgttttgatgaattcggtgttaagcacgacgcagaaactcacgaagagtttggtgtaaagtacttggactttgaggacttcgacggacaattgtacgctttggagtcaaacgaaaagaacacgggtacttgggctgaaggtacgccatggcaatattcatcagttgatccacaacacgctgtacttggtttgggtgcacaattgttgacgattaacaatgaaaacgctatgcacatggttttgacgtctgttttgggcgctaaggaagttgcccgcgacggcgacgatgttttgtacgagtttgacaatgccggattcggtggtcaagtacacacgcgtttggtacgtttgttgccacgtggtttgcaaggttatggaaatgcgcaccactttgccttggcagttgatgatgaaacggctttgaacttctggatcaaccgtttgcgccaattgggcttccaagactctggattcgtggatcgtttctacttcaagtcagagtacttccgtccaacgccaggaatcttgttcgaaatcgctacgaacggaccaggattcttgcaagacgagacgtacgaagaggctggtcaccacttggagttgccaccattcttggaaaacatgcgtgatgaaattgaagctggattgattccattcaactcatcaaacgatgatttaccttcaccagaggtattcaagaagaacgtttctgataacgcagaaaactaatgattattttgaagcaggaagcaagctaaaacttggttcctgcttcttttttgcaaattaggtacactaaaagtacggaaaataggtcgccttttacttgttaaaagttagttaaagtagatataatagagacacttactcgaacggagaaaaaataatggctaagaaaaagtataaaaacaccattcggcatgcttatgtgtcaggtgatcctgatttagcaccaattttgttactacacggaactggtggtgatgaaactgacttgcttgaaattgctgaattcttggcacccgaaaaccctaagatttcaattcgtggccgcgttagtgaaaatagtatgaatcgttattttgagcgttatgaagagggagagtttaatcttgaatcgttgcacgcagaaacagattggttagttgacgcggttcatgaactggctaagcgttatgagcttcatgaagacgcaatgattatgatgggcttctcaaacggggcgaatattggcgctcacgcgatgatggcccgcgaagataccccatggaagaccgcgttgctcttccacgcgatgtctgttgaacgattggaagagattcaagatttgacggatacgcgcgtctttgcatcatttggtgagtttgatccgattatctcagagaccaatttcgatatgctgacggaagatttgcgcaagggtggcacactattgtcaacatttgcaattaagacgtcacacacgatgtcacaacctgaaatgcaagctgcgaagctttggcttgatgccaatgacttacttgatgtggatgatgagccagaatggccagcttcaatgatgtatggtgaggatgaacatgatcaccaccatcacgatgaacacgatcatgatcaccatcacgaagaggatgatcatgattggcactacccagatggtcagccggctgaagatgaagatgaggtagccaagttgcccgaagactagtaaaattattcacataagcgactgcttaaatggtcgggaaagttactagtaaagggagatgtcacaatggcatttgaaacaacagttaaggtggtaggcgattcagtaacatatcgcttcaacccacaattaaagaaatacgcacttggtgatacaggatttgtcactaataatgcaggggcgtacgtgatgcaacgttcactcgaaccagctaagggattagcaaaggctattaagcttaaggttgtcgttgataaagatttatcaggcgtgaaaattaaaacggttaatcctaacggggcagccacggtgaacattttcaaccgcaaagataatgctgaaatgattgaactctatcggttctacttgaatgaactggttgaacgtgaaattttatttgctgaataacaagaaaacgcaatggccaagaatggcgccattgcgtttttatttatccagaacttaaagaaaccttgatatttgggcatttgcaaggaaaaagggataactaaaagttacggtattctataaaacgcaacttatcttttgtaatattaacgtcacaaaaggttcaattaaaccgaatgttaaggtaaaatcatgtaaaattcgcactttggacataaattatctagttttttaactggttaatcatttttgtagaaaagtgattagaacaatgatttcgactaacaattcgtgcactgttgcatcaaagtgacctaaaaacaggcgtttgagatagagacgtaacgcaacgacttttatttgtaacagtacgcgcgctcaggttggtaaactaatatctgttgttgagaggtacacgtgtcacagtcgcagagcaatttggccgcgactgttcgaacacatttgtacatttatagatatagagttttaaccaagaaggagaaatattccccatgaataagaagatgattactgcattggctgttgctggtatggctacgttcgctttgactgctgatgcatcagctgacacatacacggtacaatcaggtgacacgttgtcacaaattgcagcaaaccacagcacaacgatcgatacattggtcgcaaacaatgccattgctaacgctaacttgatttatgttggtgagcaattggaaatcgatgcagttgcttctaatgcttcatatgatgcaacgcaagcttacgtcgcaccagttgttgcgtcacaagcgccagttgcaacggaagcagttgttgcttcagcagagccagttgcaacgtcagtaccagctacggttgttgcttcagcagaaccagttgtttcagcaacgtcagctgaagatacgacagcttacacagcgcctgttgccacaacaccagttgccacgacaacgactacggctgctgcttcaggttcaacgtatgaccaatttattgccgctggtggaactgacgctatgtggacggctattgttatgcctgaatcaggtggtaacgttgatgcctcaaacggtcaataccacggattgggtcaaactaaccaatcatggggttacggatcagtttctgagcaaacttcaggtatgttgaactacgcaacgtcacgttacggttcagttgacaacgccattgccttccgtgcagctaacggttggtggtaagatttaaccagataataattaatcgataacacaaaagcgcttaacgaacacattgttcgctaagcgctttttttagttaacttgatggctttttgcggcgtcaggaaaggttagcacggctcctgtgacgggccacatccaatacttttgatttgcaatcaattgcatttgtagactgtaaacatctgtgggagtggccataatggtcacgtccgtgatgtgatcagtttgataacggcttggcactaaaatttgtgagaccaactgtcggtcatcgtcaattaggatgccttcgccaagggcatcatcagcaagttttactaaacgtgtcataaaatttctccgaatttgttagatgtcacggaataattcttgccaggcggctttgttgagcttcggctttttgcgtcgtggctgtcgtggcttgggcgtataggttgcttttttatactgccggacgatttcagcctggacatccttttccagtggcagggaatgtgccacaaaatcaatggcatcaaccggcaaatctgggtaggcagtgtggttatcaatgaaccattggcgcatctcactatttaatccagcatgacgccggatgcgttggagcaactcatccaaaccaaaatccaagtggtggattttggtttgcaactggcgcatgacggcttcaggaatgccaatgtgatccgcaaaatgtgtgatgccaagtttaataagtgtaccgtcttgattttgaaggacgtattgatgcttcaagcgtcgaccgcagtcacaatagagttgtggaccagtattcgcatcataattatcgttgtagttataggcgacaaactgccaggtgctaccgtgcccaattaaattttgatcaacaaaaagcgaagtgtgctgataacgaatgtgctgtttcaacactgcttgctgctctgacgttaaattatgccaagtttcttgtcgtcgttccttggtcagggagacttttgacgactttgcgtgcgttgccatgtttgacacgacctttctagtcaaaatacatggtaattattatacgcgttattggtagcccgcctcaagtaggcgttgtgaaatagcagcatagactgtctcaacatcgcgtggcgtcccgcgcagttcgtaacttgcaatcacgggtgcttgaaaggctacggcgtaccgacgggcagttaagatgtactgggcgttgaaatttttattaccagagccgacgattcctaataaatgctggcgattatcaccatatgaaatttgatcagccaaggcattggtcataatttcttttacaccgttatcgatgccgttaccaccatcgaggtaagttggtacaaatgcaaaaaatggtgccgtttcatcttgatcgaaactggcgtcagaaatctcgacggcttcaaacgtcaaatcatcgtgttccgtggcgtatgtcacgagatgattgacgaaagaccgggtattgccggaaattgacgtatataaaagacgaactttcatgatgtattcctcatatatgttttttctaatactattcctatacagtagttgattcaacctgtttttgcaaatttttcacataacggaaagttattttataatatttttgtaacattcacggcgaagcctaatacggcggtaaatgccgttgtcaagcccttttttgttcgatatcagtcccttgcattctgttaggttcgtcgctatactcaaaagcagatattaactaatgtcacgaattcaaaaagcgaaagataaaggtgaatgatatgcaaaacgttactgtatatacgaagaataactgtattcaatgcatgatgacgaagaagacgctatctcaatatggagtcagttatgttgagaagaatgttgaggaagacccagcaaccatggctttcttgaaggatcaaggttaccaagccgtgccagttgtgttctcaaatacagctgaaccaatcaaaggcttccgtcctgatttgttggcggaagttgccaaggcaatttaaacagctgcttcattagtcgtacacacatgctactcaaacgtcggtgcagccataacgggttccgctttacgttcggtagcacagggggaataatttatgtcactaggaacgctcgatttagacaaagtatcatactttgatctgaacaatgaattaaacattccaaaggataacagtatccaacttggaaaagacaaggaagcactagacgcgtttattcgtgaaaacgtcgtgccaaacacgttacagtttgacagtttgcgtgatcgctttgattatttaattgcacatgattttgttgatcaaaaaatgttgcaacagtacagtttcaatttcataacgcgcttgtatgactatttaaaggcacaagatttccagttcaagtcattcatggccgcatataagttttacgcacagtatgcagtgaagaccaacgatagtgagtattacgttgaaaactatattgatcgtattgcgatgaacgcgttgttctatggtgccggtaatgaagaattggccatgaatttggctgatgagatggttcatcaacgataccaaccagcaacaccatcatttttgaatgccggtcgttcacgacgtggtgaattggtatcatgttttatcctacaaacaacggatgatatgaatgccattggtcgtgtgattaattcagccctgcaactgtcaaaaattggtggtggggtcggaatcaacctttcaaatttgcgtgaagctggtgcaccaattaagggcattagtaatgctgcttcaggggttgtaccagtcatgaagttgttggaagattctttctcttactcaaaccagatgggacaacgtaacggcgcaggggtgacttacctatctgtcttccacccggatatcatgagtttcttggcaactaaaaaagaaaacgctgatgagaaagttcgcgtgaagacgttgtcgcttggggtgacggttccagataagttctatgacttgattcgctcaaatgcggatatgtttttgttctcaccttatgatgttgaacgtgaatatggtgagccatttaactacattgatattacggctgaatacgacaacatggttgcaaaccctaagattaaaaagtacaagattcgagcgcgagacttggaaaatgaaatttctaagatgcaacaagagtcaggttatccatatgtgattaacattgacacggtcaatgctgccaatccaatccacggcaaagtgatttcgtcgaatttgtgttcagaaattttgcaggttcaaaaagcttctgagattgataatgagcaacaatacgtcacgatgggatcagatgtttcttgtaacttaggatcaaccaacatcgtgaatatgatggcgacaaccgactttgcccgttctgttgaaacgatgatgcgtgccttgacgttcgtatctgataattcagatttggatattgtgccatctgtacaaaatggtaatcgtgaattgcacgcggttggacttggtgccatgggcttgcacgctttctttgcgaaaaaccacatgtattatggtgatgaagaagcattggactttacgaacgcgtatttcttgatgctgaactactatactttgttggcgtcaaataagattgctaaggaacgtggcgagtcattttatgaatttgaaaagtctgcttatgcggatggttcatactttaacaagtatttgatggctgactggtcaccaaagacggcaaaggttcaggaaatttttgaacaacatcacttcccaactaagcatgactgggcaatgctaaaagaatctgtgcaaaagcacggtctgtataatgcttaccggttggcaattgcaccaacgggatcaatttcatacgtgaatgactcaacggcatctttgcacccaatcattaacaagattgaagagcgtcaagaaaagaagattggtaagatttattacccagcgccatatcttggcacggacacgttgccatattatgaatcagcctacaatttggatatgcgtaaagtcattgacgtatatgcaacggcgcaacagcacattgatcaggggatggccttgacgctgtttatgcgttcgacaatcccagctggtttgtatgaatggaaaaacggccggacggataaaatgaccacccgtgacttaaatattttacggatgtacgcgtaccacaagggcgttaagtcaatttattatgtacgaacgtatacagacgatatggaagaattcggggtgaatgagtgcgaaagctgctcaatctagcgaattgtgaaataataagcaaaaagctggtataatctagctatgatttaagaaacggtcagggtcttaaaactctgaccgtttcaatgtgtaagtgataggggattgttatgactgaaggatacgttgccatcaactggaatgaagttgaggatgcgattgataaagcaacatgggaaaaattaactgaacaattttggctagatacacgtattccgttatcaaacgacttggatgactggcgtaagatgacagaagaggaacattatcttgtcggccacgtgtttggcggattaacgttgttggatacgttgcagtcacaagatggtatggcatcattgaagcgttcagtgcgtacgcaacatgaagaggcagttttaaataatattgagttcatggaatcggtgcacgcaaagtcatattcatcaatttttgaaacgttgaatacgcccgctgaaatcgatgaaattttttcatggacaaataccaatgatttcctacaatacaaggcgcaacgaattaatcaaatctaccaaactggggatgatttgcaaaagaaggttgcttcggtattcttggaaacattcttattctactcaggattttatacaccgttgtggtacttgggtcacaacaagttgaataatgtggcggaaattatcaagctaattttgcgcgacgaatcagtgcacggtacgtacattggttacaagttccaactaggattcaatgagttaacagaagaccaacaaagcgaaatgaagatgtggatgtatgatttgttgctagatctctataacaatgaagaacaatatactaagcacttgtatgatggtattggttggacggaatcagtgttgacgttcctacgctataacgcaaacaaagcgttgatgaatctaggtcaagatccgctgttcccagatggtgctgaagatgttaatccaattgtgatgaatggtatttcaacgaccacatctaatcacgatttcttctcacaagttggaaatggttatcgtttgggacaggttgaagtcatggaagatggcgattacaacattggtttggattaggttgcatttaaaaaattaaaatgctatcataattgcaagataaaagttaggtggaaacagtgatgcaaaatgcaatggcacaattaaatggttggtggcgcagctaacgcgtccgaattgttgattaacagattcggtacgtgctcttttagagcgtattgagtctgtgccgactgatttccgttaacgaaaggtctgcacgggttaccgcgcaggcctttctttttaccgcaagaggggtttgctaggagacccttttgcggttttattttgtcatgatagtaagaggatagcgatatgaataagaaagtgatggtagcgttagggctactcgcggcagttttagtggctgccggtgtgcaggagtctgttagcgaacagcggacagcgaaagtcccaacggttgggattttacaatttatgtctcacccagccttggatgcgattaataaaggcattcataccggactgactgagagtggttatcacgttggtaaggacgtcaaaattgatttccaaaatgcacaaggtgaccagtctaatctgaaaacgatggcgacgaaatttgcggatgccaacgatgccgtatcggttgggattgcaactccagccgcggttgcactggcaaattcgatcaagacgcaaccggtggtgttttcggcttctacaaacccgattggcgctaagttggtaaagagttaccaaaagccaggtggtaatgtgacgggagtgtctgatcaagcccctttgccagcacaattaaagatgatgcgcgcatttgtcccaggtcttaagacattgggggtgatttatacctcttctgatgactcggcgacgactgaagcgcgcaagatgatcacgttagctaagcaggcaggcttaaaggttaaaacctacaccattgcctcttcaaacgatttaaatcaaacgtcgttgcaaatggtggcgggccatcaagtggatgccgtatttgttccaacggataacaccattgccggggctatgacgacactggtcaagaatacggacgcggccaaggtaccagtcttcccaacggttgacacgatggtggcagatggtggcgttgcggctgaatcaattaatcaaacgaaattaggtgtcatgactggcaagatggtggccaaaattttgaagggggctgacccaaagtcagtgccggttgattttaccaaggctggcgaattagtcgtgaacaaagcgcaattagataaactgggtctgacattacctcgtgggtatacagacgcgaagcttgtaaagtagggagggcacacagatgagcattttagtttcagctattgggcaagggttattgtgggcgacactcggcattgggttgttcttaacatttcgaattttagattttccggatatgacggttgaaggaacgtttccactgggggcagccgtggcagtcacgctgattgcaaatggcatgaacccggcgctggctagtttgatagcagcgttagccggtgcgttagctggtctggtgaccggtttgatctataccaagggtaaggtccctattttgctagccggtattttaacaatgactgccatttattcgattaatttgcgtgtcatgggtcaagcgaaccggtcgctacttgggaaagaaacgttgtttacggcgcctttcttagactttttgcctaaaaattttccaacggttatggtggggttgctcattatcattgtggtgacaggtgccacggcggcatttttgcaaacggaattggggcaggcgtttattgtgactggtgataatcgtgcaatggcacgttcgttaggggtcaatacggataatatgactatcatggggttgatggtctcgaatgccttaatcggtcttggcggtgctttagtcgcacaaaacaatggatttgccgatgtaaatatgggaattggggttatcgtggtagcgttggcttctattatcattggtgaagttatttttaccgatcaaatgacgctgacggaccggttgattacggttgtgattggttcagtcctttatcgttttgtcttggtcatcgttttgtatcttggctttaacgcgaatgatttgaatctctttagtgctgttgtccttgggttggcattgattttgccacagctacgcaagtacttcaaactggatagtgtattacgtaagggggtagcctcacatgactaagacaagtttaagattagaaaatgcaacggtggtcgtgaatcaaggaacgcctgaagaaaagacgattttagataacgtctcattgacgcttaacgaaggtgatttcgtcacggtgttgggttcaaacggagcgggtaaatcaaccttgttcaatgtgattgcagggtccctgatgttaactgccggtcatgtttatcttggtgatcaagacgtgacgcgcctaactgaaacacaacggacgaagttcttggcccgggtgtttcaagatcctaagcttggtacggcaccccgcatgacggttgctgagaacttattgtttgctgaacggcgagggctgtcacggcgtctaaagtggcgtggtctgaccaaagaaaaattggctgagtttgcgacggttgcggcaacaatggggaacggactcgatgcacgtttgcatgtcgcaactggtgacctatcgggtggacagcggcaagccttgtcatttctcatggcgacaaggatacgacctgagttattgttgcttgatgagcacacggcggcgcttgatcccaagaccagtgagcaactgatgcgcgtcacggaccaacgaattcgggaagacgcattaacagcgctgatgattacacatcatcttgaagatgccattcagtatggtaaccgattaattattatgtctgctggaaaagtatcgttagatgttgctggtgcggataaggcaaaattgacggtgccagatttgctggaatactttaatcgttattaataatcaaatagagtgagacgagagacgcttttgaggctgagacagagacttctgtcccagcctcttttgttgctggttagagacttaacctgatgttttcctaaatgactaaataagtggtaaattagagggtgagttttttgctggaggtatggtatgaaaatagatcgcacaagactgcttgttgtcggtcgtgcagtaatcgtaggaatattagtcggtgttgttgtgagtgctttccgctggctagtggaagccattttagaacagtggcgccttatctatcatcaaattggccatgctacaaactggccaatttggttagctggcacaattgttgggatgattggtttgaccgttttggtagggcaaattatcaaaggcgacccaaatgtcaacggatcgggaattccacaagttgaaggacaattggccggtcagatgacggttaatccattttctgtgctctggcgcaagttcacagcgggcttaatcacaattggatctggtgcgatgttgggccgtgaaggaccatccattcaattggggtctgccgtggcgcagttatatggtgaaaagcgagggtatgacgcccgtgatacgaaattaatgattgcgatgggggcagcagctggtttatcagcagcatttggtgcgcccgtagctggtacgttgtttgtgttagaggaagtttatcggaccttttcaatgttggtttggttgggtgctttaacgagtgccgttgtggctgatatggtgagtgtgaacgtgtttggattaacccccgtgttacacatggctaatttgcatgcgctacctttgcttgattatgcgtggttgccattatttgggattttgctcggactgtttggttatgtttaccaacgggcaacgttggcagcacctaagttatttgcagggttaacgtggctaccacgtcattatcacttcattgtggtctttctattaatgctaccaatcgggatttggttgcctcacttacttggtggtggggccgggttaattttgaacccaacaacagcaaccgcttcaattggattattagctcttattttagtgattcggtttgcttactcaaccttagcctttggttctggggtcccaggtggtattttcttacctattttgacactcggtgctgttgctggtgccttatatggtgcaatattggtgcactttggctggctgcagccaacttatgtattagacatgatgattttggggatggctggctattttgccagcatctctaaggccccatttacggccatcgttctgattgctgaaatggttggttcgatgagtcatttggtcgccatggcaatggtcgcgttgattgcgtatcttgtggtcgactttttgggtggtgaacccatctatgagtccttgctggcccggttacgtttatccgatcagctgacggaattacggggacgcctcgaagaaatgacgatcgttgttgcaccggggagtgcactggaagatgcggaggttcgtcagttacaattgcccaaaggcgtccttattcaacgaattcggcggggcgcggaagaacagttacccaatggtgattttatcctacgggtgggcgatgagttggtcctattaactgatgaagcacagtttggtaaggtttgggatattatgcaagccttaaatcgggaggatcgttaaagatgacaaaacttttttggcagcgattaatggcggttagcatgggtggcttctttggcgggagtctacgtgaagcagttgcgctattggttaatgttacgaattttccgctatcaaccctaattattaatttaacgggtaccttcttgtcggcttttctcgtcgtcatttggtcgaaaaaagtgacacttgctcagccggtcgccgactttattatggtcggcgtccttggcgcctacactacatattcaacagccatcttagatatggtgaaacatggttggctaattggtggtgtgtatattcttgtgagtgttgttggtggtgtcatagtcgtctatctgggccgttatttagctgaaaaggtggtggcagcatgatgcaaattgttgttgcgggcttgggcgctatcttcggatcaatggcccggttcagcttattagagttggcaccaaaagtatttggtaaggcaagcgcttggatggtgatggtcatcaatctttcagccgcgttattaatcggttttgcctatggcatgcaactaccggttatgcaaaatacgttctgggtaactggtattttgggtggttattcaaccttttcaaccccaattgttgccttggccaacgggttgcaaaatcccggtgaacgggttaacattatcggccaaaccttactagcgtttgtggggggcgtccctgtcttgctactaggcgcgtggttaggggcacacttttgagcgtaaacgtggtaaatttaatacacgacgtaaactatttggagaaaaataagagaagatgagcaagattgcggttttggtggatagttcaagttacatttcacccgaagatttagaagctttaaatattaagcaaattaacaatcctattatgatgggcacgcaagtatttcatgagaatgaagattggcagacgccagctgaattctatgaaatggcccggacggcagtaacaccatttacgacttcacagccagaaatcggtgttttcatgacggctttcaacgagttggccgcagcagggtatactgacgtgattgccgtggttttgtcgagcggcatttcaggtacctattcatcagtccaatcattggcacaaacgatggataacattaaaatccatgcctgggattcacaaattgcggccgctggagccggcaatcaggctaagttggcagccgaaatggtgcaagctggccatgatgtaccggaaattttggcggctttgacgacgctacgtgggacgaccaacgtttatttcgcagtagatgatattcgtcatttgcaacgcacgggtcgaatttcaggtgggcaggcaacgctaggatcattgctaaatatcaaaccgatgttgacttttgaagacggcaaaatcattgcaatcgggaaggaacgcgcgatgaagcgggcttggaagaaaatgatagctgacttcacagcaattcacgacgcggctacctatccattacgcgttgccattgttgatggtaaccacccagatttggcagatagctgggcggctgagttacaagcggccttcccagatgtggttgtcgaacgtagcatcatcggtccctacatcggtgtccacacgggcgaaaaagccatggggatgatttggggtcaggactacaagtcgttattgtaaagttaaagaatagttaaaggtctataccaaacaaatgttggtatagaccttttttcataaggaatcattgtcaaatcaatggtttaagtgcaaaataaaaaacattggtataggaaattattcatactgttaattattttttaggggaattgtgaaaatgaaggattatctacaacgaatgggtcgttcgttgatgttgccggtttccgtattgccagctgcagccttacttgttggggttggtaattggattttgcgtttgccaggtggtgtcgcgcaatcgattggaaactttttggcctttgccggtaatggcttgttgggtcagttggccttgctgttcgcagtcgggttggccttgggtatggtgcaaaaaaaggaagctggtgcagttgcactagcagctgttgtggcgtatgaattgcctgtcaatttattagcgcccaagaatatcgcagcgctgatgaacatcaaactgagcgccgtcaacccggcatttgatgccttggtcacaaataatgtgttgcttggtattatttcaggtttgctagcggcagcaatgtataatcgctttagcgaagtacgtttgccagctgctttggccttctttagtggtaagcgttcggtaccgattattacagctgtcctaatgttgttggtttcggttgtattattgttggtctggccaccagtttataccggcttggttacgtttgcgaagttgatttccggtcttggctgggtcggtgctggtttatacggtttcttcaaccgtatgttgattccaactggtttgcaccacgcgttgaattcagtcttttggtttaatattgctggtattaatgatattggtaactactggaactcaactggtgttaagggtgtaacaggtatgtaccaagctggcttcttcccaattatgatgtttgggttgcctgcgggtgcttatgccatttatcagcaagcacgtcccgcacaaaagaagcgggttgggtcattgatgttggcggctggaattgcggccttctttactggggtcactgaaccacttgagttttcattcatgtttgtggcttggccactgtatgtaattcacgctattttgatgggcttgtcattggccattgcagccttcttccactggacgtcaggatttacgttctctggtggcttggtcgattatattctgagttattcaatgccattggcgaataagccatacatgttgctagtacaaggtgtcatttttgcgatcttgtactacagtatctttactttcgcgattaagaagtttaacttgatgacgccgggtcgtgatcctaaggacgatgatgacgcggccaacgatgtccaagttggtaaggcggcaacagttggtggggaagataagtacctccgcacagcacgaatggtatggtcagcactaggtggtgacgccgctgccaaagacaatttgacgtacttgtacaactgcacgacgcgtttgcgttataagatgacggacacgtcattggcagatgtggatgcgttgaagaagacgccgggtgtcatgggggttaacgttttggacgatcaccaaattcacatcgtgattggacctgatgtacaattcgtggctgataacgttgagaagatttataacggtgagttatcatctaagctagaaaatccattgtctgctgatgaagttaaggcagtcgatgaaacaccagccggtaaggaggaaaacttctttgcggttgcgaacggatctttgcttcacttggaacacgtccaggatgagacatttgcctcaaagatgatgggcgatggctttgcaatcgaaccaactgatgacaatatcttggcaccaattgatgctgaggtcacgatggtttcgccaacgaagcacgccattggtttacggacagaaagtggtctagaaattttggtgcacatgggaatcaacacagttgaactgaatggtgaaccatttgatatcaaggtggccgtgggcgataaaattaagcacggtgacttgcttgcaacgatggacattgctgcggtcaaggctgccggtaagctagcaaccacgatggttatcttcatgggcttgtcagaacaagcccaagtcaaggttgacgatgaagagatttttgatggtatcgcgggaaactatgttggccgtgtaattttctagtaacgacattctaaaatttagacacaaaaactcgtctttacggttgtagtaagttagctacaattgtgaggacgagttttgttttttaaatcgtataaaaaatgtaagggaatatagttgaatgactgtttcgccggtggtacactcagttaagagaaaaaggcacgtgcgctaacacgcgcaaaaatccagagagaatagatgttggaaggtgtaacgcatgagtttaattaatcgtgatcgaatcaatgagattcgacaagcaaatgacatcccggttcgtgaattagcgaatattggcattagccgtaaccgctattaccggtacttgaatgaagaaaatgatttgcctgccgagggattcatctcattgatgagtcacttactgttgacgggtgcggaaatcaatagtgaattggttaacgggcatgacacagttgaagggctaatgggcgagttgttggcagcaaatcaagcccaagatgcagaaacaatcaaagaagtgagtcgacgtagttatcaactattccgaaatacaatggcccgtggttttttgcgtgtcgcgagtttagcggatgtgcttcacgcacgattgattcccgatgaacacgcccaaattgcccaacaaattttaattgattcatttgaagcggttaaaatttggcgtgcgatggatgtggcattgctgtatccggtgattgcagaagttgataaggcaatggcacaacaatatctgtcagaaatctggaccaagagctggccacatagtacgatggaacgattgaatgcaatgactgtgcgttatatgacggttttattgggacgtgatgattttgatttagccagttttaaaacggtggcagattggatcgttaatgagccaaagaccgcaatgagcttcgcttggtgggcgcgattggtatctcaattggaataccataattgggatgacgctcggaaactggcgaaccaggcaactgaattaggcatgactgaaatggccgaattatcaagtgctttgattgatgcttggcacaagcgagcagaaaatatatgatgattaaaatagccccaacatgaccgtacttggtcgtgttggggctattaactatttgttagcaatgacttcgatgtggttaccttcaaaatcatctaaatggaaaatgatatgccgaccatcgtcactctcggtagctggcttggcctgggtgacatagtaattgataaagtgattttcaacggtttccttgtgatcacgaacggtgacctggacaacaattggatcggcttccggatcttcttcaaacacgattgattgctgatcgaagtacaagtgccgggattcattctcaccaaattcagttggcaaatcaaaaacttcacggtaaaaacggacagctcgtgcgacattcgtggttggaatgcgcaggggagcaaatttacgaactcgcataataaacctcatttgactattaatgtgtgtctattatacgcctttctcatgagtggtacacgatggaaaatggagaattccctgatttgggcgtctgtattgctagatggaggtgcacaaatgctagaaattgcggattcggtgcaaaaagttggtgatgctatggtgcaacagtttgggcagtcaccacaagaagcctgttggatacttgcggtcaatacgcaaatgcgggtactagaagttaatcgggttgcgattggtaccttagacagtgtgacggtgcatccacgcgatatttttcgacgcctagtggcattgaatgcttacggctttattgtggttcataatcatccgagtggtagcttacggctctcacaagcggatcgtaaactcatgacccagctggcaatgtgtagcggtgtcatgcaatttcatttgctcgactttatggtaatttcaagtcgtggctatacgagtttaaggtcgcaacattggttgacagaaataagcgttgaaacgttgtatgacttatggacgaaaaacgataaggtgtgataaacttaataagaaattagtgtggcgttttagcgtagcaattagtaatctgctccttgaagtttatccggacagtgagattgttttttgcagctggtaagggtgacttgggtacggtggtaggtgataattgctgacgtactcagactgctttatgttaggccatagaaaaattaactataaaatattgtaaagaaaagggatagaagccgtgttttcatttggaactcgtaatgtcggaatcgacttaggaactgccaacacgttggtatacattgaaggtaagggaattgtgcttcgtgagccatcagttgtggctcgtaacacaaagacgaatgaagttgtcgcagttggatcggctgcgaaggatatgcttggtcgtacaccaggctcaattaaggcaatccgcccaatgcgtgatggtgttatcgccgattacgagacgacggttgctatgttgaagtattacttgggtaaggccttgggtggtcgcggtgctaagccatacgttacgattggtgtgccatcaggcgttacagctgttgaacgccgtgcggttattgatgcggcacgtgtcgctggtgcgcgtgatgcctatgtcatcgaggaaccatttgcggctgctgtcggagctggcttgccagtgatggagccaacagggtcaatggtcgttgaccttggtggtggaacgactgatgttgccacaatttcattaggtggcattgtgtcatcacgctcaattcgtatggccggtgacaagattgatgaagcaatcatgtcatacattcgccaaaagtactctgttctgattggtgagcaaacggcagaacgtttgaagatggaaatcggttcagctgatgttgaagctgctaagagtgcggaaggaacatctgcacgtggtcgtgatttggtaactggtttgccaaagacgattgatattgaagcggttgacgttgctgacgcgattaaggatgtcatttcagaaatcattattgcaattaaggaaacgttggaagagacgtcaccagaaattgcggccgatgttatcgatcacggtatcgttttgacgggtggtggggccatgttgcaacacctcgatgaagtgattgctgaagcgacgaaggtacctgttttcgttgcgcctgagccattagatgcagttgtgattggtactggtgaagcattgaagtcaattgatgttttgaagaacaactaagcaagatagacgataacgccgcaccattcggtgtggcgttgtttattttaatcaaacgaaaggcaatcggaagatgaaaaatatctttacatcacgccgtttggtcgtcacagtgattgtcgcaattgtgacgattggtgtgattacacttagttcgcgtgcacgtagttctcaaaaagagccagcattgccaactcgtgttgtgtcagacgtgtcaggatgggtgtcaggtgtggtaagttcacccgtcaaagcattgagtagcagttatgcggcaattacagatttgctaaacacgtataacgaaaatgaaaagttaacaacgaaaattgatgatttggcacaatctaaggtgcagttacagacattgcaagctgaaaatcgtgctttaaaagatcaattaaaaattgatggcacgttaactgactataaggttgtgaatgcagtcgtcatttcacggtcaccaagtaattggcaatctcagttgattatcaacaagggaacgaatgccggtcttaaaaagggcttgtcagtgatgggatcaggtggtttgattggtcgtatcacccaagttaatacaacaaatgccaaggttgaattgttgtctgatgatagtcaagttgcggatcgttttgctattcgggttacgaacagcaacagtgaagtaattgacggtattgttaccagtttcaatcaatcaaagaatctaattgtgatgggacaaattacatctgacgttgacgttaagaagggtgatttggttactacaagtggtttgggtggtgttacaccggctggtttgtacgtcggtaaggttgcaagtgtcggtaaggataactacggcttatcaaagaagatttacattaagcccgcgacagactttaataacgtgcctgttgtcagcgtggcaattccacaacaataaaaataaaaaggaccgccaaatgtggcggccctttttatttttttattcattgtaatataatactggccgaccgtttaggggttggatgtggcgattattgtaatcataatgcacatggaaggccgctaattgatcagctgatattgtcattggttgggctaaaatataccactcgacattctctgacaacggtggtgtcgttaatgaaccgatataatggtagtacgatcgatttgtgggtagaatgtcagtgacgtcacatttgaatgaatgatcatcattgatgcgacttaaaatagtggcaaaagttgtggatgcctggccgatttgtaagaacaccccaatgaccgcttgacgaccatcaggtgcttgatgaacaaaatgaacttctgcatcaaattgtttgccatcaagcgtgtgttcgcttggggcgtgaatatggaactgttgcaactggaatggacggttagcgattaccgccgtcccagttaacccaatttcgacaccttggccggtatcgtggacatattgtccggtaaagtcatacgccaaatttaatgacgcaggatagtcaatcagatcagtctccgcagtgcgaatagcgattggtgattgcatgcgacctgatgtcattgaccaggattcctgcgcatcataattgagcttttgcatggcacttggcctccttctgaagtttttctctctcctcagaatacttttagtttatcagcagtccggaaaataggctactaaatctttatttttcgctcaggttcggcggaaggcgttgacgtaaaatgcggttggcgctactatgaattagttacgatgatggtaaccactaaatggagaattaatatgttgaaatatgttcacacgtcatggctacattttgtgttggtgtacctggcggttatgttagatggtgggattgccttgcattttgcaccgatcttatttaaaacgccgatgtcggcgagcccatatctctcattgattattatgatgatgccaattttgaccggcactgattcgcaaatgaagggacgttggttgtatattgctgcattccttggcggcttactgtttgatattttttatagtggtatcattggtatttcaatgattggctttccactaactgtttgggcagcaagtaagctccaaacttatttatcacataactttttgtcggcgatggcagtttggtttgtatcgatgagtttgtatctggtctttgattatgcagcatttgggatcatcaatttgacgaatttgaactttagcgaatttatcatgttccacatgtttccaacgttgattgtcaatttgttaattttggtcgtcatttatggcatcatgaattatctatatcatgcgacacgccagcccgatgtgtcggcgtacaatgttgatcagcgtgatctgaatatgcggatgacaggtaagtcacggtcaacgcgattataagttggtgatcaaaggtgttgacttaaagtacaaagtcaattaaagttatctcataaagatttgattggacgagtagtttaacgtcattgcttagagagttgtgcagaagctgggaagcaaccaatggcctaaatgaaccacacccatgattatcggtacaagtcaaaactgtacccgattcgtctcgttatcgacgcgcgcctgttctgattgagcaggggtctgagtgttatttggtaacaaatagcaaaattgaggtggaaccacgaaattagtcgtcctcaagtaacctttatttaggttgcttgagggcttttttgtttagttaaggagaaagctatggagtacatgttgcagattatgccaagtctgctaagcggattgaaaatgacatttggtgtctttgccctaacgctgattgggtcagtaccgcttggtattttagttgctttagcgttaaaatcagatatttatttgctacgctgggtgacgaacgcttatatttgggtgatgcgtggtacgccattgctattgcagatcgtgtttgtctactatgggttgagcttagcccacatcgtgacgctaccacgttttgaagctgcggtggtcacattcattctgaactacgcggcatactttgccgaaattttccgtggtgggctacaaagcgtgccgcaaggtcaatatgatggtgccaaggtgcttggtctgacgcgttggcaaacaatgcgtaaaatcgtattgccacaagtggtcaagattgtcatgccatccgttggtaatgaagtggtgaccctggtcaaggattcatcactggtttatgtcatcggacttggtgatttgatgcgtgctggtaatattgcggcatcacgagacgtcacattgatgccttatttgttagtgggactgttatatttgctactgacagctttggcaaccgttattcaacgacgtgtcgagacgaagatgaactattaccgttaaggagagagccatgcttgaaattaaaaacttagcgaagtcgtacgatacgcggacgattttcaaaaatatgaatttaacagttaacgatggtgaggtccttagtattgtcggcccatccggaattggtaaaacgacctttctacgtattgtagctgggcttttgcctgcaaatgatggtgagatgattttaaatggtgaggcgcttgatttaactggtgaccgcacaggagcccaagtgggggtcattttccaagattttaacttgtttccacaatataccgttaaagagaatgtgatgttggcaccgcaattggttcaccacgaaacaaaggctgaggcggccgagaatgcagatcgtttgttgcaagatttgggcttaacagcccaggctgatcaatatccattccaattatctggtggacagaagcaacgcgtggcaattgcacgagctttggcgatgaagccaggcattttagcatatgatgaaccaacatctggcttggatgctgaatcaacagaacgcgtaattgcggttattaagcaattgcaagcacaaggggtaacgcagttggtggtgacacacgatttgccgtttgcggaagcggtcgcggataagacatttgattttgggacagatgtagaacgctagggggctgcgtatgaaaaagaagattaattggcgtcgtcaaattattgggaacgggattgtactcgtcgtgctggctttgctggttggctttgtttggtatcgaacgtcacacgcaaatgatacttggcgcaaagtgactgcagataagactgttgttgtgggactagatgatacctttgtgccaatgggctaccgagacaagtccggtaagttagttgggtttgatgtggatttggcccgggcaaccttcaaaaaattggggttgcgggttaagtttcaggccattgactggtcaatgaaggaaacggagttggatactggtcacattgacatgatttggaatggttatacaatgacgccagcccgggcaaagaaggtcgccttctcggtgccatatcacaacgattcacaagtactagtcacgttaaagcgtaaccaaatcgatacgattaaacagatggctggtaagacgttagctgttcaaactggttcagctggtttgacggtcttcaacgagaaacctaaggtgttaaaggactttttgggttcagcgccggtacaatatgacacgttcgataaagctttgaatgatttacaagttggccgtgtaagtgcagttttgattgatatggactacgcccgttattatgtggcgcacgaacctaatccggctgatttcgaaattattaagacgggttatggtgaagacgcgtatggtgtggggttccgcaagggggatgtgaccttacgagaaaaggtcaatcaggtcttaacgagctttaagaaggatggcacgttagataaagtttctgaacgttactttggcaccaaaaataatgattaaacaataagggcgggatagcagtttctgtccgacttgctaaggtcgcaaatctcccgatttaaatcggcggatttgcggctttttgttttacgttcatttttgtggcgtgtgcctgcttaaatatgccgaacatttttaagtattaaacggtttatacagcttagtgatgttttttgaaacggtttgctagctgaaattggggtgggttaacggttgaaacgcgaacgttcgtcggattactggaaattgatggctgacgagggttgtgtttgcccagtatctcgataagctagagtttgtaatcgggaacatatggatcagcataaaggagatatttcaacatgaagactgcatttgacactgtaccggacgctttgcaaacgttgcgtcaagggggcgttattatcttggcagatgatgagagtcgcgaaaatgaaggtgatttagtggcattggctgctgatatcacaccagaaacggtgcatatgatgcttcgtgaagcggctggattgatgtgcacgcctgttggaccagaaattgcggcacggcttggattgactgatatggtggctgattcaacagatcctcaccagacgcctttcacgtatacagtggatgggactgaagcagcaaccggggttacgactggcgtttcagcggctgatcgggccgcgacaattcggcacattgcgaatccgaccgccgttcggacggatttcaatgcgccaggccacacccagccattaacagccttagctggtgggctgactgagcgcgttggacatactgaagcggccgttgatttggcgcgcctagctggttcagaaccagccgccgttattattgaagtcctgaaagcagatggcacgatggcccgccgcgatgatctgtttgaattagctgatcgcttggatttgccatttattacgattgcccaaatttcggcgtatctagctacgccagttatgtaattaaaaaagtatcccatctcaatctaggtgcagcgcctagtattgagatgggatttttttgtcatcatttaaaatgataacggtttcatgagaaaattcttagttaaatatgcctttgttcgttttacaaagatgcaaaaacggttaaacacgaactaatatgtttcattttaatgacttatgccgacaaaactgtacatttaatcgtcgtggtggttatatgtagttgtaaagacgaactaaaaatgaggtggaagctaaatggtacgtgttgcggtagtaatgggatcgatttcagattggtcaacgatgaaagaaacggtcgcggtcttacaaacgtttgatgtcgcagttgagacacatattatttcggcgcatcgaatgcccgaggagatgacgacgtttgcccgaaatgcgcgggacaatggcctaggggttattattgctggcgctggcggtgctgcccatttgcctggcatgttggcagcgcagacgacgttaccagtaattggtgtcccaatccaatcacacgctttgcaggggatggattcattgctcagtattgtgcagatgccagctggtgtaccggttgcgacggtggccattgggaccgcaggcgctaaaaatgcggcttacttggcaatgcaaatgttgggcattgcggagcaagaactggccgataaaatagccttattccgagaagggcaacgccaacaatcgattgagagcgaggcattgttacatgactaagcgtattttgccaccagccactatcgggatcgttggtggcggtcaattagggcaaatgttggccttggccgccaaaccaatggggtatcaggttattgtcttggatccgcaagttgatgcgccagcagccttggttgcagatcaacaaattgtggcgagctatgatgatgtttcggctctgcgtaatcttgctaatcaagcggatgttgtgacgtatgaatttgaaaatgtggatcagacggcattacagactgccgtaccagctgaaaagttaccccaaggggtagcgttattaaacattacagcgaaccggttgcgtgagaaacaattcttggcagcgttgggcttaccagttgccccattcgcagccgtggataacttggtcactttggacgcccgatgccatgaagtatcgttgccagcaattttgaaaacggcaacgggcgggtatgacggccacggccaatgggatattcccaataccgatgcattggcaaatttgttagcgcattggcaacaaccgactgatatcgcccttgttttggaaaaaaagttagcgttcgatcgggaattgagcgtgatggtaactcgcgatggtcggggtgaaattcgaacttggccggtgacggtcaatgagcatcagcaccatatcttacgagtgtccgcggcaccggcaactttatcaccacagattgccaagcaaattgagaccattgcgacgaccattgccaatgcgttgcaacttgtgggcattttaggcatcgagctatttgtggtgggggagcgtgtgtatatcaacgaattagccccacgcccccacaattctgcgcacttaaccattgaggcgacgaatgtttcacaatttgaaggccatattcgaagcattacgggcttgccgattccggtgattacccaatatgcaccagctatcatgttgaatttattaggggatcagattatacaggcacgccaagatatagcgacacatgaggggtggcactttcacgactacggtaaacatgatgtgaagccgggacgaaaaatgggccacattacagccactggcatggcggctatgaaagatttgcgcgaatgggggacaaggttatgacaattgtacaaggggctttattaacaacaggcaaagcaaaggcagtgtatgccacggacgacccgaatgtgttgtggctccatagcttgaatcaagcgacagcgcttaatgggaaacaaaaagccgaaattagcgataagggacggctaacgacccaaatcagtcagcaattgtttcgctttttaaaggcgcaaggcattgtgacacactttcaacaagcagtcggcgaacgtgatgtgttggtgacggcactggacatgttaccaattgaggttgtgattcgtaattatgcggctggccattttgcaacgcgttacgcggtgccaatgctgacgcctctttcacccacggtgcaagaatattactttaaaaacgatgcgcttgatgatccgccattgaatcaatcgcaaatatttgccctcgacttagcgacgccaagtcagttaacccaaatcgaggcagttgcccaaacggttaatcggcaactgggtcaattatttgaagctgtgggcattacgttaattgattttaaattggaatttggtttggacgctactggcgcgttgacgttaggtgatgagctgtcaccagataatatgcgtttgattgaccaagccaccggccaatccttagacaaagacgtttttcgtcaggggacgggcgacttacgtgatggatacacaaccgttttgcacagactaacgacatatttaggagagtaagcatgtacattgcacagattacagttacttataagccatcaattttggatccccagggtgaagtgattaaggatgcccttgcgcgtcttgattaccaaggggtaacgtcagtgacgcaaggaaaatattttgaaatcaagttaacggcgactgatgaacaaagtgcgtatgatgaagccaccagcctgactgaagcgttattaattaatccaaacacagaaacgtatcgcatcacgatgttagcagaagtggaggcttaagatgaaagcagcggtcattcaatttccgggatcaaattgtgattttgatatgtattatgcgttacagggctttggggcggatgtccagtttgtgactgaaaagtcgactgacctgtcggcgtacgatgccgtgttcttaccaggtggcttttcgtatggggattacttacgaacaggagccgtggcgcgtttcgcacccgtaatgacagccgtgcaaaaaatggctgcaaccgggaaactggtggtgggggtgtgcaatggttttcagattttaacggaggccgggatgctacctgggcaattgatgatgaatcagacacccgggttcatctgtgatgaggttaagctaacgattactaatcgacaaacagccttcacaaatcaatatattgatgcaacgacaacgattaaattaccaattgcgcacggcgagggccggtatgttgctgatgatgcaacggtgcgaatgttgcatgaaaatgggcaggttgtcttaacgtatgcgactgatgttaatggttccgttgatcagattgccgggattacgaaccgcagtgggaatgtgattggcctgatgccacatccagaacgcgcggttgagacgttacttggtaatacggatggacgaccattttttgaaagtttactagcaaccattatcacgaaggagactgtagaagcatgacagcattgttggcaacgacgcatgaacccacaccggcagaaattgccgccacgaaaccatatcaggcgtggggattaacggacgaggaatacacgttaattaagcaaacgttggggcgcttgcctaattacacggaaacggggttgtttgcagccatgtggtcagaacacgtttcctataagaaatctaagccggtgctccggacgttttggtcaaccaatgagcgtgtcttacaagggccgggtgagggtgctggcattttggatatcggcgatgatcaggccgttgtatttaaagctgaatcacacaaccacccgtcagcggttgaaccgtatgagggtgctgcgacaggtgtcggtgggatcttacgggacattttttcgatgggcgcgcaaccaatcgcggtgcttgatagtttacgtttcggcgagttaacagatgcacggacccaacatctgttaaacggggtgattgacggaattgccggctatggcaatgcgattggcattccgacggttggtggcgaaattggctttgacccggtttatcaaggtaatccgcttgtcaacgtgatggccgttggcgtactggatcaagaacgaatgcaggttggacgcgccgatggtagtggtaatacggttctgtatgttggggcaaaaactggtcgtgacggcattcatggtgctacttttgcgtccgcagaattttcatcagatgccgaacaagaccgttcagctgtgcaagtgggggacccttttttagaaaaactagtgatggatgcaactttgacagcaattcagcaatttggtgaggctattgttggggtgcaggacatgggagcagctggtttggtatcctcgtcagccgaaatggctggcaaagcgggaatgggcattcacttgcaattagacaatgtaccacaacgtgagacggggatgacgccttatgaactcatgttatctgagtcgcaagaacgcatgttattagttgtgacaaaagggcatgaagccgccgtacaggccgtctttcaggaagctaatttagaggcagttgtgattggtgaagttactgcaacggggcgctatgaattaacctggcatggcgagaccgtggctgatttacccgtcaattttttgacgcaggcccctaaacaaaccatggaacaggtgaaaccagcacgtctgcaagacccagcaccagattttacaccgcatgtggctgatttgacgacggtttggcaggacatattggcacagccaacagttgcttcgaaagcgagtttgtttagacatttcgatagtatggtccgaactaatacagtgattaagccgggtggcgacgcggctgttgttcgtttacgtggcaccaaaaaggcattggccatgacaactgatgtgaacgtgcgatttacctacctcgatccttatgttggtgggcaacgcgcagtcgctgaggcagctggcaatattattgccactggcgcgttgccaattggtattacagattgcttgaacttcggtaatccggatgatccagcaatttattacgaattggcacaatcagtcgccggcattaacgagatggcccgacagattaatacgccaattatttccggtaatgtgtcgttgtataacgagaccgacggtgctgccatctatccgaccccaatgattggcatggttgggttacacactgatactgctgatatcacaacgatttcatttaaacagccggatgatgtcatctatttgctgggtgataccacggctgactttaatggttctgagttgcaacaactacagaccggggccattgcgggccggttgcccggtttaaatcgtgataaattgtcagctacccagcaaagtgtgttagcagggattcagcagggactgattgccagtgcccacgacctggcagaaggcggtttggcggtgtccttggcagaaagtgcctttggcacaccatttggttttgatgtaacggtaccttggacggctagctggttatttagtgagacgccaggccgctttttggtaacggtgccagcaaacgctgtggacgtctttgaaaccctactggatacaacatatctgcgactggggacggtcacacatcatgatcggttggccgtcacaacagctgatgggactgtcagcttagataaggcacgcctgcaagaagcgtatgaaggagcaatcacatggcaacgcagttaattgaacaaactcggtcattaaatgaggaatgcggtatttttggggtctggggccaccaaacagcggctaatttgacttactatggcttacacgctttacagcaccggggccaagaaggtgcaggaattgtcgccaatcagcaaggccatttatggcaagaacgtggtttgggtttgctacatgatgtttttcgtgacccagcgcgtttagcgcatttgcagggacaagcagcgattggtcacgttcgatatgcgacggcggggtcagcaggcattgaaaatatccaaccgctgatggtgaacttttccgatatgcaattatccttagcgcacaacggaaacatcacgaatgcacaatctttgcggcaaagtcttgagatgcaaggggcgatttttcaatcatcgtcagatacagaagtgttactgcatttaattcggcgttcaacggcgacgacgttttatgaccgcttaaaagatgctttgcagcaagtgcggggcggtttcgcatttttgctcctgacgccaacagcaatgtatgcagctcttgatccacacggttttcgtccctttgtggtaggccagttacctgatggtcagtatgtggtgactagtgagacggccgcgttgcatgcggttggggcaacgtttattcgggatgtccaaccgggggagttattaacgattgaccaggccggtttacggattgatcactacacaaacaaaactgatttacatatcgacgcgatggagtatatctactttgcacggcctgactctgacatttatggtgttaacgtgcatactgctcgtaaacggatgggccggcaattagcacttgaacaaccggcaacgggcgacttggtggttggtgtgcctaattcttcattatcggctgccatgggatatgccgaggcaacgggcttacctaatgaaatggggctggttaaaaatcaatatattgcacggacgtttattgagccaacacaggagcgacgtgagcgggcggtgcgtatgaagctaagcgcagtaccgtcggtggttgccggtaaacgcgttgtgctagtggatgattcaatcgtgcgtggcacaacatcaagttacattgtcaaaatgttgcgcgaagccggtgcgaaggaagttcacgtgcgaattgcgtcaccagctttcaagtatccgtcattttatggcgttgatatgcaaacgacggcggaacttttagcggcgaaccatacattggctgaaatgacggccatgttaggggctgattcattagcctttctatccgtccctggtttggtacaggcgattgacttgccatacacgggcaatgggactggcttaacgacggcttactttgatggacattacccatcaccaatttacgattatgaaaaaacgctgacggcggcgataaccacgggtgaggtcgattttaagaccgaaccaacgacaacttatcatccgagtcaagtgtcatcaattagtgatcaacaaccagctaccgatcaaacggtgagctaaaagggggagaaatgacagaagcaaatgcgtacgcgggggctggtgtagatatcctagccggtgaaacggcagttgacatgatgcaagccgatgtggcagctacctatacaccaggcgttcttgctggggttggcggttttggtgcagcgtttgcattaggcacgcaataccgagagccggtcttgatttcaggcactgacggtgtgggcacaaaactattattggccatcatggccggacgacacgaatcaattggccaggacttagttgctatggtgatgaatgacatcgtggcgcaaggggcgaaaccattatttttacttgattatttagcaattgccaaaatggtacccgaacaggtagcaacgattgttcgcgggattgcgcaagcgacccaagcgacgggggcagccttaattggtggtgaatccgctgaattgccaggcatgtatgcgccagaccattatgacctcgctgcatttggtgttggtgttgttgagcgggatgagatgctgacagttgatcatgtggcgactggcgatgcgttgattgggttagcgtctagtggtatccattccaatgggtattcactggtgcgtacggtgttgggattagaacaggaggctgattttacagcgttaccagcagcgctacaggacaccctgttaacaccgaccaccttgtatgctcaggcggttttaccgttactagcagaacagttagtcgtgagcatggcccacattaccggtggtggtatcgtgggtaacttgccccgtgccctaccagcggatgtctcggtcactttagagtggggcagttggccaattttaccgatttttatggaattgcaacgcctcggtcagctgtcgttggcagacatgctggcaacgtttaatttggggttggggatgattctggttgtgaagccaccccatgttgcgcgtgtgttggccatgctagcggatgaaggtcaagccgcgtatcaagtcggcacggtgacgcctgccatgtcagcgcaactcaattggcgaggtaagcaaccatggtcataacccgtccaaagttagcagtgtttgcatcaggaactggcactaatttggctgcgcttattcaggcgactcagactggtgaggtgccagccgaaattgttcgtgtggtggttgatcgtcgtcataccggtgcccagcaacttgctgaaacggcgggtattccggtgttacggattaactataaagattacgcgacacgcgaattggcagaagacgccatgttaacggtcttagcagcggatggtgtggtgggtatcttattagcggggtatatgcgaattttgacccctaagttggtaaatgcctttcaccaacgcattattaatattcatccagcactgttgcccagcttccctggcaattctgcgattgcggatgcgtggcaggctggtgttaaagtgaccggtgtgaccatccattacgtcgatgatggcgttgattcgggcgaaattattgcccaagaggcggtcaaacttactgcaacagatgatttggcacagttaacaactaaaattcatgcggtggagcatacattgtatccagccacggttgccatgttgattaaaaaaggagtatttgtaaaatgacgcgtgcattactaagtgtttcagataaaaccggcattgtcccattcgcaacgacgctacagacgttggggttcgaattagtttcaactggtgggacgttggccgtgctcgaagcagccggcttaacggttacgccggttgatacggtaactgacttccccgaaatgctggatggacgagttaaaactttgcatccacggattcatgctggcttgttagcacggcgtgatgacgaggcacatatgaccaccttagccacgtatggcatcaccccaattgatttggtggttgtcaacttgtatccgttcaaagccacgattcaaaagccgggcgtcacacaatcagacgccattgaaaatattgacattggtgggccatcgatgttgcggtcggcggctaaaaattatgcgggtgtgttaccggtggtcgaccctgcagattaccaaattgtacttgatcggttgcggtcagggacagctgatgaagttgattttcgtcaagcaatggcggcaaaagtgttccgccatacagccgcctatgatgcgcttattgcgacatacctaacaaccgaagaatttccaacgcagcaaacactgacctatgatcgatttgatacgctgcggtatggtgaaaatgcgcatcaacaagccgctgcttaccgcgatgcattaggtagcgaatattcagtattaagcgcggacattttgcatggtaagcagttgtcatacaacaatattcgcgatgcagatgcggcattgcgaattatcgcagagtttgcggcaccaaccgtggtgacggtgaagcacatgaatccggctggtattggtcagggagcgacgattgaggcggcgtgggatgcggcctttgcggctgatgatatctccattttcggtggcatcgtggctttgaatcgtgaagttgacttggcgacagctgaaaagatgcatcaaattttcttggaaattattattgcgccttcctttactgatgacgcgtacgctgttttagctaagaaaaagaatttacgactgttgacgttgccgtttacgacggagctgccacaacagcttgaaacgactgcgattttgggcggcatggtcatgcaggaacgcgacttaaccaccgaaacaatcgccgatttcacagttgttagtcaggtccagccaactgcggctcaactggcagcaatggtttttgcacaaaaagccgtcaaacacgtcaagtcgaatgcaattgtggtcgcacgtgatggtcaaacgttaggcgttggtgcagggcaacctaatcgcattgactcagtcaagttggcgattaacaaggcagaaaataaggcggggtatgacgaggctgttttggcatcagatgcctttttcccgatggatgactcagtgagctacgcagccagtcacggtattacagcgattgttgaaccgggtggatcaattaaggatcaagcctcgattgataaggcaaacgagctcggcattgcgttggtattttctggcgtacgtcatttcaagcattagtggaggaaactatggcaacagtacttgtaattggagcgggtgcacgtgaacatgccttggcacaagcgtttgcaaacagcgcgcaagtgacgatggtctatgtggcaccaggcaatgtgggcatgcaggctgatacgattcaacccgtgggtattccgatgacggatatcgacgcattgcgtgattttgcaacaatgacggcgattgatttgacgtttgttggctctgaagaacccttgattgcagggattgttgatgactttcaagcggccggtctgccgattttcgggccgacgaaggctgcagcacagcttgaagggtcgaagtcatttgccaaggatcgcctagcagctgcaggtattccgacggccacgtcggtaaccgtggcgtcttggccggccgcagaacgtgccattatgatcagtgaagaaccggtggtggtgaaacaggatggcttggcggctggtaaaggtgtgacgatttatgcgacccgccaagaagctttaacagctgtgcatgacctctatcaggttgataatcagacaaagttggttattgaggcctatttgcatggggttgagttttcaatttttagtctagtgggaccaaacggcattgttcacacgccagttgcccaagatcataaacgattattagatggtgacttggggcccaataccgggggaatgggtgcctatagtccggttcgctggctagcagatgaggttgtggcggatgccatcgaccagttagttggaccgttactgactgaaatggtagccaatcatacaccgtttaccggggtgctatacaccggtgtgatgctaacggcgcaaggtccaaaagtgattgagtacaatgtgcgttttggtgacccggaaacgcaagtggtcctaccacagttggagagtgatttttatgagctagtactcgcgttggtgcgtggtcagcagccggttgcgcagtggcaaacagaggacgtctatcttggtgtggttttggcggcacctggctacccagttgcaccggtacaaggaatgatggtgcctacaatttcaatgcctaaaataaggtcattttatgccggggttggacaaaatgatgataaacttataacaagtggtggccgagtagcaacgattgtggcgacggcaacgagcgcgaccaaggcacaagcacaggcctactcggtcttagatgctttgccagtcaagctacactatcgtcatgatattggttatcaagcagttgaaaaagaaaataaggtggtgtctggggatgcaaacagatattgaaattgcacaagctgcagaagtgtggcccattgaaaaaattgctgaaaaggccggtttaacgccagcagaatgggaaccgtatgggcgtgataaggccaagatttcggttgatgaaacggcgcacaaggctgaactgggtaagttggttttggtgacgtcgattaatccaaccccagctggtgaaggcaagtcaacggtgacagtcgggttagctgatgccttaaacgaaattggtcagcagacaatggtcgccctgcgtgagccttctttgggacctgtgatgggactcaaaggtggtgcaactggtggtggctatgcccaagttgtgcccatggctgatattaacttgcactttacgggtgattttcatgccttgacgagtgcccacaatacgctggcggccgtgatcgataatagtatttatcaaggaaatccgttgcacattgacccacgacgattgctttggaagcgtgctttggacgtcaatgaccgtgctttgcgtcatgtgacaattggcttgggtggaccgacttcaggggtaccgcgtgaagatggctttgatatcacggtggcgtctgaattgatggcaattttgacgttgtcgcacgacctgatggacatgaaagcacgtattgaacgcatcgtcattgggtatacgtatgagaaggaaccggtaacggttaaggatttgggcgtggctggcgctttgacaaccttattgaaggatgccattaagcctaatttggtccagacgttggctcacacgccagctttaattcatggtgggccatttgccaacattgcccaaggtaccaactccattcgtgcaactaagacggcgctacaattagcagactttgttgtgactgaagctggatttggggctgatttgggtggtgaaaagttcttagactttaagacaccattgcttggcaagcatcccgatgtcattgtggttgtggcgacagttcgtgcccttaagatgcacggtgggttgcctaagacggctttgacggaaccagatcaacaagcgttagctgcaggtttagagaaccttgggcaacacctgcaaagtatgacccgctatggagtccctgttattgtggctgttaatcgctttgtgaccgacacaccagaagaaattgcgatggttgaagcttatgcacgcgactttggtgtgcaggcctatgttgctgacgtttgggctaagggtggtgccggcgctaccgagttagctggtgcggtcgctgaagcagcgcaagttgcaagtgactttaagccattgtacgaagctgatgacgatgccgttgtaaaaatcgaaaaaatcgtgcaaaccatttatggtggtgcgggtgttgaactgtcggataaggcagctaagcaattgcgcgaatttgctaaacgcggttgggacaagctaccagtcattatggctaagacgcaatattcattgtctgatgatgctaaaaaattgggtgcgccaaaggactttaaaattcatgttcgtgaattcattccgaagttgggtgcaggcttcttagtggtgatgaccggtacggtgctaaccatgcctggtttgccaagtcacccggctgcctatgatattgatatcgatgaaaacggccggattaccggactgttctagcagtgggataaaaactcagtcttcgggctgagtttttttgtttatgcatattgagtaggtaaatttattcacttatacttgataagtgagttttttaagagaaactaattgaggaggagagatggcaaggaagagaaccataccgggtcagttagtaacacacgccggtactgtgcttgcgtgggggttattcattgcacccgttgtgtactttttagtaagtattggcatggcaattagtagccacgggcaactatttaatttggtctgttggttgattaaaggtattttaacgttcaattatatgggctttttctcgttgattagtatcggtattgtcctcatcggtgtgatgaattaccggttcggtgacgatgcgatgcgtaacggggtgccaaatgaaaactgggcaactgtcaccgaggaagcattgctaaaggaacgcgcagttcaaaatttttatttagaattacatgatcgttattcgcgtgtttccgagtgggtgattgtgacgcctgaagatgactttgcacctggtgaagtagcagaagtgtacggccgcattacaacggctgaacaggaggtgcaagatgcgacgcgagattgaaattgtaagactacaacaaattcaggaacaattgcgtcagattcgtcatttaaatcgacagcaaatgcaactgttacgaaactttcatcatgatgtgatggcacatttacgacgttggcgcgttctgtttgggttattgggcgctttattagcgtttgtgatttacattggattacagctggtgttgacacaactgacaccagaccaatcaatggtacatattattctagggtatgccatggtcattatttttggtttcttcatgggcgttgctttggccagtagcgcactgcacgactggttatatcaacgggtgagcgatcatttgttgtgtgatgacccggtgattttgccacaactttggcaaaatttagccatggtggagcagttagcaactgctttgcgccaggacgactttttacccgctgatgtgcgtgaatcggaaagcgcgattgcgttagtaatttcttattttgaacgcaatttggcttattcactgccagaagcgctgtatacattagccggtaatttgcgggtagttttgcatcctgatctacgtaatgaagtcgcgcagcaccggcgcttcgtacgtcgattacagcttgatttgtcagatgaacaacagacaattaatgagttgtacacgtatctgacgactgcgcatcatctgaaccgaatttagattagagatagaaagaggcaaacatgaaggttgttattgttggtgcctcacatgcgggtattgcagcggcacaacgtgtggttgcgaaatacgcggatgccgaggtgactttgattgataggcgaacgacccatctttcctttattggggcgggcgcccacatgtatttgaatggtgaaattgagtcgcctgctgcgactgactattgcgaagatgaacaattgcaaacattgggtgttgacttacggttaggcgtcaatgtgctgtcactggatgctgatcagcggttgctcagtttagaggctgtggaaacgggcgaacaaacaacgctccggtatgatcggctgatcttagcaactggctcaaccccgagaattccggcggtccccggctttgagagtaagcacgtccatttattgaagcgtgttgatgatgtcatcgcgttacgtcaagcgttagataacgcaaaggatgttgccaaccaacaggtaattgtgcttggtggtgggttagcgggaacggaagctgccatggcaatgcgaaatgctggtgccaaagtgacgttattacataatcacgatagcttggcatccggctattttgatcacgatttttcagaacgacttgccgagttgttgattgcacacggcattgacgtggttacgaatgttgatgtgcgacggatggaggatgtggccgaccgtggcgtggtgattgaaacagccgttgatacctatgcggcgaatgaggtgattgtgacaattggcatgcttgctaacacgatgaccgttggtgatgaagtcacgattggtgtcaatcgctcagcagttgttgatgagtatatgtatacaacgaatccatatattttagcggttggtgatgcagccacttcaaaaaatccccagttgcaggaaaattggtccatcatgcacgcatctggtgccgtgcgccaaggtattttggcagctgaaaatttgcttgaaaagcggattagctcaccgggaagccaagcggcgtacggtgtgaaattatttgattggttctttatgcgggttggcgtgacggctgatagtgcccgctttgtgaaccgcgcagttgctgagtatgttcttgagacggatcaagtggctgactatatggtagctgataatgataatgctcatatttggattaaagttatttttgacccggcaactcacgtgttacttggggtgcaaatgcaatccaagcgagattttactgagatgtttaacatgatggctgtggcgttaaatcatcaagtaactttggaagatttagcgtttagcgatatgatgtttgaaccgcatgccaatacgccactgaattttttgtcagatgtcgcattacgggcgctagatgaaaacgaggcacgttcatgatggtatttaatcgggcggttcttgttctaattgtggcgtttgtatttacgccagtgattgcgggaatcgtacgttttatagaagatttgcgttttgataagcaagtggcacggcggacggcacgcatgacgacgggagcacaaccgcttgtgtcaattgtattgccttttgcaggggatgtagaccgcttgcagcgccaacttgatctcatgcaaacctcattgacgtaccaacgctatgaagtgttggtaatggtttcggccgaaacgaccgctactttacgccgtttgcgtcaaattgtcgcacaaaatacgacaatgcgtgtgattgaatttacggagacaacgaatgtcgctaatttattgtcgcaaggtgcaatgtttagtcgtggtgagtttgtgttgacactacccataaatggggtagtcagtgggaattccttggaagaaacattggcgctgtttatgacagatatcaacggtattccggcggcacgcgttggggccgtgatgcttgcaacgttaccgcgtcgtgctgataattttgcaacgacgattgcacaaatggatgcggctgttgagttagccgccgatcgacggaaacaagcgttccatgatgtgatgattcgggttgaaaaagaggccattatgtatcgtcgtacggcgttgctggcgattggtctttggcgttcaaatcggattggtgctgagaccgatttattctggcggttgcaactgcgtggctgggttgtacggtataacacgtttgcaacaagtacccggttaacaccgccacggttgcgtggctggatggctgaacgattcatttggaccgcggccgtgattgaaaatttgtttgcccatagtcgcgacattgtttttcaaccgattagatatcggcgggtggttcgcttgtggcttggcgagtggattatgttggcctggtcttggtatatgacggcattgattttgtggggtgtttatttattgatcaccattcacacgcctgaaattgtctacattgtggcaacgagtggggcaattttgctgtttgtccaatttgttgtgggaatgttacaactgattgttgcgataaattatcggcgacataaggggctgcctaatcgctttgtctggcgtgtggggtggtttgcctgggctaattggtggattacagcacttttcaagaccgttgcaaccggcaaggtgatttacaatatgctatttgaccctgagacgcgagcctatgattaagctgctttgaattttgaaatatgttaaaaagagagtgagacaaaaggtgctttggacccgatgataacgttgtttgccccgcttatgccttggagcgtagcgtagtggtatgagtggggcaaatggcgttatattaagggttcagcctttcgaaacacgtttaaaagccgccaatcctccgattttaaatcgggagattggcggcttttgaggctgagacagaaaatttctgtcccggcctctttatttattgatatagatagaattggataatttgacgaccaaataaatcgacataggtcccttgttgggtaaaaccgaccttttcaaggaccctaagtgatccgatgttatctgctagaacatcagcccaaagcgtgaagtgagggggaagctgtgcaatgaaggctgttacgacatccgtcataatgccatgtccccagaaagcaggtgccaagaagtacgcaatatctgcttcattaacaagtggctcacctagttcattcgcccgctggtaggcaacgacgctaccttggggcgtgccgtcgatgagaattgccgcttggtatgtttggtaaagatcattttcaaacgcttgttgctgactagctgtcgattttgcgtcaatcccaattgctgttgcaattgcgggtgtggtgatgagtgcttggtaagctgggaaatcagccagttgccaaggccgtaagtcgaatgtcatgggggctcctttaggatataattgtctttattctaacatgcttcacaaaatggtcccttgacgacatgcttaaaattggctatagttaatccataaattaaatatgacatagaggtcgcaaccaacaagagtacttagctaagtcggcagacagcgcggttaaggaaagggaaggttgccgaaatgtgttttgtggcaatgaaacacgttggtctagacgtgaacaacggttagactgtcgcagcaaaatctgtcggctgcggagcgctatcgacaacactaaagactaccaattatggtccctagtttatgcgatggtataagctagggattttttcgttaatagtgcgattaggcctctcatttaggaggagttatgtcagaagaaacacaacaaccaggtgcgttgaagcgaacgatgaagacgcgtcacctgtcgatgattgccttaggtggcaccatcggtaccggactgttcgttgcctcaggtgcgacggttgcacaagcagggccgttcggtgcgctaacctcatacgctgtgattggtttgatggtttacttcctaatgacaagtttaggcgagatggcaacgtatatgccagtatcaggatctttttcaacttatgcagatcgcttcgttgatcctgccttcggatttgccatgggctggaactattggtttaattgggccatcactgttgccgtggaagctgcaacagttggtgtcgtgatgggctactggttaccgcatgtgccaacttggatttggtcagccgttgtcttagcgttgattacagtaattaatcttatgtccgctaagtcatatgctgaaacagagttttggatggcaacaattaaggttgttgcagttattgcgttcttgattattggagtcgcgacgatttttgggatcatgtcttatcatcctgatgtggcccgaaacttgtctgccggtggtaaccacggcttcgttggtggtttcgggggaatgttagccgtcttcatggttgctggtttctcattccaaggaacggaaatggtcgggattacggctggtgagtcggaaacgcctgaaacctcagtgccaacggcgattaagcaagtattctggcgcattctattgttctatatcttggcaattttcattattggtgcattgctcttctacaagaacccagctttgttgcactcaagtgaaacgaacattgccgtatcaccgtttacattggtctttaagcaagctggtcttgctggggcggcctcattgatgaatgccgtgattttgacctcagtcatttcatcagctaattctggcgtctatgcctcaacacgtatgttgtatgcaatggcccaagaaggtaaggcaccaaagattttcggtcgcgtgaacattaacacggggattccggtaccagcattgttagcgacggttgcggtcggcttgttgacattcgtcacatcagtctttggaccaggcatctactactacttggttgccgcgtctggattgaccggtttcattgcttggattggaattgccatttcgcactatcgtttccgtcgggcgtttgttgcacaaggccgtgatattaagaagttacgttatcatgcaaagtggttcccagtcggaccgattttggccttggtgttgtcaattgtcgttgttgttggtcaggatttggcatcattccaagggtcaatttcacactggaattggtccggtattatcacgacatatatgtcagtgccattgttcttggcactctactttggttacaaattcaagcacaagacaaagttgcgtaagctaactgaggtggatctggatacagatgcacgtcaatcataaataagtaagttctaaaccgcctggcatgtttcaaatcatgccggacggtttttctttgtataattgatgtctattatatgcaacatgattcgaacaaaaaatgtgtacaaaaaaagtgaaaaatagtacaataaatgacagttaggtagatacactatcaacacaaaacgaaggagatttttcagatcatgaagaagaccaagattgtttcaacgcttggaccagctagttctgacgtcgagactattacgaagttaatcgagtcaggtgccaacgttgtacgtttcaacttctcacacggagaccacgaggaacacttgggtcgtatgaacgctgtgcgcgaagccgagaagatttcaggtaagactgtaggattcttgttggacactaagggtgctgaaatccgtacgactgttcaagagccaggtaagattgagttcaacatcggtgatgttgttcgcatctcaatggattcatctcttgaaggtactaaggaaaaggttgccgtaacttacccaggtttgttcgacgatgttaaggttggcggacacgtgttgttcgacgacggtaagattgacatgttgatcactgaaaaggacgaagctaaccgcgaattggttactgaagttcaaaaccacggtttgttgggatcacgtaagggtgttaacgcacctggtgtttcaatcaacttgccaggtatcactgaaaaggatgccgatgacatccgcttcggtttggaacaaggtatccaatacatcgccgcttcattcgtacgtaagccttcagacgttgaagacatccgtgctttgttggtagaagctggtaaggaagatgttatgatcttccctaagatcgaatctcaagaaggtatcgacaactttgccgaaatcttgaaggtttctgatggtttgatgattgctcgtggagacatgggtgttgaaattccagcagaaaacgtgcctttggtacaaaaggacttgatccgcatgatgaacgctgctggtaagccagttattacggctactgacatgttggattcaatgcaagaaaacccacgtcctacacgtgccgaagcttctgacgttgccaacgccgtatttgacggaactgacgctacgatgttgtcaggtgagtcagctaacggtgcatacccagttgctgctgttgctacgatggcccgtatcgatgaaaaggcagaaactgctttggcattgaacggtcgtcacgtaaacaactttgacgctactgacgttactgaatcagttgccgctgctgttgctacggctgcagcaaacttgaacgttaaggctatcgttgccgcaacgacttcaggttacactgcaaagatgatttcaaagtaccgtcctaacgccgacatcttggcattgactttcgacgagcgtgtacaacgttcattgacggtttactggggtgtacaaccagttatctcagaagcagtggacaacactgatgctttgattgacttggctaagaaggaagtggttgctgcaggtttggcagaaaagggtgatactatcatcgttactgcaggtattcctgtaacgacttcaggtacgactaacttgatgacgatcgttacggtcgactaattagttagttgttaattaagaacgagagatacttgttatctcccgttctttttttatgttattctttaggtaatactaatacgaattgatgaggaaaagctgatgagttggcaagaagtaatcgtcgagacccaaagtgaagcggtcgaagcggtaagcaatattttgatggaagccggcgccgaagggattcaaattgatgacgccgctgatgtagatagttacgaaccagccgatgcaaccgtatgggttgattgggatgttgttgaacaccgggaagttggcgccttagtggcagggtacttcccagaaaatgttaacttacctgaggtgattaatgatgtgcaaatgcgcgttaatcaattagctgatttcggattagacgcaacgccaggtactgtgacgacaactgctgttaaggacgctgactgggcgacggaatggcaaaagtattaccacccagttcgagttacacgtcatttgacagttgtaccaaagtgggaagagtatgtcccagcacaaaatgatgaacaagtcatcgtacttgagccaggtatggctttcggtacaggtactcacccaacgacgcgtttgatgatgcaagcgcttgaaattgtgattcgtggcgaggaacgtttgttggatgtcggtactggttcaggcgtccttggtattgcagctaagttgttgggtgctagctcagtgcttggcacggatattgatgaagttgctgttcgttcagctcaaggtaacttggacttgaatcctattgcatcagatatcaaggtgatggcgagtgacctattgcaggatgtgccagcccaagagtttgatatcgtggttgctaatatgttggcagaggtgctagtgccactgattccacaagttgaatctgttttgcggccaggtggtaaattcttgttatcaggtatctaccaagataaggcggatgtcatcgttgccaagttagaggcctcgggttatgtcgtggacgagaaaatgaagctgggtgagtggtacggtttgattgcgcaccgggcgagtgaggatgaaaagtaatgcaacgttattttttgacggaaacgccagagactgacgagtttgatttgccggctgacattgcgcatcatttgatgacggtcttacgtggcaaagttggcacgatggcagagtttgtttaccccgatcgtgaaacgatggtcgttgccaaggttagtgagattggtgatgatgtgacacgcatgacggtggtggaacgagttgaagctaatgtcgaactgcctgtgcaagcaactttgattttaggactggccaagggcgataagccggagcttgtggtgcagaaagcgactgaattaggggttcatcacattatctttgttgaaaccgattggtcggtcgtgcattggggaatgaaagcagataaaaaaattgcgcgtcttgccaagattgcacaaggtgctgctgaacaatcccaccgattgactgtgccggatgttcagtatttgccaaatttgcaagcgctgacgctaccagaagcaatgattaaaattgtagcttgggaagaaagcgcaaagcaaggtgaagcagcgatgcttgcccaacagtttgcccagttgcgttcaggtgatgaagtcgcctttttggttggacctgaaggtggcttaaaggaagctgagttagaattactaacggaaaagtttgggttcgtggcggcaggacttggcccacgcattttacgcgctgaaacagcgccactttatgcgcttagtgccttgagttttgcgctcgagttagaacgttaggaaagattagtgtggtaacacaaaagaggtaaggaacatgaagcgattaaaggaagcgtttgattggcgtttttgggtttgggtgccaattctggcactcttagtacctttcattattaataaaacggcgttgagcgttaattttaaaattgtcttttcattatttattgtgaatatgatttttagtattatcgcaggtgcattcttacggaaacatggtgcattttggtatttgctatttatttggcccatttttttcttagcttcaatttggttagggctaaattcacatatgtacggttattatctagccgcactgtacttcgtcattgagttgtttgcgtttacacgtgggcaagaggaagaggttgatgtggagaatcaaatcccagtggatggtggtttccgcgaaatataatgacatcgcgattgacgtgtcatgaggctttacggcttaagaggttagaacagagtgatctgttctaacctctttttttgtgaaccggtgtccccacctcccaccacgtaccaccattcaccactggcttatcgttagcttaaaagactggtatagcaagctttgtcgcctgaaaagttaaagaattcttcaaattctaaagttcttcgaaaacttgtaaagtgactgttaaaaagggtgctccaggccggtatatcaacatttctgtctctaaaatcaagctatatccttgtggtgacgtgtgggggtaggtggtgagatgtgggagattgtggtaaattaaatgtattgaattgtcgacttttcttaacattcgcaaccggtagacctggttgattaaattgaaagggggtaacgccgatgttcatgggtacataccagcacacgctggatacgaagaaccggttgattatccctgcaaaatttcgcaatcaattaggtgacgcctttgttatcacacgttggatggatcattcactgcgtgcttatacaatgagcggttggcaagatttttctgccaagattaatgctttgccggaaaccaatgccaaggcacgccaatttaagcgatttgtttttggtggcgcattggaagtcgaatttgacaagcaaggtcgtgtgaatttgtcacagactttgcgtgaatatgccaacatcgataaggatgtgacggtgtttggccttggtgatgatacttttgagttgtggagtgctgaaaagtggcaagcctacgaagaagaaacagctgagaactttgatgatattgccgatggtttggaagacctcggtttctaaaaaataaagcaaactgggttatgccggttaactaagatgaaaggtcaaacggtttaagccatgacggaatttaatcacgtgacagtcttgcttaatgaagcaatcgataatttaaatgttaagccagatggtgtctatgtggatgcaaccttaggtggcggtggtcactcacaattgttggctagccgtttgacaacgggtaagctctggtcatttgatcaagatattacagcaatcaattacaatacggagcacctggcacctgagctggcggctggtaaggtcgcctttattcaaaacaatttccgtaatttgaaagctgctttggctgaagttggggtgactgaaattgatgggattgtttatgatctcggcgtgtcatcgccacagtttgatgatgggcaacgtggtttctcatacaactatgacgcgccacttgatatgcgtatggatcaatcccaagagttgaacgcccggacggttgttaacgagtgggatttccacgatttgcttcgaatcttgtcacgttacggtgaagaaaagtttgccaagcaaattgcacgcgctatcgaacggcagcgtgagattaagccaattgaaacaacttttgaactggtggaagtgattaagtcagctattccggctgctgctcgacgtacgggtggacacccagctaagcgatcatttcaagcgattcgcatcgcagttaatgatgaacttggggtggtagaagaatcgttagcccaagcgcttgatatgttaaaagttgggggacgaatttcagttattacgttccactcgttggaagatcgtctggtaaagacaatgtttaaagaaaagacggcgttaccggaagtaccagcggggctgccaatcattcccgatgagatgcaacctgattttaaattggtgtcacgtaagccaattttgccatctgaagaagagatggcggaaaatcaccgggcacattctgccaagttacgtgttattgaaagactacgttaatgaaaactgttcttaactaaataagaacgtgtaaggaaggatctgaaagtcatggatgcaatgccaaagtacgctggcaatacagcgccaaaaaaagttaatcagccgcaacgccgggttaagactaagacggtgcgtcgcccttatgagaagcccgtttggaacgcaatggatttgacgatggctgctgccgcggttgtaacggttgcatttatggcatttttggtcatgttcatggcaagtaagggtgcttcagctaataagcaacttcagtcaacaacgacgcagctcgagcaattacgtgacaaaaataacgatttgaagcaagaagttagcagcttatctagtccagatcgtttgggtcaagttgctgaaaagcatggcttgagtttacagaatcaaaacataaggaacgtgaagtagcatggtaaagaaacaacggatgccaaaacgtaaccaatcggataaatatagtcgcaactccgggcgcattttgctcgggtcgatgatactggtattggttgtgttgggggtccgtttttcttatgttgccgttgccaaagaggtaaagggacataagttggacaaggccgctcaactcatttatcagagtcaaaacgaggtgcaagccaaacgtggtgaaatctttgattcggttggaaatgttttggctgaaaattcatcaacctacacggccgcggccgtgttagataaaacacaaaatgatgcggacggtaagcctgcttacgtaaagccaagccaggataaaaaggttgcgaagcaattggctggcgttttaggtagtaaaccggcggaatatcaaaaagtgttagcaaatgcccgtaagcaagatttgaatcaagttcagtttggtcaacacgggttaaaaatggatgtgacgacgtacaagaaggttaaggccttgaaaatcccgggaattatttttacaccagggacgtcacgtttttatcctaatggtaaattcgcttcggatttggtgggaatgaccagcgaaaaagtgaacgataagacgggtaagcagacgttaacagggatgatgggattggaacaggcttataacaagcaattgactggaaagaatggtgtcaaaaccaccagcgtcgatgacggagatctggctgtttcaaaacataatcaaccggccgaaaacggttatgacatctatacgacgttgaatacgaagttgcaaacgacgttggaaaagaaaatggacgcgttggatgacgatatgaaacctaagtcggcaatcgctgttgtgatggatacgaagacgggaaatatcgtagcgacaacgcaacgaccaacgtttaatgccacgacacgcaaaggggtcggtacgtattggaataacgagttggcatcaacgacatttgagccgggttccgttatgaaagggattacgttggcggctgccattgatacagacaattggaatggcgatgcaacttaccaatccggtacattaaaaatcggcgaccgggcggttactgattggaacaatggtgagggttggggtgaaattacgtatgcccgtggtattgcagaatcctcaaacgtcgcgatggcgctgacggagcaaaagatgggggcggatacatgggaaaagtatattcaccgtttccgctttttgaagtcaactgactctggtttgaatggcgaagctgctggaacaatgcaatttaagtatccaatcgagcaagctaatactgccttcggacaagcaatttcaattacaccattgcagatgatgcaggcttactctgccattgctggtaacggtgaagaattgaaaccgcatgttgttgagaaaattgttgacccaaataccaaaaaagtggtttatcaagccaagcgtgaagttgttgctaagccaattaaggcatcaacagctaaagcgacccgtgaacaattagaggatgttatttattccgagtacggtctcggtaagatgtatgctatcccaggggttaaaacaactggtaagtctggtacggcacaagttgccacagcaactggttattcagcaccgggggacaatacgcacgagattcattcctggatgggaatggcgcctgctaagaacccacgttacttgatgtatgtggtcacgaaagagccacaacgaaacactgcgaatattgcaactgatatgtctgacgtgttcgtcagcgtgatgcaacaagccttgcaaatgtcagaagatgataataaggtggttgttagtgcggatcaagaggtgaaaattccaacggttgtcggtggttcaactgccgaagcaaaacgtgaagtgaccgccgctaatttgaccccaattgttatgggtgatggcaaaacggttaaatcacaaagcccaattggcgggcagaagtcactggttggccaacgggtattcttaaatacgggtcatgacattgccgtgccagatatgggtggctgggcaaagagtgatgtgttagcgtgggctaagttagcggacattaatgttgtcatcaagggcgacggcttcgttagcacgcaatcgattttgcctgataccaagttagcggatgggtatcacgacattacagttgaatttaaggaacccaaaacaaattagagattaatgattgagaggagacgtcgagatgacgactttgttactaggcttattagtgggtctaattgcaacggtgctagtagtgccccgtttgcgagattggtttaagaagattaaggtgcaacagctggtgatgcgtacaggaggaaatggtcctgatcacgcggccaaagccggtacacccacgatgggtggggctgggtttatcccggttgttgtgttgggattcgtgattctcgcattagcaactggtcacgcagcgccaactggttgggcaacgctaattgccattattgtgtttgctttggttggtggttttgatgacagtatcaaaatcttcaatcaccgtgatgaaggtttccgcttcttgccaaagctgacagcacaaatcgttgctgctttactagcaatgttagtgctttacttgggtaaatttgattttgtgcttgccttgccatttggtttgggtgaaatcaatagtgtcgtggcctatgccttgtttactattttttggcttgttgggtggtctaatgcgacaaatctgacagacgggttagatgggttagcatctggaacggccattattgcttatgtcgcttatctaattatcgccctgatgcaaggtgatatgagtatggttttgttagacgccttgatgattggtgctttgttgggcttcttggtctttaaccattacccagcaacaatcttcatgggggatacgggttccctagcgttgggggctggactggcaatgaacgcattagtccttcaccgagaatggtcattgattttgattggctttgtctttatggttgagacgttaaccgttatgattcaagtaacgagttatcactttttcaagaagcgtgtcttcttgatgacgccgattcaccacagcttcgaaaagggtggcttgacgggtaacactgacaagccttggaatgaatggcaagtggattcgttcttctgggcagttgggttgattgttgccattctatactttatcttgtttaagtaaataactatttaattaaagcggaaacgctgacatatcgcattttgttaacggcaaaatgcactgcgggcttgcccgtgtacatattttatataaggggatctgatcatgaataagcatgttttggtaattggctttgcacgttctggagcagccgttgcgtcgttgttattaaatgaaggtgcgcaagtgacggtttcagacccaaagatggatgtgacaaacgaggacgttgtggcgctacaagcgcgtggggcgacgtttacaacggaacaaacaacggcattgttaacaggtgttgacttagttgttaaaaatccaggtattccatacacgattccagttctggtggcagccaaagatgcagggattccaattgtggttgaagttgctgtggcacaaaagtacattcgtggtgaatggattgccttaaccggttcgaatggtaaaacaacgacgaccgagatgattgcagctgtattgcgtacgcaagcaacggctgatcatcaaattgttgttgctggtaatattgggacaccggtaagtgaagtggcgcctagtttacgtgacacagatactttggtcactgaattatcatcattccaattgatggggatgcctgaagccaagcctaatattgcgattattactaatatttttgcatcgcacttggattaccacggctcacgtgaaaattacgttgctgctaaaatggggattaccaaaaatcaaacggcggatgactatttagtgattaactacgatcgcgctgagtggcgtgaattagcgcagcaaaccgctgcaactgttgtaccagtctcaagattggataacagtgaagatggcgcctacgagcatgatggtcagttatactatcaaggcgagttggtcatggctgcagctgagcttggcgtgccaggtgatcacaacgtagaaaatgcactggtagcaatcgcagtcggtaagttgcgtcatgtgccaactaacgatatcgccgaggcattgcgacgcttcacgggggttgaacaccgtttgcagtttgttggtacgtttgacggacgccaagtatataatgattctaaggcaacagatatcgaagcgactgaaatggctttgtctggtttcacagcacctgttgtgttgctagcgggtggcttagaccgtggcgatgatcagatgcgtttactacaagcgatgaaggcgcacgtcaaggcattgattgtctttggtcaaacagcagacaaggttgcggcagtcggtgaggcgttggcgattcctgtcgtacacgcaacggatgccccagcggcggttgcgccagcctttgaactcagtgagcctggtgatatcgtcttgctatcaccagctgcggcttcatgggatcaattcccaaactttgaaacccgtggtgatttatttgtagcggctgtccaagcacacgctacgaaagattaataaagaggaattaacaattatgcgtattgttgtatctggtggtggtactggtggacacatctatccggccttggccactgttaagcaattaaaaaagcaagatccaagtactgaggtactctacattggtggcgaacgtgggttagagaagactatcgtacctgatgcaggttttgactttaaggcgttggccgttcagggatttaagcggtcactgtcagtggataattttaaaacgatttacctgttcttaagcgcgacacgtaaggctaagcagatgctactggactttaagccagacgtcgttgttggcacgggcggatacgtatcagggccggtgttgtacgcggctcagcaactacagattccaacggtcattcacgaacaaaattcagttgttggtgtcactaataagttcttggcacgtaaagtgaccaaggtgggagttgcctttccggcagctattccagcgtttaagcccggattggcaacggtggttggtaatccccgcgcccaagaagtcgtcgatggtgaaggcagcttcaattgggccgacttgaacctatcagcaaccgtgccaacggtattgatttttggtgggtcgcaaggtgcgctgaagctgaacaaagccatggtggcagccttaccgaagttcgctgatcggccctaccaagttatttttgtaactggtggcaagcgctttgatgaagtgcaagcggacatgcaagcagctggcgtgactgcggctgcgaacgttgcggtggtgccttatattgggaacatgccacagttgatgccagcggttgatttggttgttggccgggctggtgcgactagtctagctgaacaaacggcattgggtaagccaatgattttgattccaagtccgtacgttacgaatgatcaccaaactaagaacgcgcgtagcttggttgaagctggtgcagcggaaatgattaccgaagaatcgctaacgggtacgacgttgtttggcacaattgatcaattgatgacgaatcaaggtgaacgtcaagcgatggcgacagcagcgacaacgttgggtgtcccagatgcagctgaccaatttatcaagttgattaagtcagttattaaaaactaatgtagctgaaaatgccagggtgttacgtgatgaaaggaggtaatgatggccgataaaactactcaaaatgataagtcttcgtcagatattcaagcacatttggatgcgttgctatccgaggaggattggtcatcgttaccaacacgacgcactggtaaaagtggtgccgacgaagttgccgaagccactaatttttcggcaaatggttatgatgacgatgatgttgaggcgaacttattgcgggctaagccacgattcgatccatcggcacggcgattatatcaacacgaacgaagtacattaaaatcacttgctgttctgggcgtcgcggcggcattcttaggctactttatctcgccttttggtcagattcagaagttcaatgttgtcggcacccaagatttgtctgacaaggcggtcttaaaggcggctggattgcaacttgggcaaccgctgttttcgaccgtacatcaaagtgcttattttaataaattagcgcagaaaaatgatccacaggttgctaatttaaagttgcgattggttgggacaaatacggttgaagtgaaagttaaagaaattgtccaggttggctacgtgaaggcaggcagtcgttattacccaattttggcaaacggaaccatgcttaagcacggttcggcctcgcacccagtcggggggctgccattgtatgacggctttacgtcaggtaaacaactaaagctgacgttgtctgaattcggtaagttatcaacgccactgcgtcatgcggtctcggagattgtttggtcaccagatgcccagaatgcacaacgcctgaagttgtacatgaatgacggtaatcaggtcttaattagtgctgatgatttatcgaaaaaattgcggtactatccaggcatggttgcgcaattagacaaaccaggtcaggctgacctacaagtgggggcgtatttcacgccgtatcagtaagaaaacctgcttgaaagtatggaagaaacacctgaaagtatggtattatttttaaagaattgtttatcccggtagcaattagcctaagatttttgatttcagtcaaaaatgttgcgcaaagggcgaccggatagagcggaattggtcacgtcgggcgctatttggccccaacgtgaccagtctactttatttatttaaacaacatcgtttggcagtcaaaggaggaattaagatggccaaccatggtttgattgttggtctcgatgtcgggacgagcaccattaaagtgttagctgcagatgttcgagaccaacaagctaatatcgttgcagttggtcgttcagttgctcatggcgtaaagcgcggtatcgttgttgatattgatgcgactgctaacgacattcgacaagcaattgcacaggtaaatgagcagactgacgtccctgtgacagaagttgttgcgagtttgccggcaaataacattcaaattcaacatgtcagtggcatggtaacagttaaagatagtcagcatatttcatatgctgatgttgctgcggccgtgaaacaggcaattaaaattcaattaccggctgatcgagaagttgtggagctgttgccaacggagtttatcgttgatgactttgatggcattcaagatcctaacgatatggtcgggatgcgtttggaaatgaagggggtcgcctatacagcaccccggaacatcctgacgaatttacggatggcaattgccaaagctgggttgcagctacgtgattttgtgttagcgccacttgcatatagcaaaacggtactagcagagggtcaacaagaatttgggacgattctaatggacatgggtgctggtcaaacaacagcaaccgttgtccatgataatcagctgaagtttttgactaccttcccagcgggaagcgagaatatttctcgcgatattagcgctgtattggaaattggcttacacgatgcagacatgttgaagttggatgctggtttggcattgtcagaaatggcaaacgcagataacaaactggttattcaaaaagttggggctgagacgcctgaacaagtatctgaactaatggttgcacaaattatcgaggcacgcttgatgcaaattctggataagcttggtgaaaagctaaacttagttggcacatttgatttgcctggtggcgttgtggtaaccggtgggggtgccgcattgcgaggtgcaccagaggctgttaaggcagcttatcaggttcaggtgaagtcatttgtaccaagtgatattggcttgcgtcatcctggctatgcaggggcatgggcaatcgtgcactatgcggcgcaacaaacaccggtacaattgattgtgaaggaagctttgtatgatttgccattgacggtgttaggtcaaccaacccttgggcgtcaggttatgtcaacgccggtacaacctgagccacggcaagcgatgcaagcagttcaaccacaaacggcagaaccagttgatgcatcagaatacgagcaaacgtcagtagaaaacgatgaaagtccaaagaagcaaaatccaattcggaatttcttcaaggaatttttcgactaattataaaagaaatacagagtagaaaaaggagctcgttatggatttccaaatggatatgaaccaagagtacggcgcaacgattaaggtcatcggtgtcggtggcggtggtggaaacgccgttaaccaaatggtgagcgatggtgttgaaggtgttgaattcatcgttgcaaacactgatgcccaagcacttgagcgttcagcagctgaaaataaaattcaaatcggaacaaaggcaactcgtggacttggtgctggtgcccgtccagaagttggtgaagcggccgcaaaggaaagtgaacaagaacttgccgaagcgcttgctggtgcagatatggtctttgttacggcaggaatgggtggtggtactggtaccggtgctgcgccagttatcgctaagattgcgaaggactcaggtgctttgacgattggtgttgtaacacgtccattctcatttgaaggtccaaagcgtggcaagtcagccgctgaaggattagctaagttgaaggaaaacgttgatacgttgatcgtgattgctaacaacaacttgcttcaaatcgtcgataagaaggcgccaattatggaagcctttaagatggtcgatgatgtgttgttgcaaggtgtgtctggtatctcagatttgattaccaagcctggtatcatcaacttggactttgctgatgtgaagactgccatggctggtcaaggaactgctttgatgggtattggttcagcgtctggtgaaaaccgtgccgctgaggcgacgcgtaaggccattgcttcacctttgttggaagctaagattgagggtgcaacgaatgtcttgctttctgttaagggtggcgcagacatgtctttgttcgaagcgcaagaagcttcagaaacgattgctcaagctgccggaaccgatgttgacatcatctttggaacaacgattgacatggaaatggagggggatttggttgtgacagtcattgcgactggtatcgatcgtccagcaacgccacgtcctgaaattaatcttggtacggtgaatactgcgagcccttttgaagcagtgacggaacaaccagtgcaacaaccggtccagccacaacaaacggcacctgtacaaccacaacaaccagttaacacagatccgtttgcggattggaatgttaagccagaacagcctgtacaacaacaaccagcgcaacaacaagctgcacctgttgaacctgtacaacctcaagcagccccagagcaaacggcagcagaagaggaaatcgagcgtcctgcttactttaactggatgaagcgcggcgataagtaaggagactgacaatggcatttaagttcaaggaattcttcggggtagataactactacgaagaagaggtacctgaagagcaatatgctgaggacactgcacaagggtctgctgcaccaacagcgacttcaaatgcgacccgtccgactgctgcccgtcgtcctaatgttttgaagatggatggctcacgaagcgaaacgtcaaaaatcgcattgtacgagccacgcacatatgcagatgcccaaacgattgccacacaattgttggcgggcgaagcagtgattgttaaccttggatcgattgacgagaatactggtaagcgtgtgctggactaccttggtggaacggcatttgcggttgatggtattatcgaacgtgttggtgagcgcattttcctggcaacaccacataatttcgaaatctctggtaccatctcacaaaacttaggacaacagttcaattaataggtgataatatggttgcaatctttttacttttgagtctgattctacgagccttggaatttgtgattcttatctgggttttgatgtcttggttgccaggtgcacaacaatctgcgctgggtcaatttttgggcatgattgccggatttattttagatccactacgtcgttttattccacgcacgggatttattgatttcacacctttggccgggttattgcttttgcaagcagctcaagttggattgcaagcaattgcacgaatgatataaaagaagaaacgatatggcagataatgtagcacagcatttccgcccgagtgaagccgcgtttcttgatgtagcgcaaggcttaattcgtcaggctctggatgagtatcgtccagtcctgacgaattttttaaacccgaggcagagatatattattgagacgctagttaaccagcacgacgacttaaaatggcaacatgaaggtggttatgctgatgccgaaagcgctcgaacagttatcgcgcctgcgtattatgatattcagcaaagtgattttgaacttgccgtgattgcaattaattatccacaaaagtttgctgaattacatcacagtaccattttgggcacgttgatgaataatggcattacacgtgacagtatcggtgatattattagtggtgaagagggaacgtggcactttttgacgacggtgccaatggcgacctacattcaaaccactatggatcatatcggtaagacaaaagtacgttttgagacggcctcattggcagatattagcgcaccaatcgaagaatggactgaaattgacacaacggtttcgtccttacgactagatacactggtagctaatgggtataatgtctctaggacgcatgcaaaagagttggttgaacgtggtcaagttcgtgtaaactggactgacgtggaccgtccagactttgtcctagcggtaaatgatttggtttccgtccgccactttggtcgactgaaattagttgccgagaacggcatgacaaaaaaagataaatggcgagtgtcactcgctgtgatgaagaaatagattggagaaagcacatggcattgaccccacaagagattcacgcgaaggaattcacaacaaaaagtaacaaatggtacgataaggccgaagtttcagaatttttggaccgtatcgtaactgattacgatggtatgatgcaagagaatcaaacgttgaagacgcaattggctgaagcagatgcaaacgctaagcaagttgaagagatgaagcaatctgttaattcatcaattttgattgcgcaagaagccgctgatcgtttgaagaagcaaacagaggctgaagctgaagcaacgttgcaacaagctcaagctgaagcacaaaagattgttatggaagctaacgcgaaggccaatgctttgttgactgagtcacaagctaagaacgaaaagttggttgctgaaaaggatgctttggacaaggacatgggtgcctttaaggccaagattgaaggtctattgcaggcacaaatggatttggttaagactgatgattgggctgcgttccaaaagccagccgctaaccaagtgccatcagcatcatctgcaccggttgcaccaacatcagcagccgctgatagttcagaagtagaaacggttgttatcttccctgaatcagcagaaagcaacggaaacttcttgaataaggactaatttttcgttatcatgtaaacatggtttcttgaccaaacggtaaggtgtattccaaacagcgacctagaattaacccggtgagagtctaggatggtgacgcactttgcttatcagcaagaaagttttttaatcaaatacacagaagaggcggcagtttgccgtgaattcgggtggtaccacgttgacatgacgtcccgcattggctagtgatagccggtgcgggattttttagtttcagggtaagccgcatgtcaacgcggtagcacttggattgaacagaaaggattgcgcttttatgaagatgaagcaaaccttgaacctaggaaagacgaagttcccaatgcgtggtaacctaccacaaactgagctacaacgtgaaaacatctggttcgagaataaggtctatgagcaacgtcaaaagatgaacgaaggtaagccatcatttatgcttcacgatggccctccatatgctaacggaaacattcacatcggacacgccatgaacaagatttctaaggatatcatcgttcgttacaagtcaatgaatggtttctacgcaccatttgtccctggttgggatacgcacggtttgccaattgaacaacaattgacgaaggctggtaaggatcgtaaggcggttggcccagttatctggcgtaagatggccgaagaatttgcacgtaagcaagttaagacgcaaatggccgacttcaagcgtttgggaatttcagctgactgggataacccatacttgacgttgttgcctgaattcgaagctgcccaattgcgcgtcttcggtgagatggccaagaagaacttgatctaccgtggtaagaagcctgtcttctggtcatggtcatcagagtctgctttggcaatggctgaaatcgaataccacgacattgagtcagacacggcgttcttctcagagcgcgttaaggacggtaagggcttgttggataacgacacgtacttcatcgcctggacgacgacaccttggacggtaccagcttcacaagctttggctttgaacgctgatttcgaatattcacaaattcaaccaaagggttcagacaagaagtacatcgttgcttcagctttgttgggtgccgttgcgcctaagttcggctgggacgagtacgaagttgtcgcaacctttactggtaaggaacttgaaatggtgacaactgagcacccattcatggaccgtgagattttggttgttaatgctgattatgtgacggctgatgccggtactggtgcggttcacacggccccaggatttggtgaagatgactttgctaccggtcaacgttacaacatgccagttatcatgaacgttgatgaccaaggtaagatgacggccgaagctggtcctgactttgaaggtgtcttctaccaagatgctgacaaggtatcattgcaaaagcttgaagaagctgatgcgttgatcttgcacgaaccagttgtgcacagctacccatttgactggcgtactaagaagccagttatcttccgtgcggtgccacaatggtttgcttcgatcgatagcttccgtcaagacattttggatgcattggacgatgttaagttccaaccagaatggggtaagaagcgtttgtacaacatgatccgcgaccgtggcgactgggttatctcacgtcaacgtgtttggggtgtgccattgccaatcttctacgctgaagatggtacggcaattgttgaccctgaaatcatcgaccacatcgctgaattggtagccgagcatggttcaaacgtttggttcgaacgtgaggccaaggacttgttgccagaaggttactcaaacgagcactcaccaaatggcgaatttaccaaggaaacggacatcatggacgtttggttcgattcaggaacttcacaccaaggtgtcatggccacgcgtccaaaactaagcttcccagaagatttggttttggaaggctctgaccaataccgtggatggttcaactcatcattgatcacaggtgttgctgtaacgggtaaggcaccatacaagtcagtcttgtcacaaggatttgtcttggacggaaatggtgagaagatgtctaagtcattgggtaacatcatttcacctaacgaagtggtgaaggagatgggggctgaaattatccgtttgtgggtaacgtcagttgattcatcagccgatgttcgtgtatcaatggacttgttgtcacaaacgtctgagacataccgtaagatccgtaacacgatgcgtttcttgctggctaacacagctgactttgatccaaaggctgatacaattgccttcgatgatttggtcgcagctgaccaatacttctacgcccgctttaacaagttggttgctgacatcaaggctgcctacgacgtgtatgacttccaagcagtcaacaagttggtcatcaactttattaacgttgacttgtcagcgttctacttggacttcgccaaggacatcttgtatgttgaagcgccaaagggacacgctcgtcgttcattgcaaacggtcttgtacaaggtcttggtagacttggacaagttgttgttgccaatcttgccacacacggctgaagaaatctttgagtatcttgagcacgaagaaggtgactttgcttacttgactgagatgccagctgttgcagatattgctaacgctgacgaattgatggctaagtggtcagaattcatgacgttgcgcgatgccgttaacaaggcgttggaagttgcccgtgatgcgaagttgattggtaagccagccgaagcagcggtaacgttgttcttgactgacgatcaaaaggcttggttggattcattgggacaagatgttcgcgtcttgttgcttgtgtctcaattgcacgtagcatcagccgatgaagctgatgatgcaactgactttgatggttacaagattgcggttgctcacgcagaaggtgaagagtcaccacgtgatcgtatgtaccacactgatttgggcgccgatcctgacttcccaatgttgtcagcacacgaagcacaaatcgttcgcgaaaacttccctgaggctttgactgaaggcttggagtaattcacgattaaacaaaaataatatcgataacagaaaacgccgagagattttgtctctcggcgtttttacgtctataatggagggtatatagtttggtgtgtatgtgtcctccttggtaatcggagtgattagctccttctttaggcacgctaacatgtggcggggctaatcaccgcagccaagcaatcctttaatttttcgattgacatcgactaaaaaccattacggtagtaaaaatacaccatttattttgcggtagatgacaatccatggcggactggcatatctcggctgctgtggctgggggcgccccgcgtatagaacgaggagtggctaaatatgtggcagtcgcacttagcggttttaccgcttagtgctaccaggggtaaaggtgtacgcggcaaagccgtggactccgcccgccactattttgacacacctcgtttagcgggacaaaagaagccgcccgccactcgacgcaacgcgtcgacacacaacacaaactaacatacataacgaattcaagacaaggagaccaaagcatgacgaagctatacttcatccgccacggtaaaacagaatggaatgccgaagggcgttttcaaggagcaggtggtgattcaccactgttaccagaatcatacgaccaaattaagatgctgggccgtcacttacacgatgtaaaatttgcgcacgcttttgctagtccaatcaagcgagcacgcattacagctgaagaaacactagcccttttagatgaaaagcccgagctaacgtttatggatggattgaaggagttttcgtttggtgtctgggaaggcaagacgtttgcggatgtccaagctggctggtatgacatgtacgatgcttcgcgcaaccacccagaaaagtttgacgccgcgcaggtgccaggggcggaatcatttgaaagtgtgcaagcacgtttccgccaggcagtcgaaacagcggtaactgaatacggtggcgaaggggttaacctggttttctttagtcacggcgcggccttaacgaccggtatgggtgggttgacagggattccattggccgacttacgcgcgcgtgggggcttagggaacaccagtacctcaattttagagacggcggacggtaaaacatttaccgaattatcacgaaacgatacaagttatttgggtgtcagcagtgatgcctcaaatacaatttaagcgaagaaggaactagagagatgacgcaaccagaaaatgcagcacaagcggatatggcacgcttggtcgccgaaattaacgctaacccaaataactggcaagcctatgcagacttggtagctgttttggttgcaactgaaaacttgattgaagcagaggatttggccctaaagagtttgggactcttccaagcgaatgatgaagctttgcaaaacttgctgtacgcgacgggtaatgtgtattacgtggcgggggattatcaacgggcaaatgatttctttggtaaaattactgatttggctattttgcatgatgcaactgtgatgcaggcacaaggatggtatgctcaaaaccaattccaaaatgcattggtatatgctttgacagctgttgagcaacagccagaagacactggtgcgcaagtattattaggcaacatctggctaggcttgcaacatgaatcaaaagcagctgaagcttttgatgcagcaatccacgttgatccgatgaatttcgaggccaattttggtcgtggggttgtggcaacggccaagggcgatcaagacaatcaatggttggcgacggcccaaatgattgatttacaacgttatcaggcacaagcacaacgattagatgaaatcgtccaattactatcagggagccgattagatggagaatcagactagtttgttcgacggcccaaatccaacggatgagcaacccactgtttccggccaagttaagaatattctttttgcggctcaggattcattttataaagtcatgattgttgaagttgctgacctgaattttgactatgatgatactgaaattacggttactggtagctttggtgatattcaaattggcgccagttatgaatttaagggtcgtttaacaactcatgcccgttatggcacgcagtttgcagcgcaaaattatcaacgacaagcagccagtacgacgtcaggtttagtcgcctatttgtcaggtgatcaatttccgggggttggtaaatcaacggccacaaagattgttgatgaactcggtatcgaagcggtggatttgatcctagaagatccagctgtcttgacacaaactgggatttcaacgaagctgcaagaagtcattgtgaatcagttacaacaatctgatggcatggaacgggcgattatcgcgctaaatgattacggctttgggtcggcgttggcaacggccatttatcaaaagtatcagcaacagacactgcaaattttaaagacaaatccctaccaaatggtgattgatattgatggcgtatcatttgcccgtattgatcgtttggctgcccaacaaggtatcgatgccttggacgcccgtcgcattcaggcgggcgttattgcggcaattaaccaagcaacgttcgagtctggtgatacgtacatgcaagttgaagcgttattgcaggcaacacaacaaattttggaacgggcgcagaatgcccgcgtggatgtggctttaattaagcgggcactgttgacccttacttcagatggcgtggttattgctgacggacaaaacttatatgtaaaagctttgtttgaagcagagcgcgaaattgcacagaagttagtacgcctaacgcaacgcaaagcgggtgagtatgcccgcaaagatgtcgtgcagtacctgaccgaagtggaagaagagaatccgtttccatatgatgatgtccaacgagaagcgatgattgctgcgttaaccagtaatttgtttattttaacgggtggaccagggactggtaaaacaaccattattaatggggttgtggcaactttaaagaagctactgcaagccgaaggaatgaaatgggatgagattgagaccagtattcgtctggccgcgccaaccggccgggcagcgaagcgtctctcggaatcaactgggatgcctgcgtcgacgattcaccgcttattggggattaatggtcgtgaagacttggatgagattgatatcgaagagttgtcaggtcgcttgttagtcattgatgagatgtcgatggtggatacgcagttgtttgatttgctattacgcggtatcccgggcggcatgcaagttattctggttggggacaaagaccagttgccgtctgttggacccggtcgcgtcttttatgacttattagctagtggcttgttgaattaccgtgagttggagacgattcaccggcagggtaaagggtcaacaatcattgcgttggcgagtgctattcgtgccggtcagttgccagaagattttacggtgcgccaaccagatcgctcattctttccagcacaaacgacgcaagtaccacgactaattgagcagattgcaacgagttggaaagaaaaaggcaattcggtcgcagatatgcagattttggcaccgatgtataaaacaccagcgggcgtgcataatttgaatgcagttgcccaagagattttcaatccgatgacccctaaaaagcgggaaatcaatattaaattaggtgacttagcgtttagtttccgcgtcggtgataaagtgatgcagacggcaaatgatccggaacacaatgtctttaacggtgacattggatatattactagtattatgttggccaaggataaggcaaatgaagataatacggataacattacggtggcttttgacacaggggaagttgagtatacgcgccagaactggaaccaattgacgttggcctatgcaacgaccattcacaaggcacaaggtgccgagtataagttagttattatgcctttggttaatgcgttctcccgtatgttacaacgtaatttgctgtatacgggattaacacgagcaagtgagtcattggtgctgattggggatgtgagtgcctatcagcgtgcggctgtgacggaaggcgttaatcggcagacgactttgcaggaacggttgcaacaagccgaagcgggacaactacctgaaacgccagatgaccatgcctcaatcgcaactctaaatcaacagccactggcagttgatccaacggcggaagtagttgatgaagagaatacgatcgatgattcgccggcagtcaatgaaattgttcaggcagttgccgacaccgaggatgatatcctaacaattgcacaaattaccgccgaaacaattgatcccaatattggcatggctgatttgacgccgtatgactttatgtcagctgagaatatgctataattctactagtcaagcacagacaatgtgtgataaaattaatcgataaattttcgaatgaaaaggggtttctgaaatgtcaggacacagtaagtggcataacattcaaggacgtaagaacgcccaagacgcaaagcgtggtaagatcttccaaaagcttgcccgcgatttgtacacggcagctaaggctggtggtgtagatccagattcaaacgcaggtttgcgtttggttatcgacaaggctaaggcagctaacatgccaaaggataacatccaacgtgccttggataaggcttctggtgccggtggcgctaactaccaagagttgacgtacgaaggttacggaccagctggtgtagctgttttggtccaagcgttgactgataacattaaccgtacggctgcctcagttcgttcaacgttcaagcacttcggtggtgaattgggaacgactggatcagtttcattccaattcgatcgtaagggttacatcgaaatcgagcgtaacgaagataacgatattgatgaggatcaattgttcgaagacatgttggaggctggtgccgaagacatgaagacttacgatgaccaattcgaaatctacacggatgcgaagtcattccctgaagtacgtgacgctttggaagcaaagggttacacgttggtcaacgatgaagtaacaatggttgcccaaaacccaatggcagtgcctgaggataagcaagcatcattggctagcttggttgatgaacttgaagaaaacgatgacgttcaagctgtctttacgactgctgagtagttttcgttaaaaaagagacgtggatttcccgtctctttttttgttaccaaacataactgttgacgctgtgaacaaaaagcgataaagttataaacaattattaatagttgagtcgttaacgtgttttgccacagactcggaattgggtatcattgcgactgcgatgataccgttaacgacgccgggatatttttttatcttggcgtcgtttgtttttccgtatcattgtgcgaaaccgtcgatgatgcggaattttttattaggagtgaaatgggtacatgttagaacgattcttcaaactgtctgacaatcacacaaatgtgcggacagaaatcattgccggaattacaacttttgtggcaatggggtatatcattttcttgaatccgtcagtgttgtctttgacggggatgccaagtcaaggtgttttcttagcaacaattttgacagccgttgtcggtactttaatcactggactgtttgcaaacttgccttacgcgttggcaccgtcaatcggtatgcaagccatgtttacctacacgattgtctttggtttggggtacacatggaagcaagcgttgggaatggtcttcttggttggtctagttgatgtgattatcaccttgacgaagattcgatcagccattgttaaagcaattccggatcaacttaagcacgccatcgcagcaggtattgggctgtttatcgcctatattgggcttaagaatgccggcttcttaaatttcttagttgacccgcaaaacattttaaccttgaacaacaagccatttacaggtggtggggccaaggtcattgaaagtattacggcaaacggtagcacgacgccagaaattgccacgtttagtcagccagctgtcttgttgggactaatcggtttggtggttttggtattgttggtggtcgccaacgtgccgggggccttcttattgtcagtcttcatcacgacgattattggtattccaatgggcgtaacgaatacgcacattgacgccatggcctcatttacatcaacgtttaaggactttggtggtatctttggtcaagcacttggtccagacggcctttggtcaatgttcacgtcgccaaagcacattttgatcgttgtgttaacagtattctcaatgggcttgtcaggtttgtttgacgccattggcacgttcattggtacaggtatgacgactggtattttctctgaagctgaccagaaggagttctacgaaggtaagggctttaagtcaaagatggaccgcgggttggttgcagatacatttgcgacgatgtttgctggtatctttggtacctcaaatacaacgacgttcattgaagcgtcagccggcattaaggcgggtggacgtactggtttgacatcagtcgtcgttgcaattggtttcttgcttgcaattattgcggcaccgctggttaatgtgattccaacggcagcaactgcaccaattctaatcgttgttggtatcatgatgatgaatgagtttaaggcaatcgagtgggatgatattgaaattgcgattcccgccttcttcacgtcagcattcatggccttctcatactcaatttcgtatggtattgcggctggctttattttcttcgttgtcattaagagtgtgaagcggaagtttgctgaaattagtccaatcttgtggattgtgacgattttgttcttgttgaacttcatctcgttggcagttaattaaaaaaattttgaaacgctcttgcgactggttttcttggttgcaagagcgttttttgtgaattaaaaaattgttttgatgacttttggacaaattgtacaaccgtgcctctttattagttgtgaggaggtaagacatgacgacaattcaaacggtatttagtaacgccattttcgaggcagcacaacaccaagcaagtgatatttacattatgccgaaacaagacgggtatcaggtgtcttgttatacggcgggtgggattgttccattggacgtgttaacagcatcggtaggggcagctttaattcgccacattaaatttgaggcacagatggacatcagtgaaatgcggcgcccgcaattgggacggtggacttatcaagcgggtgaccgaccacttcatttgcgggtatctagtgttggtgattttctaaatcgggagtcagtggtcgttcggttaatcgtggcggccaccgaccgccaaattcgatgggtagagacgacgcctgtggctgaactcacggccacgttagcgcgtcgacaggggttagtcttaattgctgggcaaatgggcgccggtaaaacgacgacattgcattacctggcgggacaggtacttcaaaatcagatgattttgacaatcgaagatccggtggaaattgtgcagagtgagtacctacaattacaggttaatcgtgacgcagaaatggattatgcgaccttgctacgattggcattgcgtcaccatccggatgtgatgattattggtgagattcgggatgccgaaacggcgcacattgttgttgaagcggccttgagcggtcatttaattttaagtaccgttcatgccatgtcaatagctggcatttggtaccggctgcgggcattcggtataccagcggccattcttcgccaagttttgattggcttgggttaccaaacaatggtgcatgacacacacggaccaatggctgatttgcaagttgcgcagggggacgaattagtgacattactccaggaggtgagggatgaagaagcagcagtggccgttgaaaacgcaagctgatttttttgaattgcttggccaactgattgcgaacgggtatgcgttagaacggacgttgatgaccgtgcaaggtgttttacccaaacaacggctggcactaaccgcaattgtggctgggttgcatcaaggccaaccactacatcagctactggcaccgtatgtgcgtcgcgaaattgcgcgtgaattggcttttgctagtgtccatggacggctatcgcaactggtgatggaaattggtcgacgggaacatcgtcgtttgagacaaagtcagaagctccgccaattactactctatccagttgtgctactggtgatgttagcgggcttaatggggctattttgtacgtatctattgcctcaattacagcagatgggtgcaacagtgccacagctgtcgcactggggcgttggtttaagcgtgagtgttttaacctgttgtgttgttagttggcttggtggacgaatatggcgtcgacgtaattggctgcaacgactacagctgttacagcgggtgccattcatcggctcactgttgcagttgtctatcggatatcagatgagtttgcaattggggttacttttgacgagtgggattggtttggcgacaatcgtcaagcggagtgcaacagcggatagtccagaattaatgcgactattgggcacgcaagcagaacggggcttacgagaaggccaagatttacgacaagttattcagtcgatgccattattaccgccggaatgtcaacatctttttgcaaaaggaaaatcagaacaagcaattggtgaagattttcaaattttagcgcaacgtaaatttgaactattagaacgacaagtacaacgttatttaatgattattcaaccggtatgttttgcggtgattggtctaattgttatcgggttatacggcattatgttgttaccgatgtatcgaaatatgggggaattaatgacatggtaaagcacacaaagcgtcgcggatttacgttgattgaagttgtgacaacaatttttattattggtctattgatcttattggtcttgcccaatgtgaataacgtgcgtaagttcgctgaacagaagcagcaaacggctctggtacaaacgattcaaacgcaggtagatctttacttgagcgaaaatccagataaggtcgctaatttcggtgatttacaaacgaatcagtacttgtccgcagatcaggtaaaacaggccaaagctgcgggaattgacattaaggatagccaggtgttccgtgcaaaataagcgggccgcgtttacattaattgaaacggtcgtggtgttatgcattgtcagtgtggttggtctatcaggacagcagttgttgcccagcaggtctgcggacgcctgggtgacgtttgaacaacagttcgatttggcgtatgagaaggcccgtcaacggcaactgtatatgggacaagcctttgccgtgattgcgcaaggcgatgccgtgtttgtggataatcaacgagtgcccctaccggcaggctgggtagcacgatatcgcatggttgagtgtcgacgccattatgtgaaaccagcgacaatcatgatgtggcatgcagaccgccccaaaccggtgcgcttagtgtttcaatttggtgggggtacctatgagttgcaaacgtaacgggacgattcttgctgaggcattggtggctgcgctaattttaaccagtacaacaaccttaattatgatgacagtacgttactatcacgtacaacgacaacaagaagaagcccaaatcatggctgttaaacaaacatacaaacaggaacttcgaacgtggttaaaagaaaagcattcaccttagcagaaacattagtcgccttaagcattattatcatgtttggttccctaataacgattggcactcgaatgatgcgtcaaacgcaaacacaagcggtgcaaacgatgacaacgcaacgcgttttacgggccttgattattttagaatcgccagatgctgcctaccgattggtgacgtgccatgcggatgtggttcgcctgcgaagtcaaacgaaacaacaggactacctactcctagttaagcgccaacgtttggttgtgacgacgatgcacagcggacagattgtgttgttaaatcaggtcaaacaagcgaaatttcaacgtcttagtgaccggcgcattggtattacgattttctgtacgacaggccaaaaagtttatgaggaggtgactttgtattgaaacggacacgatcagggcatattttggggcacacgttgggggtgagtggggtgctggtggtggcgctgactggctggtgtgtgatgcagtcacacgcgcaacagttgcgccgggctgagctgttttattggcagggtaagtgccaggcgttagcttatgtgcgccagacacctgaagaacgaggtaagtcaccgcaaccgtatccacgcattattgcaacctccaagtgccatgagtatgtcttggtcgactggaatcggcaggtcattattccgaagtgaattcaacggcctctttccttgtcacttactaaaaaactagctacactggaaggagcagaaaaaacgaggtaaagacatgtttgaaacgattgagaaggcggttaagcaactacaagccgcacaaaataagcttgttgaaacattagacatggctgcaattgaagcgcttgtgattgtgtttgagttgatgctcgggcaagatgatgatgaatgggcaacgctttcagcgacggatcaggcaaatatcctagctgacatccaagcggctgattttgatggtatgaccccagaactaaagcgtcaggtactacaactattgcttgtggcaacgatgcgtgaagatgggttgcaagcaaactatcaagtaacgccagatgccattggcatgtgggtaggctttgtcgttgaacaatttgtgactgcaggtgagccggtaaaggtaactgatttgacggttggttcgggtaatttgcttgcaacggtggcgcaagttttgggacaacaaaagaatgaaatgacagcgagtggggttgaaaacgacgataccatgttgacgattgcctcaggtatggccgctttgctcggcttggattggcaactaactttggcggatgcagtcgctgaccaaccagctgtgaatcaagatgttgtgatagcagacttaccagttggctattatccatcagctgtgccgactgattttacgacgcaagctgatgatggactgacatacgtacaccacttgctaattgagcaagccattaaggcactgcgtccaggtggtttggcggcgttgattgtaccggctaatttgttcgaatcagagcaagcggctaacatcttgaagtatttgcaaggctcagacgttttcttccaagcactactccaattcccagaaaagctctttactaatgagaaagctgccaaggctatcttggttttgcaacgagcaggtggggatgctgtccaagcaaccccagttatgctagcacggacgcctgaattgacaaatgtggcagaaaacaagaattttgtgtcagaaattacggcttggatgacggcaaacgcattacgccacgcatagtgtcacacgtgatacgtgtgtgaaacatttgacaattcagtcggtaaattttgtgctatactatttaaagatattgagcaaattccagttttggaaaagaggagacaagtatacatggctaagactatggcgattaacgccggctcttcatcattgaagtttcaattgattgagatgccagctgagcaggtaattgcaaagggacaagttgaacgaatcggtttgagcgattcaatctttacgttgaagtacaacggtgaaaagattgaattgattcaagacatcgacaaccacgaggctgccattaacttgttgttggaacaattgaaggaaaacaacgttattgctgacttgagtgaaatcacaggtgttggtcaccgtgtggttgcgggtggagaatggtttaaccactcagtcgttgttgacgatgatgttttggaaaagattgaccgtttggctgcttatgcgcctttgcacaacccagctaacgctatgggaatccgtgtcttccaaaagttgttgcctaacgcaacttcagttgctgtgttcgacacagcgttccaccaaacaatgccacgcaagaactacttgtacggtttgccatatgagtactacacgaagtacggtgctcgtaagtacggtgcccacggaacatcacaccgttacgtggctgcccgcacggcagaaattttgaacaagcctcttgaagacttgaagattatcacgcttcacttgggagctggtgcttcaattacggccatcaagaatggtaattcatacgacacgtcaatgggattcacgccattggctggtgttatgatggcaactcgttcaggtgatgtagacccatctttggtttactacatccaagagcgtgagggtttgacgaacgatgaaatgttgaacatcttgaacaagaagtcaggtttgcttggtgtctcaacgttgtcagctgacatgcgtgacttgaaggctgttcgtgagacaaacgaacacgctgaattggctatccaaatgttcgttgatcgtgttgttcgttacatcggtcaatactacatggagcttgaaggtattgatgcaatcgtctttactgctggtatcggtgaaaatgccgatgacttgcgttcagaaatcatcagccgtttgaacttcatgggtattaagatgaatgaagaacaaaacaagcaacgtgatgatgaaatgattatttctactgatgattcagccgttaaggtgttgaaggttgcaaccgatgaagaaattatgattgcacgcgacgttgaattgttgaagaataacaagtaaacaaatgaaacgatacaaaagttacgtatgaggaatcgtacgtaactttttttatttatcggcgttggctgcgacaatcacaaaggaactttaaaacgttactggcataattaggggtatttgcctaagtttggtaaaataaagtgtacgaatttatactttttgaacatagagtctaacgaaaggaaatatttaaatgtatgcacaagtgattgttgatgtgccaacgatgcaaacgaatcaaccgtacacgtatgctgtcccagaagcattgaccgaggtcttagccgtggggatgcgcgtggttgtaccgtttggtcgtggtaatcgtttgattcaagggtttgtagttggctttgttacggctgttaaagaagcaactgagttgaaggcaattgaaagtgttgtcgaacttgaaccagttttaaacgaagaattacttgatttaggccagtggttggctgaaaccaattttgcatttcgcatcagtgtcttgcaaaccatgttaccaaacgtcatgcgtgctaagtactcaaagaccttccagttagttgcgccaaatggcctagctaacgagccggatgtgcaagtgctgtttgctgatcgctcagagataccgttcaacgaaacggaaatcgcgccagaattattgccgaaattacaacgtttgcaacgagcgggtgttttacaagtcgggtacgtggttgataatcgagcgaccgccaaaactgttttggcgatgaagccactattgtcagccagtgagtatgatgacttacgtcaaaatttgcggaagacagcggttaaacaagcccgttttttgacttatttgatgacagcgcctcaggaatttgtcccaataaaaacggtattggatagccagggattggactatccaacgatcaaaaaagctgctgaacaaggttggattgaacgggcggagattgaagagtatcggttgccacgattgagcagtccgattgaaccaacatcaccattgacgttgaatccagaacaggaaacagcttataccgcaattgcggctagtttaggtgaggcccagacgaagacgttcttgctcgaagggattacggggtctggtaaaacagaagtgtatttgcaagcgattgcgcggaccctgcaacagggaaagacggcaattatgctggtaccggaaataacgttaacaccgcaaatggtgcgtcgcgtcaaaggccggtttggggatgatgttgctgttatgcattcaggcttgtccgaaggtgaacgttatgatgaatggcgtcgcgttgaacggcacgaggttaatgttgtggttggggcgcggtcagctattttcgcacccttggaaaacattggcctaattgtaattgatgaggagcacgaggcgacctacaagcaggatgaaaatccacgttaccacgcccgtgacgttgcacaatggcgggcagaacgacatggggcaacccttgtgttgggatcagccaccccgtcacttgaaagtcgtgcccgtgcacaacggggcgtgtatacgctattaacattgacagagcgtgcgctgcataatccactgcctaaagcagaagtcgttgatatgcgtgaagcgatgaaggcgggaggtgatgatattttctcaccacagatgcttgatcaattgcgtgaccgacttgataagaatgagcagagtgtcttgatgcttaaccggcgtgggtacgctaattttatgatgtgtcgcaattgtggttacgtgccacgttgcgtgaactgtgacttggcgatgacggttcacaaagacacgggacggttggagtgccactactgcggctatagcgaacctattccaacaacttgtgcaaactgtggttctgaccgcattcgcccttatggaacggggacgcaaaaggttgaagaagagttacaacgtatgatgccggatgcgcgcattattcgtatggatgttgatacgactcgtcgtaaaggagcaacggacaagatgttggcagattttggcgacaaaaaagctgatatcttgctgggaacgcagatgattgcgaagggacttgattttccagatgtcacgttggtgggtgtactgaatgccgatacaaccttgggcctaccggattatcgcgcctctgaacgaacgttccagttgctaacgcaggtggctggtcgtgccggtcgtgctgataaagaaggggaagtggtgattcagaccttcaatccagatcactacgctattcaattagcgaaaacccaggattacgaagcattttaccggcaagaaatgaacttgcgccacacatggcaatatgccccatattattacacggttcagattaaaatcgcgcatgaacgccaggatgaggctgctaaagttgcgtatcaaaccgctaactggttgaagaagcatcttgcgtctgattctgtgttgttgggaccgtcaacgggtgcgattactcgtttgaaaaacaagtactattatcgaatggtcattaaatttaagcacgatgatggtttggaagcagcgttaacagagctagtttcagccggtcaacgtttgcaaaagcaaggggttgtgctgacaattgatcgtgacccagtcaactttatttaaactaacggtcgctagcgatagcgaccatacataggcaaaaaagaggagcaggaacatgacaacgaaaattgtatttatgggaacaccgaatttttcagtaccaattttgaatgcgttgattgccgacgataactatgatgtcttggcggttatgacacagcctgaccggccggttggtcgtaagcgtgtattgacgccaacaccggttaaggaagcggcagttgctgcaggtattcgcgtgttgcaaccagaaaagttatctggttcagaagaaatggccgaggttattgcgatggcgccggatttgttgattacggcagcctatgggcagttcttgccaaccaagttgttgcaagcagcgcaaattgcagccatcaatgtgcacgcgtcattgctaccaaagtaccgaggtggcgcaccaattcactacgctgtcttgaatggtgatgctgaaacaggtgtctcaattatgtatatgattaaggccatggacgccggcgatgttatttcgcgggcgacgttgccgattttggatgatgataatacaggaacgttgttcgataagttaagcctgttgggacgtgatttgttgttgcaaacgttgccagacttaattgctgggaacgtgacgcctgagccacagaatgaggatgatgtcacgttctcaccaaacattacgccagaacaagaggtgttagactttacccgttctgcgcgtgagattcataatcacgtgcgtggcttgtatccattcccaatcgcgcacacgacgattaacggggtccggacaaagattcagcaaacacacttggttgatgaaacgaccgatgcgcccgccggaacagttgttaaaaagggcaagcatgatttgtggttggcagctggtgatggtcacattattgcgattgatgagttacaaccggcgggtaagcctaagatggccgtgacggcatacttgaatgggcacgctaagtttgaagaaggagagatggtgattaccgatgagcaagggaactagcaataaggtcgctgaatgggaattacataatgcgcgtgccatggcagtccgcacgttggaaaaaattcgcaatggcgcgtactcaaatttgcaattaaataatacggtcaagcaagcggaattagatgagcgcgatgtgcacttgatgaccacgatggtttacggggtaattcagcgccggatgacgttggaatactggttgacaccattcgtgaaaaagcctgaaaagttggacgcctgggtacgtgagttgctatacatctcacttttccaaatgaagttcttggacaaggttccgacacacgcaatctttgatgaggcaatcaatatcgctaagcgtcgtggtcacgatggcgtccgcaagttcgtgacaggtgtcctacacgcaatcgatcgtgaaggtgtccgctcatttgatgaaattactgataaggttgaacgattgtcaatcgaggcatcattgccagagtggttgattaatcaattaacgacggaattaggttgggaaaaggcatcacgtattgcaatggcgattaacgatgcgccagcccaatccgcccgggttaatttggctgtcacaacagtcgctgaagccacggacattttggaggcagaaggctttacggttacgccgtctaaggttacgccagatgccttgttgttgtcgggcggtcacgttgcaagctcacaagcatttaaagatggcttggttaccttacaagatgaatcagccatgctgatggcgccaagtttggatatccatcctgacatgcaagtgcttgatgctgccgctgcacctggtggtaagacgacgcaaattgcgacatacttgaacgcaactgaaggtggtattgtcgaggctttagatattcatgatcataaggttggcttgattaatcagaacgcagaacgccttcatgtggccgaccgtgttcatgcgcgcacattggatgcccgtaaggtagatgaagcctttgcggatgaacaatttgatcgcattttggttgatgcgccttgttcaggatttggtttgctacgtcgtaagcctgaaattcgctatgacaaaacaatggcagatagtttaagcttgcagaagattcaattaggtatcctggaagcggccgcacctaagttgaaggctggaggacgcatggtctatggtacttgcacgattctgcaatcagaaaacgaagatgtggttgatcaattcttggctgaacaccctgactttgagttggtaccaacgtacacggcgtatgatcttgaggcacaagatgatcgcgggatggtgcacatgttcccagatgatttcgagtcagatggtttctttattgcaacgttgcaaaagaaagcttaaaaatcagacggtaacaactgaaaggaaggcaaccttatgaaaattgcgtatgcgtccgatactggacgtgttcgtgccgacaatcaggattacgtgggtgtttttattaaccaaacaggggcgcaattagcgattgtcgcagacggtgttggtggtgaaaacggtggagatgttgcggcgacaatggcggtttcacatattggtaatgaatggcaacaaactgatgttcacgatatttgggcggccaaagattggatgctccagcaaacggcacaagagaatgaaacaattttaaaaaaagctaatcgttaccggacactgcgtggtatggcgacaacactggttgtggccgttatcttggctgaacaagttgtgattgcgaatttaggtgactcacgtgcctacttaattcgtgatgacgaaatgcgacaactcacggttgatcacaatttagctagcgaactattgcaacgtggtgccattacagccgatgaggcagttgcacacccggggcgtcatgtgattacacgacaattgggtgtgactgaagaagcgaatccggatgtatttgaatttgcaactcggccaggtgatttattagtattaacaacagatggcatgccgaaacacgtctcggatgccaaagtattggcaacaattttagcatctgataatttgacagatgcggtggcgtcacttattgcccaaacgaatgacgcgggtgggtctgataatgtgactgttctaattggccaacaagaaagtgaggatcgctaaatgcagattaatcaactaattggcgatcgttaccgcattattgaaccactgggtgaaggtggtatggccaatgtttatcgggcacacgatattattttggatcgggatgtgtcattgaagttaatgcgcttagatatgcgtgataacgagtcagtgcgcagacggtttgaaaatgaaattgcggcaacgtcggcattaattcacccgaatatcattcaagtttatgactatggtgaagatggcgggtcgcaatatttggtgagtgaatacgtttccggtatggatttgaagcgatatattgctgaacgacaaccaattccagtgacacgtgtcatcgacattatgagtgaaattctggcaggggttggtgaagcgcacaaggctggcattgtccaccgagatttaaagccgcaaaatattttgattaatcaaaatggtgaggctaaaattactgatttcgggattgcacgtgcgcaaacgtcatttggtatgacgcaaacgaacacagcgattggttcggttcactacatggcgccagagcaagttaagggtgaggtagcaactgtccgcagtgacatttattcattgggggttatgctgtttgagatgctgactgggcatgtgccatttgatggggaaacagcggttgccgttgcggttaagcatacgcaagagccgatgccgtcaatccgggatatcgatccacgcatgccacaagcgcttgaaaatgttattttgaaagcgacagcaaaaaatccgatgagtcggtatgcctcggcgcatgagatggcagctgatttggcaaccgcattatcacccaatcgggtcaatgaagcgcggtgggaagatccgaatgaagccgttgatgatacagtgacaaaggttattccattggcgccgattcatgagatggcaagtacggaagctgctagtgaggcggcgccgtcatcagcggttacagctgagccaacggctgtaacccccgataatcctaaatcgaagtggcggtggatctgggtaaccttgggcattgtcgcagccttagtgattgggttaggtgtctacggggcaacgcgaccagcattggtgcgggtgccagatgttagtggaatgacgcaagccaatgcatcacaggctttggaacgtcttaaattggaagttggagatgtgacaacgaccagctcgagcgcgattgaccgtggtaaggtggttcgaacaacgccagcccgtggcaaaagtatcaaggcaggtgccgaagttgacctgattgtgtccaaggggcctgcaaaagtccgcttcggcgattacgtcaacgagaagtatacgacggtggctgacaagttgaaggcgaagggctttacggttgaacagactgaaaccgctaatagttcaattccggcgggatatattatttcgcagaatctagatgctgaagaccgggttattccaggcgagacaacagttcgctttaaggtgtcgactggaccaaaacgctatgcggtacctgattttagtggcaaggaccgctcagaagtggcttcctgggctgctgaaaacggtatttccgtgacgtacaattcagtgtattcagatagcattgcggtagatgaagtggtatcacaatcgattacgccgggatcaaaaattacgacgaacgatatgctgatggtcaccctatcaaagggtgaaaatcctgaagcaaaggctgctagcgaagcagcccgtgaatcaagtgtctctgcatcgatagcggagtcgcaatcaattgccgattctgaagcagcctcattgtctgcaaaggaatcatctaaagctgcctcagaggccgcaaaagaagctgccaaggacacctctaatacgccagcctcatctgttgacggtgacgatagtgtaccaagcagctctacgagtacgtcagcaagtagctcaagcaacaaatcatcagcgacaagtagcaagagtagctcaaattaaataggagaaaatatggcagattatcatggacaaattcaattagccttggctggcttttatgatgtcctgactgacgagggtgaactttttcgaactcgtgcacgtggtaatttccgcaagcgcgatatgaagcccctcgttggtgattgggtaacgttcagtgccgagaccaaggatgaaggttatatcttggatatcgatgaacgtgaaaacagtttagtacggccaccagttgcaaacgttgatcaagcaattgtggtgacggcggtcaaaatgcccgattggtcaagcaatttgcttgatcgtcaattggttgcgttggaagagaaagacattgaaccggtcatttacttcacaaaaacggatttgttaaacgccacagaaatggctgacatgattaaagttgcagacgggtaccgtgcggctggttaccaagtgattttgccagcggttgcgtttgatgaaccaagtttgctggcagtgaaggacttgttagctgataaattatcggtcgtgatgggacaaactggggctggaaaaagcaccctgttgaatcatttggccccagagctagatttagccactggtgaggtgtcgcaagctttgagccgtggtcgccacacaacccgccaggttgggcttgtgcaactgtttggtggctttgtcgcggatacgccaggattctcagcttttgaagtctttgacatggaagcgcgtgatttaacacattacttccgtgaatttaatgccttagcccctaactgccgcttccgtgggtgcgtgcacttaaacgagccaggttgcgctgtgaaggatgctttggaagccggtacaatcatgcaatctcgttatgataactacaagctattttacgatttgattgaaggccgacgcccggtttataataaacatgacaagaaacactaatttttgagattagacaaaagaggtttagacatgacgattaaggtagcaccttcaattttgtctgcagattacatcaacttgcaaaaggatattgagttgattgaagctgcaggtgcggaatttgttcacatcgacgtgatggatgggatgtttgtgccatctatctcatacggtccagcttgggtaaaagccttgcgcccagtgaccaacatggttttggatgttcacttgatggtagaacaaccagaacgttacattgacgtatttgcagaggctggttcagacattattggtgtccactatgaggccacgccacacattcaccgtgctttgcaacaaattaagaaccacggtattaaggctgaggttgttattaaccctggtacttcagttgcggcaattgagccggttttgcacatggttgatcaagttttggtcatgacggttaaccctggtttcggtggtcaaaagttcttgccagagacgttggagaagattgcccgtttggctgaaattaagcgtgaaaagggctacgacttcgatattgaaatcgatggtggtgctaatgatgagacgaccaagttagcttatgaagccggtgcaaccgttgcagttgctggttcatatgtctttgacaaggttgacccagcggctaagattgcgcgtttgaaggaagtaacgtcagactaatgaaacggatgcgtgtgttagtcgggggcccgctatctgagtggccggatgcgttgcacgcaggtcagttagacggcccatgggcagcggctgaccgaggcgcattacgattattagccatgaatcaagtgccactactaacagtgggcgactttgattcgatgacagcaactgaacgtcaaatgaccttggccaagttgccacgggtcgtgagtgcacagcctgaaaaggatgagacggacacagagctgttactatcactgattgaacaggactatcagccggaccgcattgaaatatatggggccactggtggccggattgatcagttactgtcaaatatttggatttttacgcaaccacgttttcaaacgctagccaccaaaattgtgctcattgatcggacaaatgaaatttcgttttatctgccaggcaagcacacaattacgcatacaccggggatgacctatctaggatttatgccactgacaccagtcacggggctaacgttagttgatgaaaaatatcgtttgacggattggtcagggaaccccttttcattctcgtcaaacgaatttgcgggtgaggtgaatcatttcgaatttacttcaggcatggttgccgtgattcaaagtcgtgacttaaatgggcagacaagcgactaagtcgggggtttgccaaaatatcatcttgtgatattcgtgtaaagtaaaaatactttacacaaaacccttgcacaactggtaagggtttgatattattgttcaagtaaataaaagcactgaattaaagagcttaagattggagggtaaacatatggcagttgatgcagtcaacggaaagcgtactcgcttcggtaaccaacgttcacacgcccttaactcaagccgtcgtagctggaagccaaacttgcaaaaggtgacggttaagattaacggttcagcacctaagaaggtgtacttgtcagctcgtactttgaaggctggtttgaagaacggttcaattgagcgtgtttaatagataaagctaccgtctacggtggcttttttcttttttacgggacttgttgaaaagtaaacaagttcttcaaaaaaactgtttctggcctatcctatggtaaaatagaaatagttttatacggaggtcatacagatggcagttaagattcaaacaacgcaaggtgcgattgagatcgaaaatgatgtcattgcgacgattgttgggggtgcagctactgataactatggtgttgttggtatggccagccaaaacccacttcgcgatggggtcaaccaaattttgaatggcgataacttcgctaagggagttgtcgttcgccaacaagagaatggtgtggcagttgatgttcacattattgtcgggtatggtatgaagatttctgaaatttcaaagagcgtgcaagcgcgtgtaaaaaacgatttgaatgtcatgcttggtatcgtggctagtgaagtaaatgtgacggtacaaggtgtgcgcatgctaggcgactaaaacctagttataaggagttgagaactgtggaagttgtaacgacgattaccaacgtcgagtttggtaagatgatcaacgcggcagccgatgcgctgaagaataacgcggaaaagattaataaattaaatgtgttcccagtacctgatggtgatacgggaacaaacatgacgttgtcaatggccagtggtgccgagtacgaacgtaatgaaacggatacccacttgggtgctttggcgcaagcaacgtcgaagggcttgttgatgggtgctcgtggtaactcaggtgttatcttgtctcaaattttccgcggttttgccggaaaaattgctgataaggaaactttgacagcccgtgatttggctgacgccttgatgggcggtgctgagacagcttataaggccgttatgaagccaaccgaaggaactatcctaactgttatccgtgaagccgctgcggccgctaatcggacggctaaggagtctgatgatgcagttgttgtgatgaaggcaacgttggatgcagcggaaaaggctttggcatcaacacctgacttattgcccgttttgaaagaagtgggggttgttgattcaggtggacagggtcttgtaattgttttggaagccttctacacagttttgtctggtgaagaagtgacgactgaaattgataatgcggctttggatgccatggtaatggctttgcacaatgccggtgtacaaggtgatttgaaccctgaagatatcacttatggttactgcacggaaatcatggtggatatcgccaagggaacgacctatgatcaagaatttgattatgatacgttctaccaacacctagctgaaatgggtgactcattgttggttatcaacgatgacgaagttgttaaggtgcacgtgcacactgaagaccctggtgaagtgattaactggggaacgcacttcggttcattgcgtaaggttaaggttgataacatgcgtgaccaacaagctgaggcggctgccgcagctgaagcccaacgtgaagctgatgctgcagcagcggctgaaaagcctgctgtagatttggcagttatcacaacggcggctggtgcaggaattaaggaattgtttgcttcttcaggagcaacggttgtgattgattctgagcaagcaccttcaacgcaagacttggttaatgcggttaaggatagcggtgcgaaggaagcgttgattttgccaaacgatagcaatatctttatggcagcagatcaagcagttgaaatcgcagacgtgccagttaaggttgttcgtacgcgtacgattcaacaaggtttgacggcgttggttttgggctacaacccagaaggaacgcttgacgacaatgctgaagcgatgacagcatccttgggtgatgttaagtctggtgccgtgacgacgtctgttcgtgacacgacgctgaatggtttggagattcatgctggtgatgcaattggtttgttcgatggtgaaatcgtcgtggcagtaccagatgctgatatccatcaagctgcggttgaattgctgggcaagatgattgacgacgattcagagcttgtgacggtttactacggtcaagaagcaactgaggatgacgcaaacaagcttgaagaagctggcttggtacttgatgaggatttggaatttgaaatccacgatggtggccaaccactttacccaatcttgatgtcagttgaataatttaatgtaaatatgaaaaacgccaacacgttcgctagttcgaatgtgttggcgtttttttgcacaaaaatcacacctatccccaaatgagggcttattcgagcataaaaatgagtaaatggttaaaatttaagcaaaagcacaaatagttcgtcggaaaatgttgggggattaatcgtaacgttgccgtggattgggtgcattttatcgatacaatgcagaagatggccagagtatgcattttggttgtacgtaacggggaaacacagagaagtagactggaagtgaggataaaagtctatggcgatagaaaatacaacgtataaaaagaagaagaataagcaatggttgcggtatggcacaacctctttaattgtggcgatgggcttaggtgctggtgcaaccggccaagccatggcagcagaagacccaacgacgacggatattgatccaacatcaacgaaaacaggcgaagatgacagtcaaaatactgattcagataatcgagatgttgacggtgatggcctagatgatgaaacgggccaaccaataccaactaatccaagtgatccaacgatggttaacgatagtggtacgacgtcaagcccaactgaaggtgaagagacaaccgccgtggcagaaacgccggctgacccaattgttgtacctgctgaggagacggcaacggttgaatcgtcaactgacaatgtggttgagacgccaacagagacagtttcaacgacagtgacgccgacgacggtggttgcagaagcgccagttacagaagctgaatcggttgccgatagtgacactacgcttaccccatcgacagtttcagaggtggcggaatcagcgacgtcaacacctagtacagcgacgacaacagcaattaatgatgagaatcaaccagccgaaactgcagaagcaacagtcgattctgtgtcagattcggatgcggttcaaactgatgaggtactaccaactgaaacagtttcaaaccaagatgaaaatacggtgacgccgactgaatcgacaacgggtgacgtgactgatgaaacaacgggggatcaagatgaagcaaccagcgtcgacgttacgactgaagcgacggatacaacgcgtgaaacaaccccagtagcatcgaccgatagcgatgcttcgtcgaccgatgcagggcaggcaactagtgaagcgtcttcagaggccacgtcagttgccacagggtcatctgagacggccagtgatcaaaatgcgactgtattaggagaaacgaacgccccaacggcgactgttttaggtgatgaaccagaagcaacgaccacggcgccagcgggtgtgaccgtgtcaattgacacgccgattacggtgcctaacaaggaaagttttacaggcgcagattatggcttgagtagtacggtcacagttacgtatgccgacaagtatttgtggattaatttaccagctgtttataatttgaacagtattgatatggatgccctgaaagcctatgctgtgcgtaacagaatggtgatttcattcctgcaagctggtgaacaagcgaaagacaccacgacgggattaactgaggcgcagcaagcgacgtttgacatgtttaacaaagatgcgttcaatttgctacctgcaactgaagtgatgaatgataacggtacggtgattgtctattggcccgattcaaccgaggctagtgcaacgtttgattcagttgatcacgatgacatccgggtgtgggctgaaacaaacggcttggattgggcggttgcttctgaagcatggcgtcgtacgcagggacagactttaccagccggagattcagtcgcaaatagttcaaacttgccaacatatttccaaaaagatacgaatttgttgacgttctattactatgcaggtggtttcaccgatacgacaggaacgaagtggttagttggtgtggcacgaaacgttactagtgatccgtggagccaaaaggtcgtttctggaagtactgtgatgttgacgagctataacgatagcgggattacgggtcgtcagtatgttgccagcggtggtacgttgattgttgggggaacaacatttaaaaacaatataaccaatggtactggtgactacgaggttacgagtggtcgaagagatgggtcaacaacaaacacgaattggcgaatgaccggtatcaatgtctttgcaaaggcagcggatgcaaactattactatgccattgataacggcgatgggacatatacgcgtacgacagatcgtattccggaaaatccaagtgcaggcgaaggggcagatgccaaggttaaccaattgattggtggaactggtggcggttatgatgatgaatttaccatcacatcagatgtcctacctggctaccaactggtaccatcattaacacaagtatcatcgcaaaaaagtacaacaacgagtggcagtgggacgaatacgaagcagacggttacgggtgcgtttaccaacatgagtacggatgtctatacgattgctgattcgcgttctaagtcagccattatggacccgaataatccattcaatttggcactggtccgggcctatggatttgacgtatctgcagtgccaaaagatgcagttattcgtaaatttaccaaccaaactaatccagctaattacacggtaatcatttattggccggcggtggatgccaaaggtaatgtcacgtcaatgacccaaattacgtggagtgggaacacaaatgtcatcacatttacgatgcagacggccggtgcaacgaccgtctcacctaatttggtgaatacgtacaccattcctgataaaccgttgacgttctatttggcgacaaacgcggcaactggggcaacaagtgttgtggcagcaacatcgcagccaactacgagtgggatgtcgtacgctaaaatcaccggtgatttgtacaagacaagtgatggtaagtacacattgtcagctacagacgcttttggcaatgcgaacgcagttatttcaacaccagattgggccgatgaagatcgaaatggttcgattgacggcggtagtttcttaggatttggtggtacgggacttggtaatttgggcggttatattcaaccgttgctgcctagtgaatcaggcgttaaattttactatgtcgcggcgccacaattggccacagttggtctccaaactgcggtgcaaaatgccgatggaacgttctcgttagctaattcaacagcgattgccaatacggctggtatctcaaattataataatgcgactgccggtcaaactaattcagccctacaaggtttgaccggtggacagattggtgtgaaaacgacggcatcgccaaataacgattggagcaaaataaatacaaacgtgccagggtatacatacgtcggatttaccctgaacggtggtgctttacagtcggccaagaagaccgatggtacttatgctttgccaagtgaaagtgcggcaacaaagtacaatgccacggcgggtacatcaaaaagcggtacggcattgaccgattctgctgctgatgcgattgtcctgtactatgtgaaggacacgcagcaggcgcaaattaagtttgtgatggcggatggtacaacagcgccggctaatgttaatctgacaggtaaaacaggtgaatcattatcaagcgatattgcaagtagtattcctgctggttaccatatcgacacaacaaaaacgacgactaccggttcgccggcaatgacactttctggtacaactgtttcgggaacgtatgatacgacgaacaacagtttgagtgcgacagatagcagtttgcagacgatgacaattaccttagtcgcggacacacaaacggttaaggtacgttatatcgacgtcaacgggtcaaccaaggaaacgggttggacagcggccgatggtactgaaatcacggattgggtgcaacccgttaacggtgcgacaggtaagacctatacaaatgcgctcgggtctgtttcacaaagtggatatgtcattgtggcgcaagatgccggagcaacggcaggaacatttgataatgatacagccacggatcaaacttactatgtttacttgaagcacaacaccgtagatgtagaaggtggtaaggaaggcaatgcgcgctggacggttaggtcaacagtgcgttatcgctttgaggatggtaccaatgccgcgagcgctaatgtacgcacgacggaattcttggccactgttacgtatgatgccgtaaccggtgaggaactggcggttacgtgggagacggagacgtacacgtttgatgacgtagagtcaccggttattcaggggtatattgcggacaaactagaggccggggcggcaaccgtcacctacacatccgcaggaattgcggcaattgtgacgtataaggcattaggagcttggacgccaagcttcccagatacgacaccagataatccaccatcagatattacgtatcccaatgatcctaacgatccaacgcaacctgatcggtcaaatccatcggtgccggttgtaccatatgtgccaggttatacaccagaaggaccaaatggaccactgacgccagtcaatccaaatgacccaagcggtggttatttgccaccagatgtgccaacggatccaacggctgatacaaccattgtttatcatgccaacgaacagacggtgacagttaactatatttatgtcgctgacgacggaactcgtacaacggttaagacagaatcattcacgggtaaatcaaatgcggcttatacgcatgaattgtgggattacgaaaataatccagaccaatcatatgtgctggtgtctaaagatgctggtgctgagaacggtgtatttgatgctgacgatgacgagacgcaagtctttaatgttattttggcaattggaactgaatctgtcccaggtggtaaggacgatgatccaaaccaaagcgattatacgaagacagtgacgcgcacgattcattacgtcgaccaagctggtaaccagatggtcgatgcaaacggagagcccgtgccagatcgcattatgaggcatacattcactgcaacagtgacctataaggttgactcaaatgtaccggtttcggttgaatggccaaatgatgcggccacgtttgaagcggttaagagtccggtcattacagggtatgtagcagatgtgacgcaagtcgatgcggatactatcgaccacactgatacagacacgacgtatacggtcacctacaagccaatgggaagctggacgccaagtttcccaccgaataccgaaaatgtgccgagtgatccaattcaatatccaaacgatccgaataatccaacggacaatgaaacgccacacgaccccgctgaaccagatgatccagtgattccatatgtagcgggttacacgccggcagggccagatggcacgccactaaagccggttgatccagaaaatccatcagctggttatattccaccagcaccgacagatccaactggcgatacgacgattaattacacgcggaatacacaacaaattattgttcggtatatcgatgacacaaccaacttggaagtgcctgatttacggcaaacattctcaggagagactgaccaggcgtatacaaacacactcgctgattatgcagcccttggttatacatttgtttccgccgatgctggggcgtccgccggaacgtatgatcgtgatgattcaaagacccaggtttacttggttcacttgacgcacggtacggtggttgttgatgggggtcgtgagaacgatccgaaccacgatagttatacatcaacggtgacttcaacagtgcattacgtttatgaaacagatcaaaccgaagctaagcctgatagcgtacaggaaaagaattttacggcctcggttacctatgacgcagtcactggtgaagtgctgtccattgtatggccagctgagtcgcaaaactttgacgatgtgcaaacgccagtgattgatggttattttgctagtgaaggttcagttgctggtgacgctgtggactataacgatgccaatcgtgaagaaactgttaccttcacgaagctgggttcttggattccacacgttcctgatttacctgaagaggagcagttgaagacgcgtgtctatccaaatgacccaaatgacgcatcaaaggtttggacgcgtgatgatccaaactatgttgaagtgccggtaccatatattccagggtatacaccaacgactgatggtagctccattccattggagcaaattgatccaaatgatgtgacaaagggttactacccaccaactgtgccggataacgcagctgcagacacgccgatttattacgtggcgcatccccaaacgctggtggttgtgtacgtcgatatttcaacaggcgctgaagtcgaagtgactgaactccaacaaacgttaaccggtacaacgaacgcagcctatacaaataccttgtcagattatgctgcgcgaggttacgttttagttaatcaagatgcaacagcaactgaagggaagtatgataacgcggataacgtgacgcaatttgccaaggtttacctggaccacgggacggttgtcgtaacgccggacaacccaggtgaccccggtagcccaatgtatccagatgtgccagatacgcccacttggccagtagggacggatattgatggcgttaagcaaacggttaatggcgttattagttatcagtatgctaacggggatgaagtctttccagatgtcacacgtacagtgacgtttgaacggtcaattacactggatgcggtaactggcgagcaaatttcaacgacggactgggtggtgacggctggtgatgatgactggccagagacgccgagtccagtgaaagaaggttactatgctgatatctcagatatttcagccgtaacgattgcaccagacgatttcgatcggagttacatggtgacgtactacccaatgggacagtacgtaccggtattccctgaaggtactgaaaatgtgccaagtgatccaattacgtacccaaatgacccagataatccgggtaatcctttggaaccgggtcaaggaacgccagatacgccaggtgacacagataatccaacggtgccatatgtgcctggctttacgccacaaggtccagatggcacgcctttggagccagttgacccagacaatccaagtgcgggttactggccaccgaaaacgccaaccgataatccgggtggcgacacgacaattacctacacagcgaatgagcaaaaggcgaccgtgacgttcattgacgatacgacgggtgatacgctgcaagttgttgatttgacgggtaagtcggacaaaacggatgcctatcgtacagcaactgacattgcgacgtacgaacgtgccggatatgtccttgtgagtgatgattatccaatggatggtgtggtttatgaccgtgttgatgatgaagaccaaccgttcacagtgcacttgaagcaagtcacgattacggttgagccgaatgatccaaaggactcgggaacagatatctttacgccaggtgacccagttgatccgagtgacccaagcagtccaacatatccagaaagcccatacacgccaggtgaccccgtttatccggatcagccagatggaccgacggtacctgatacaccaggcgacccagggacaccggttgatcccgataatccaagtggtccgacatggccagcaacgccaacgtacccaagtggtgtcaccaaggatgatttgaaccagacagttacgcgtacgattacgtacacgtatgcaagtaatggcgaaaaggcatctgaaacggttactgaaacgttgacgtacagtcgtacagcgacagttaatgcggtgactggggcggtgacgtatggtaattggcagacgactgattcaacccttgataaggttgattcgccgttgatttcgggttacgtggctagtcaactactggttgacgaagagacaaacgttgacgcgatggccgacgataaaactgttgcaatcacgtataccaagcttggtcaatgggtaccatcgttcccaccatcagccgatgatgagaatgtgccaagtgatccaattgattatccaaacaacccaagtgacccaacggcgccgctagagccgggtgaggacaatccaaacgatccaggtacgccggccaacccaacgttgccatatgtgtcaggttatacaccggaaggaccagatgggacgccgttgacgcctgttgatccagataatccaagtgcgggttactggccaccagagacaccagcggataagccgggtgataacacggttattcactatgttgccaacgatcaagcagctcggattacgtatattgatgatgacacaggccttgaattggcagttgatacgattgctggtgaatcaagcgatacatcaacgtatacaacagctgaccgcattaagtcttacgaagcacaaggatacacgttggtttcaaatgacttcccagaggatgagtttcaattcgatcgtgatgacgcaacggaacaaaagttcgaggtgcatttgaagcgcacggttttggtgattacaccagatgacccacgcacgccaaatgacccaatctttacgccaggtgagccggtggacccaagtgatccatcaagcccaacgtatccagctgaaccaggtacgccaggtgagccaattgatccggcaaacccaagtggcccaacttggccggagacaccaacatacccagcgggattgacggctgaagatttgaatcaaacggttaacttgacggttaactatgtttacgaagatggtacgacggttgctcacgacccacacacggatgcggtgcactttacgcgcacggcaacgctagacacagtgacgggtgaggtgacgtattcagattgggtagcggttgatgatgacgatttgttggatacctataagtcgccagttgttgatggttactatgctgacaaggcatacagtaccgcggtgacagttgcagcgacagacgatgatgtgactgagactgtgacgtacaagaagatgggacaatgggtgccatcattcccagcgacgacgccaagtgcaccgacggatccaattgattatccaaatgatccaagtgatccaacggtaccaacggatccggctgagaatccaagcgaaccaggtacgccagagaacccaacgttaccttacgtgccaggttacacgccagaagggccagatggtgagccgttaacaccggctgatccaagcaacccatcgtcaggctacttgccaccaaacccaactaatccgggtgatgatacggtgattacctacgtaccagctgatcaagttggttcggtaacgtatgttgatcagacaacaggtgaaacgctagtggttgattcactggctggtaagtcagatgagccgggcacgtacgtaactgccgaccgcattaagcaatatgaggcgatgggatatgttctggtatcggatgactatccaactgactttatgttcgacagtgatacggccaagtcacaagacttcacggtcacgttaaagcaagcaacggtggttgtgacgccggatgatccaaagaatcctagtgacccaatctttacgccaggtaatccggtggacccaagtgatccatcaagcccaacgtatcctgaggaacctggtacgccaggtgatccgattgatccaaataatccaagcggaccaacgtggccagcgacgccaacgtatccagctggggtgacggcacaagatttgaacaagacggtcacacggacagtgacgtatgtttatgaggatggttctgaagctgcgacaacagtgacggacaatgttgtctttgaacggacggccacggttaacgccgtgacgggagcggtcacatatggcgagtggacggcagttggcgatgacgtcgattggcagcaagttgattcgccaatgattgtcggctacatggcagacaaggcgtcggttgaatttgtggacgtcactggtgcaactgagtcaacatcagtggttgtgacgtatacagcggttggacaatgggtgccacatttcccaccgggaaccgagaatgtcccaagtgacccaatcaactatccaaacaacccggatgacccaacgaatccagcggatcctggtccggataatccggccgatcctggcacgaccgacaatccaaccttgccatacgtgcctggctttacgccacaaggaccggatggtcagccgttggagccggttaacccaagcaatccaagcgaaggatactggccaccggttattccggatgatcctaagcagagccaagatattacctatacagctaatgaacaaactgcgcgaattgtcttcattgatgatacaaccggcacgacactggcaactgacgatatcgatggtgtctcggatgagaagtcgacgtatacgacggcggaccgtttggctgcttaatacgcccaaggttacacgttggtcagtgatgactatccagccgactttgcgtttgaccgtgtcgatggcaacgttgaaacgttcgaggttcacttgaagcacgctgcgattaccgtgacgccagatgatccaaagaacccatcaacgccaatttacacaccgggtgacccggttgatccaagtgacccagagagtccaacgtatccagcggaaccaggtacgcctggagacccaattgatccggataatccaagtgggccaacttggccagcggtgccaacgtacccagatggcgtgacgacgaccgacttgaacgagacagttaaccgcacgattacgtatgttgacgacaagggcgaaacggtctttgcagaggcaacggacaaggttagcttcacacgcacggcgacagttgatgcggtgacgggtgaagtcacttacggtgcgtgggttgcaactggtggtgacacaacgtttgacgcagtgaactcaccagttaagactggttactatgccgataaggaagttgttgctgagaccactggtttgacggcaacgacgggggatgaaaccgtccaagttgtctacaagccaatgggacaatgggtaccgtcattcccagccggcactgaaaacgtgccatctgatccaacgacgtatccaaatgacccagctcatgctgatacgccacttgaaccaggtgattcaaatacgaatgtgccaggaacgccagataatccaacaatgccatatgtaccaggctttacgccacaaggtccagatggcacgccacttgaaccggtaacaccaggttcgccggaaggtggttattggccaccagcaacaccaaccgataacccaggtggtgatacggttgtgacttatgttgcggatgaacaaaaggcaacgattacgtaccacgatgtgacgactgatactgatttgtcggttgatacgattgctggtcattctgatgaaacaagttcatacaccacagcacaacgtattgcgatgtatgagcaacaaggttaccgtttggtcgctgatggttatccaggtacgaaattcacgttcgatcgtgatacggcaactgatcaagcgtacatcgtacaacttgagcgtattacgcaaacgattacgccagatgatccaaagacgccaagctcaccaatctttacgccgggtgatccggtggacccaagtgatccatcaagccctacgtatcctgaacaacctggtacgccaggtgaaccaattgatccagataatccaagtggcccaacttggccagccacgccgacttatccagccggtttgacgcatgatgatttgaatcaaacggttacgcgtgaagtcacttatgtatacgaccgtgatggttcagaagctgcgacaacagaaacggaaacgttgacgtttacgcgtacggcgacgcttgatacggttagtggcgagattacgtatggtgactggattgcggctgatagtgataccacctttgatgaggtgacatcaccaacgattgctggatacacggcaaaccgcgcgtcagttgcggaagcgaccggcgttgcggcaacagatgcagatacgtcgattgaagtgcgttacgttgcgaatgagcaacatgccacgattacgtatattgatgacaacacgcagcaaacgattgtcatggatgacattaccggacaatctgatggcacgacgacttacacgacggctgaccggattgcggcgttgcaagcgcaaggttacagcctggtgagtgatggttggccagctgacttcgtgttcgacacggatgatgatacgacgcaagccttcgaggttcacttgaagcacgcgacgatgacgattgacccagatgatccgaagacgccaagttcaccggtttacacgccaggtgacccggttgatccggatgacccagatggcccaacgtatccagctgaacctggtacgccaggtgagccaatcgatccaaacaatccaagtggcccaacttggccagcaacaccaacgtatcctgatggtttgaagacgactgatttgaatgaggggttgatcggacgattacctatgtttatgaggatggtagtgaggctgcaaagacagcgacggataacgtccagttcacgcgtacggctgagtatgacgtggtgacgggcacggtgacgtatggtgattgggttgcaacgaacggtgacacaacctttgatgcggttgcctcaccagtgattaccggctactatgcggatttgactcaagttgatgaaacggctggtttgacggcggatagtgcggatgaaaacgttaaggtcacgtataagcaaatgggacaatgggtaccatcgttcccagctaatacaccaagtgtgccaacggattcaatcacgtatccaaacgatccggatgatccaacgcaaccgcttgaaccgggtgcgccagattatccagtggtgccatacgtgccaggctttacgccagcaggaccggatggcccattgcaaccagttgatccgactgatccaagcaagggttatgtgccaccggcaacgccgacggacaaccctggtgaagacacgacgattaattatgttgccaatgagcaaatggccacgattacgtttatcgatgacacgacgaagacgaatttggcagtcgatacaatcacgggtgtttctgatgcaacatcaacatataccacggctgagcgcattcaagcatacttggctcaagggtacacgcttgtttctgatggttatccaactgacttcacgtttgaccgtgatgacagtcagacccaagcgtatgaagtgcacttgaagcacgcaacgattacgattacgccaagtgatccgaagacgccgagtcagccgatttacaacccaggtgatccggtcgatccgagtgacccagatagcccaacgtacccagaagaaccgggtaatccaggtgacccaattgatccagataacccaagtggtccaacttggccagcaacgcctacgtacccaattggtttgactcaaactgatttgaatgaatcagtgacgcaaactatcacgtacgtatacgccgacggccaagaggcaagtgaaccgaagacggacacggtaacgtttagtcgtacggcaacgcttgatccggtcacaggtgcggtaacgtatggtgagtgggttgtagcaaatagtgataccacatttgatgcggttgcctcaccggtgattacgggctatgttgcggacaagcagacggttgctgaagtgacgggtattcaggcgactgatgctgacactgacccagttgtgacttacacggcgatgggacaatgggtaccttcatatccagctggcacaactgatgtgccaacggatccgatgacgtatccaaatgacccagctgacccaacgcaaccagctgatccaacggcgccaaattatccggtcattccggatgtaccaggtttcacgccacaagggccagatggtccattgcaaccggttgatccaagtgacccaagtaagggttacgtgccaccagcaacgccaactgatccgacccaagatacgacgattacgtatgtggcgaatgagcagcaagcaacgattgcttacattgataagacaactggtaagcaattggcactggatccgattacgggccactctgatgagtcatcaacctacacgacggctgataagattgccgcgtacgaggcagccggttatgtcttggtttccgatggttatccaggtgtcaacttcaccttcgatcgtgaagatgattatgaccaaacgtatgaggtcattttggaacacgctgtcatcacagttgatccaaatgatccaaagacgccaagttcaccaatcttcacgccgggtggtccagttgatccggatgatccaacgagcccaacttatccagttaaccctggtgagacaccaacaccaacgtacccagccggtgtggaaacagctgatttgaatgagtctgtgacccaaaccatcacatacatgtatgcggacggtacaacggcagcggatgatgcgacagatacggtaacgttcagtcgtactgcgatagttgatgcggtaacgggcgaggtgacgtacggtgattggattgcaggcaatggtgatacgacctttgacgcggtgacgtcaccagtgattaccgggtatgttgcggataagcagacgattgctgaagtgacgggaattgccgctaaggatgcggacacaacaattacggttgtgtacaaccagatgggccaatgggtaccatcgttcccagcgggtacgaccgatgtaccaagtgatccgatgacgtatccaaatgacccaaatgatccaacggtgccactcacacctggaccggaaaatgaaaatgatccaggtgacccagctaatccaaccttgccgttcgtgccaggctttacgccacaaggaccagatggcccattgcaaccagttgatccagctaacccaagttcaggttactggccaccaactttgccaagtgacccaacgactgacacgacaatcacctacacggcggatgaacaagcagccacaattacgtatgttgatgcggtgacaaatgagatattaggtgtcgaccacattaaggggggctcggatgaatcgcatgcctacacaacggctaaccgattggcagcttacctggcgagcggttatgagttggtttcagatggctacccaacgaacttcacgtttgatcgtgatacggcggtcacgcaagcttacacggtaaccttaacgcacggttcacaaacgattaacccgaacgatccaaagacgccaggcacgccaattaatccggataaccctgatggaacaaagtatccagacggtttgaagtcaactgatttgaatgagtcagtgacgcggacgattacgtatgtggatcaagctggcaagacgatggcgacagcggttaaggaaaccattcactttacgcgcacggcgacccttgatacggtaaccggtgcatacacgtatagtgcgtgggagccaacgacggtaacgtcaatggatgccgttgattcgccggtaattgctggttatgtggctgatcgccaaacggtcgctgctttgagtgatttgacggcaacgtcagcggatatgtcagaaaaggtcgtgtacgcaccaattggtcagtacgtaccagcattcccaagtggtgtaacggatgtgccaagcacgccaattgattatccaaataaccccgatgatccaaccacaacggatacgccgggtgaggataatccagccacaccgggaacatctgataatccaacgatgccgtatgtacccggctttacgccgcaaggtccagatggtccgttgcaaccagtggatccaaacaacccaagtgcaggttactggccaccagcgccaagcgagacgccaactgaagacacgacgattacctacacggccaataagcaaacggcgacgattacgtatattgatgatgaaactggtcgcattttggcggttgatacgattacgggtggttcggcggaaacgagttcgtactcaccttataaccgcattatggtttacaagttggctggtatgatgttagtaagcaatgggtacccaagtcactttacgtttgatcgtgatgagtcagttgatcaggcctttgaagttcatttcgaaggcgcgacaatcacggttacaccagatgatccaaaggtaccaggtgagccaatttaccaaccaggtgatttgattgatccgaacgatcctgattcgccaacgttcccagatccacttggtgagccgggtacgccggtcgatccggatgatcccgattcaccaacttggccacagccgccagtttggccggatggcgtaacggcagcagatttgcgtgaagaagtgaaccaaacgattacgtatatttatgaaaaggatggttcaacagcggctaagacggttactgatcaggttgtcttcacacggacgattacgattaacgtcatcgctgcacagcagagtgcgcaaccacaagcccgtctggcacgtgctgccacggcgagtccgattgtttactctgattggcaggcagtgaacggcgatgataagtttgatgcgaagacctcgccagttattccaggctatatcgctgaccgattggtggtcgaagaagtagctgatatggatgaaaccagtgaagatgacatccagcaagttgtttatcgtcaacttggttcttgggtaccaagtgtgccacaagtacccggggttaagacaccggctgatgtgacgtatccaaatgatccggatgacccaacgaagacggctgatccaaattcaccaggttatccagtcatcccatatgtaccaggctttacgccacaaggtccagatgggacgccactacagccagttgacccaaaggatccaagccagggttactggccaccgactgtgccaaatgatccaacgactgatacaacgattgtttatcgggttgaccagcaacgtgcaacggttaacttcatcgatcaaaatacgaagcaggtgctgcacgtcgaacaattgaccggtgatagttatagcaagtcgacttatacgacgactgatcaaattgcgggttatctggcacgagggtatgtcctagtacgggatggttatccagcaggcggtatgacatttgatgccgattccgcccataaccaaacctttgtggtaacactagctcacggtacgacaacggttgatccaaatcaccctggcgtaccaggcacgccaatcgatccgaataatccgaccggtccaaagtggccggcaggtacggataaggccaacttgactgatgaagtggagcgcattgtacgttacttgaatgatgctgggcagactgttgcagaagcgcaaacgcaaactgttacgtttacacgaacggcaacagttgacctggtgaccggacaagtcacgtatggtccatggcaatcgattcagtcagctgagatggcagccattacgtcaccacgtctagcgggttacattgtcgatcgcccaacggttgcatcagcaacggttcaagctggtcaaggtgactgggtcgagacggttcgttatcacgcggttggctcatatgtaccacaggtgccaggaggcgtaccggttgattatgtcacgaatccaaatgacccaagcggtattctcacaccaggtgaacctggtagtccggttttgccacacgtaccaggttatgtcccagttggtccggatggtaagccattacaaccggtagatccaaatgatccgcgtcagggttattggccgcctgcggttgcagacccaactcaagatacgccaattacgtatgttcagattgtgactgaccaggtaacgccagatgatgcgacaccagcgccaagcgattcagcagttgctgtcgatcatcaagcaccagttagtgacgatgttgtgctagatagcgatgcagttttgccaactgctgaagttagcgcagccagtcaattgacaacgagtggtggatcattagcctacacagcgtcgtcggctgcaacgactgaaccgacagatgtggcgaatgaaacgccaaccaagcattcaggtgttttgccttatacaggtcaggatgaccaagaaggggcaaaagcaaccggattggctatgttgtttggtttgttcctcggtttgttcaagcgtcgtaagcgcaaggatgaatcagatgagacgacgaagcatcatgaagatcgttagttaagataaatagacgaggctgggacagaagtctctgtctcatcctcaaaagccgccaatctcccgatttaaaatcggaggattggcggcttttaaacgtgttccgaaaggctgaacccttaatataacgccatttgacccactctcgttttttactaggaatccttcaaaaaaagcccacgttttgttgttatacttaaagaaagcgtttgaacaaacggggaggttctaatgcaacacttatttttaatggagttttttggtcgaggacagagcggccgatcgtatgctgtgactgaacgcgtgcgtgtgttcaaagcattgcagaaaaatgtgcgattggtcacgtttgactacaatccacaatacaatgacatttggcaggcggttgccccggatttagaggcaacccatttaaatatgatggcgtattatcagggggatgcaattgctggcggtgtgcgggttgaaagactacatgatcatcagcaggtgacattggttgaccgtgtgtttaatcaaagtgatcgcctggttggtgaaatttattatggcctggataataagacggtttcgcggcgggtggccattctttataacactgatggttccgagcgaatccggctgttatatcaacaaaataaagtggcccaagttcatttttggcaagccggccagttgcaggtgatgagtttcacggctttggttcgtcagtttttgcaggaaataacggcccaggaaccgagcgttatttatgccgatgtgctggaagaagaaatgacgcaagcctatcttggggtaagcaatgcagtggcaaaggtcgcctatattcatgctgaccatcacgttggtcaacatcaaattttagtcgggttccgcaatttactacgttcgcgtcaatttgattggattgttaccgggacccacaatcaggctgttgatgtccagacggaatggcagtgtcggacagcagatattgcccccgcgtcgattaacgtgcctaagtcagtgacggctctggcagaccgccgagctatgtcagtggtggtcgtgactagatttgatcgcattaaacgggttgaggatatgatcgcagcggtggtgcaggcccatcaacaaaatcgcgatatcaatttgcaactgtacggcacaattacagaccaggcttattacacgcaactgcaaaaacaagtcacggatgcccatgcgtctaattacattacatttaatgggccaacaacggatgcggtcgcgaccttccagactggccaattgacggtgttcacttctcgcacggaaggctttggtcggacgttacttgaagcgttagccgctggcacgccagttgtgtcatacgatattgattacggtccgcgcgctgtgattggtaagggaggcaagttggtatcagatggtcgggttgacctgttagcgaatgcgttagtgatggggctggctgatcgtcattggcgcgagcaagctagtgaggcagcacgacaacaggcgacgcagtatgatgcgccacacattacagccaagtgggcagacttaattgcagaattggagcattgcgatgaaaataatgctgattaatgaaaaaacagaccatgtgattgagacgtttaaccagttgaagcggcgctaccaccacgtgcagattgtgaacgtcacggaggatgaacagtatgtggcacggcaagccggtgaatacgtactgtaccgagtcgctggggcgcgtcaacgcccagcgaccacgttgaatgagttgccgtttgcaccggattatgccatgtcttatacgccacagggtgagttacgagtgacggatatggggcaagaaattgccacgttgcaattaatcgattggcagaaacaaacggtccgcgccattaaatacatggtggctggctctaactggcaatttgacttggttggcgaacgggcagcagttattaagcgctggattcgtgacgaacgcttgcgcaccatcatgattcgtctgacccaaaataacggtaagtcggtgaagaagctttataactatgatggcgacagtcaacaaccagtcagcctgagctttctctatgacggcaaactctatgcgaacgaaacagattacttaaccaaagcctgccaagatatttttgatacacaagacatcgaaattttacgatatctaggctaatagaaacaccgacttattggtcggtgttttttagtgcgggtcgtgcctgttgcagcaatcgagtggttctctgtaatcttcgaatgtcaatgttctgtggtgtgatggcataaggccaacaatgactatcaagcaaaccgagaatatcttgattgctggcatggtgggtggggtgtgacgtagcgattggtcggggtgaactcacaagttcggccgaccgccggttagataagacgttacggaccttgactcttcgcgcaattatttgggcactagccggtgctcgcgccggcggagtttaccccgaccaatctttggcgtagtcacgccccacccaccatgtctcgacgcaacgcgtcgaccgccaccacaaacacgttttgtttttgttcagtaaaacctaattttgcgttataatgatacctcagaaagggaggtgtttaacttggctagtttattagatttagtcgatgatctcgatggtgttggaccaaagcgggttcaagcactcaataaacttggtatctacacaatcgatgacttactcggctactatccaatgcgctataacgacttagcgatgaaaacgcctgctgaaacgcaagacggtgagaaggtaacgtttaagggcgttatcacgtcaccacccgtggttaatcgcttcgggtataagaaaacacggactagtttccggttgacagtggaacatgacacgattatggtgtcattttttaatcaaccatgggtaggaaaaaacttggagcttggtcaggaagtggccgtccacggtacctacgacaagacacggcaaggcatgtctggcattaagttaatgtcgcgaaatggcgatgatgagatggaagccgtttatccatcttcaaaagaaatcaaagcaaagacaattaaagatttaattattcaagcattgggcaagtatggcgaactgttacggacggatatcgtgcctgcttatttacgaacacgttataagttgatgaaccaccacgatacagtctttgggatgcatgcaccaacggatggccaagttgcgaccgaagcacggcgtagcgcgtcgtttgaggaatttttcgtttttcaaatgcgtctgcaagtgattaagtcaatggatcgtgataatcgtggtcggtcaattaatttcaacaatgatgaattgaaggcgtttattgccacattgccgtttgaactcacggatgcgcaaaaacgcgtcgtgaatgaaatcgtgcgtgacatgcgccgcccaattcatatgaatcgtcttttgcaaggagatgtggggtctggaaaaacggttgtggctgcgttggccatgtatgccgccattaccgctgggatgcaggcaactttaatggccccaactgaaattttggcccagcaacacgctaaaacaattggcaacttttttgatccagataaagtgcgagttgagttgttaacggggtcaacaaaaacagcggctcgccgtcaaattttggaagatgttgcaaacggcgaagtggatattttgattggcacacatgcgttgattcaacctgatattgcgttccgtaatcttgggttagcggttatcgatgagcagcatcgattcggtgtgcaacagcgcgcgacacttcgagaaatcggtatgaatccggatatcttagcgatgacagccacgccaattccacgaacgttagctatcaccgcgtatggtgaaatggatgtgtcgatcattgatcaattaccaaccggtcgtaaacaaattaagacgtattggttgcgtagtaatgagatggaaaaaacaattgcctttattaggtcccaactccaggagggtgcgcaggcatacgttgtgacaccgttgattgaggagtccgaaacactcgatgtccaaaatgccgaagctgtctatgctgagttgtcggaatatttcgcacccacgtatcgggtcggtttgttacatggtcggctatcgaatcaagaaaaagaagatgtcatggcggcttttaaggcaaatgagtttcaagtgttagtttctacaacggttattgaagtcggtgtggatgtgccaaattcgacggtgatgcttattttggatgctgatcgttttggactatcacaacttcaccaattgcgtggtcgtgttggtcgaggaagtcgccaatcctatacgttcttaattagtgatccaaagacgcaatatggtattgatcgcatggaagcaatggttgccacgacggacggatttgtcttggcacaaaaggatttggagttacgtggtgccggtgacatcttaggtaatcgtcaatctggtgtgccagagttccgcgtcggtgacccgattgcggatttggcgatgatgacggtggcgcaagaagaagccattgaaattgtgtcaaaaccggattgggacaaagaccctgagctagcaccactggcggatatgctgtcagaaaccatggctcgttatcgtaattttgattaaaaaattggcgccttttacttttacccagtcctaaaagtatgttagatttgttctagcatttatttaagttattttttgaatccgagaggaaatgtaattatgtttaagattgccattgatgcaatgggaggggataacgccccagaagcaatcgttgctggtgttgagctagcgcgtgaccaaatgcctgacacagagtttttgttgtttggtcaattggacaaggtgaagcctttcgttaagaatgaagagcgcttgactttggtgcaagcagatgaagtcattgcgatggctgatgagccagtgaagtcaattcgtcgcaagaagcaaagttcattagttttggccgcgcaagcggttaagaacggtgacgcggatgccattttctcagccggtaacacgggtgctttgttggctgccggtatcttcattgttggccgaatcaagggaattgatcgtccagctttgatgacggctttgccagcgtttgatggtccgcacgatgctttcgtgatgatggatatgggtgccaatgcggaaaatcgtccggcacacttgtaccaatacggtattttgggttcattctacgcacacgagatcttaggttatgatgccccacgtgtcgggttgttgaacaacggaactgaagaagacaagggtgaccaagtccacaaggaagcgcaccaattgttgcgttatggttctgaacacaatttgttgaacttcgtgggtaatgttgaagcacgtgaagttttgcaaggacctgctgatgttgtgattgccgatggtttctcagggaatgccacgttgaagtcaattgaaggaacggccttgtcattgttgaagttgcttaaggatacgattatgaatggtagtcttaagacaaagatggctggtgcgatgttgaagcctgcgttgaagggcgttcaagcaaagttggactactcacagcacggtggcgccgttgttatcggggttaacgcaccggttgttaagacgcacggttctgctggaccagatgcagttgcaaacacgatgaagcaaattcacacaatgctagaagctgatttggtggccaaggtgcaagcgtttgttgccgatcacaaggaagatttggctgcacgtccagagaatgaggtggacggcgccgctgaatagcgttaaactaggtagagttaaatattcgaataggaaacggaatcatggaacgacaagaaatcttaaacaaggtcattgaactagttgcggaccactttgagttggacccagctaaggtgactggtgaattaaactttttgacagacatcgatgccgattcaattgattttgttgaattggtattggagatggaagacgaatttggtgcagaaatctctgacgaagacgctgaaaagttgattaccatcaacgacacggtagattatattgccgcacgcgtttaactaatagttaaaaattaatcataaatcccagcaatgtagccatcgtggtttagcagttgctgggatttttgtgtgtttggaaaatttgcgtgcgctggttaacaaactctgaagaaccgtaatataacacggttttctctggtataattaaacagtatatctagaaaggaagtcttatgtttaaacaactacaagcagaacttgcattatcctataatatccactttaacgatgtgtcattgttggaggaggcattaacgcaagccaattatattaatgaacatccaaactacacgggaaatgattaccaacgtcttgaatttttaggtgacgccgtgatgcaacaatcaaccgccgtctatctatttaagcgttacccagagtgggatgaaggtcgattgacagagttgcggatttcgatggtccaaacccgggcgtttgcagctttgtcacgtgagttgcatctcgatcaatatgtgcaattgggccgtggtgaggaattatcgggcgcccgtaatcgtgattcactgttagaagacttatgggaagcatttatcggtgcattattcttggatcaaggtcaagatgtcgtgatgcatttcctaggtgacatcatgtttaacaagattgatgaaggattctacgatcgtttcgtggattacaaatcaaaattgcaggagcacttgcaacgtcatggtagtgtcaaaattacgtacaccaagttaggcgagcgacctgtcgaaaataatgaacaaatttttacagtgcaggttgccgtgaatgatcaagtattggcaacaggcgaaggaaaatcaacaaaggaagcagaaaaggtagctgcacgggcagcataccaaacattgacgaaaaactagggaattggtatgaaactaaaaacattggagattagcggctttaagtcatttgctgatcgcaccaagatagaatttatgccaggtatcactggagttgtaggaccaaatggttccggtaaatcaaatattatcgaagccattcgctgggtaatgggtgaacaatccgccaaagggctacgtggtgacaaaatgtcggacgtgattttcggcgggacatcacaacgtgcgccactgaatcgcgctgaagtgtcaatcacattcgataataccgatcgttatttgaactccgactactctgagattcggattacgcgtgccttatatcggaatggcgattcaaagtaccaaattaatgggacaacggttcgcttgaaagatattcatgaattgtttatggattctgggttgggacgcgaaagcttttcaattatttcacaaggacgtgttgaaagtattttcagtgcgaaaccagaggagcgtcggtcaatcattgaagatgtggctggggtttataagtataaacaaaataaggacaaggctgaaaaagagctgactggtgtgcaagataacttaaaccgggtgcaagatattttgtacgagttggaaaatcgcgtgaccccattagctgagcaatcggcaaaggcacagacgtatttgacgaccaaagcacggtttgatcagttagatcaatcacgcttagtcttggaattaacggactggtacactgagcaagcagatatcaaggcccaattaagtcgggctgaggatgagaatgaaacacatgcggaatcggttaagacgcatactgacgcgttagcagcgatgaagcaagctcggacagaagctgaagaaaagcagcaacaagcacaagctgaattattgcgattgacgacgcgtgcggaacaattggttggggaacaaaaattgcaggctgagcgttctaccaatcgatcaaatgtgacccgtgaactggaagcacaattggcccaagttgaagaccgcttgacggaactacgcgtaacggcggcgaaccgtcaggaaacgatgacggcggcggctgaccaggtaacaacactagaagccaacattgcgacgttacaggcgtcacacccccgccaacagttgactcaggtaacgacggatattgaacaattacgggcaaccttagttgagacgatgcaattgttaacgaccgctaaaaatcaacagcaattcttagcgcaagaaaatgagcggaatgacgctgagagcgagcggttggcgcaacgtcagaatcaattaacgttacaaatgactaatgccgaagccacggtcgcaacggcacaaaccgccgtagctgaaacgacggccactttggcgagtgcgcaagctgaatttacgcgcttgcaacagttgggtaaacagttagaggaacaaagtcaagcccgccgccaagaatggtttagcaagatggaagaggatcagcgactgtcaacgcgtttgcagtcgttgagtcgtctatctgaaaattatgagggttatttccaaggtgtgcgtaacctcatgaaggccaaagagaatttccccggcattcacggtgtactggctgagttaatttcagttgcgtcaacgcatcaaacggccattgaaacggcgttgggtggtgctttacaaaacgtggttgttgcggatgaacaagttggtaagacggcgattagttatttgacgcagcaccgtttgggacgtgtgacatttttgccattaacaacgattcgtaagcgtgagttgcaaccggcacaaattcaaactgcccaaggccaagctggctttgttggtgtcgcagcagatttagtgaagacagatagtgcgtatcgccctgttgtacaaagtttgctcgggacaactgtcattgtcacgaacatggatgaggctgtgcccatggcgcgcgccttacaacatcgcgttcggattgtgacccttgatgggcaagtcatgaacgcaggtgggtcgatgactggtggtgccagtcgtaatcaaggtaatggtttgttgtcacaacaaagtgaagtggaatcattgacggcacaggttgcgacgttgcacacgcaaacggaacagttggaacgacaggttcgtgagttagatgacgaactgaaagcaacaacgacggcctttggcgaggcgcaagatcaggtgttagtggctaatgaagcggcacaggcagcgacggcacaattacaggtggctgaagaacgcttggcccaagcacaaaaagagaagtcggccttaacatatgaattcagtgtgtcatcatcaggtacggttgaccacgcgtcattggtggctgacaatcagcacgacattgcgacgttgtctgagcaacaagcagcccagcaggtccagttaacgagtttattggctgagcaaacgacgttgagcgacaaaatggcgacagttgatcaagaattgacggctttgcaagcacaactcgccacagctcaagctaatgtgcaagcggcttccgttcgtcacgaagatgttgtggaacaaattcaggcggaagaacagcgcttagcagcttatcagcagcagatgactgatttgacggcggatcagggtgatgtccaacaacgactggctaacgacttaactggtacgttggcggataaggaagcaaccgaagacgagttgacagatttggcaactgagttagaggaattgcgacaagaaatcgccttagctgaaggcgagcttgtgcaagcgcaagaagcacaaactgaagcgatgacaagtttgagccgtttgagcggtcgacagggtgaattacgtagtgccattcaagccggtgaacggactttggaagaaacatatgatacgtcgttcgaatacgccaagtcgcagctgtcggtaatgccaattgcagatatccgaacggaattacaggcgttgaaggtgactttgtcagaaattggcaacgttaatttaacggcgattgatgaatatgtggaagtgaaagaacgttttgatttcttgacgcagcaacaagatgacctggttgcggcccgggataacttacgccaaacgatgtcggaaatggatgaagaagtcgaaacccgcttcaaggaaacgtttgacgctgttgcagaacattttgctggcattttcgttaagatgtttgggggcggtcaggcaaagttagaactgacggatccgacgaatttgctaacaactggggttgatattaaggcccagccacctggcaaaaagttccaacaaatgagtttgttgtcgggtggtgaaaaggcgttgacagcaattagcttgctttttgctattttggaggtccggcccgtaccatttgcggtacttgatgagactgaagcggcgttggatgaagcgaacgttgatcgattctcacgttatttgcatgatgtgaatgatcggacacagtttattgtaattacgcaccgtaagggaacaatgacaaatgccgacgttctgtatggggtgacaatgcaagaaccaggtgtttcaacgatggtttcagtaaacttgatggcactcgatgagatgacatcagaaaattaatggggataaaacaatgggattgtttgatttttttaagaaaaagccagcagcgccaaaggttgttgtggaagtgctttacccacagacatgggaaaatggcgaggcacctgttgaaccaacagttctcgccgcggaagtgttacaaccaacacctggtgaggcagttgaaattcaagtaccaagccatatcgctgccgaggacgttgcaccagttgctgaagttgttgagactgtagaaacagaaacagaaacagaaacagaaacagaaacagaaacagcggtaacatcagagacgaacttggatgaaggtttgacgaaaacacggaagacgtggtctgaacgttggaatgcgtttatggcgaatttccgatcagttgatgaggatttctttgaagaacttgaagaaacactgattggtgccgatgttggcgcgcaaacagcgttgcaattaacggatgagttgcgcaatgaagttaagctacaaaatgcgaaaagcaaggctgacatttcacgcgtcattattgataagttggttgaacactaccgtagccaaggcgttaacgaagatgcgtcaatgcattttgcacctgagggaccaacagtgattttgtttgttggggttaatggggttggtaagacaacgacaatcggtaagatgtcagcacgatacaaggctgaaggtaagcaggttgtgctagcggcggcggacacgttccgtgccggtgccacgcaacaattgcaagcctggggtgagcgcaatggtattccggttgtggctggcgctgctaacgctgacccagcatcggtggtctatgacggtgtgaagacggcgattgaaactaacgcggatattctcttcgtcgatacggctggccgtttgcaaaataatgttaatttgatgcaagaattggcgaagatgaagcgtattattacgcgtgagctgccaaacgaaccgcaggaagtgttgttggctttggatgcaactactggtcagaacgcgctccaacaagcacgtctgtttaaggactcgacagatgtgacgggaattgttttgacgaaacttgacggaactgccaagggtggtattatcttgccaattcgtaacgagctacacctgccagttaagtgggttggtttgggtgaacaggttggtgacttacagccatttgatgcggatgatttcgctaagagcttgtttggtagcctattgattggagatgacaagtaatggaattagagaaaaacacgcgcttgaatgccttgtttgatttctatcaaccgttactgacgtcaaagcaaaatgattacttgcaattgtactacgcggatgattactcacttggcgaaattgccgaagaatttgaggtatcacgccaagccgtgtatgataatttaaagcgtagtacccagttattggaagattacgaagcaaagctccacttgtttgcagattatttgcaacgacaaagtgtggccgcacaattaaatgattatattcaagaaaagtatcccaatgacgctgagctaacgcgattagctgaacgtctggtgacattagaagaggagtaaagcatggcctttgaaggtttgactgagcgattgcaaaacgctttgagcgggttgcgtcgtaaggggaaggtgacagatgcggacttacgcgagacgatgcgtgagattcgtttggcattgttggaagccgacgttaactttacggttgttaaggactttgtccgtaacgttcgtgaaaaggcggctggtgctaaggtgttggaaggattgaatcctgcccaacaaatcgtctcaatcgttaacgatgaattgacggcgatgatgggtgagtcagaggtgccattgaacgtttctgacaagattccaacggttatcatgatggttggtttgcaaggtgctggtaagacgacgacggctggtaagctggccttgaagttgaagtctgagcagaacgcccgaccattgatgattgcggccgacgtttatcgtccagcggccattgatcagttgaagacattgggtgagcaaattgatgtgccggtctttgagatggggactgatgcagacccacgtgatattgttcgccaagggttagctaaggcagcggaattgaagtcagactatgtcttcattgacgcggctggtcgtctacaaattgacgaagccttaatgcaagaattggctgatgttaaggaaattgcacaaccagatgaaatcctactggttgtcgatgccatgactggacaaaacgccgttgaaacggctgaaggctttaacgagcggttagacgttaccggtgtcgtcctgactaagttggatggtgatacccgtggtggagcagctttgtcaatccgtgctgtaacagggaagccaattaagttcgtcggacaaggtgaaaagatgacggatttggatattttctatccagaccgtatggctagccgtatcttgggtatgggtgacttgctaacgttgattgagaaggcccaaaaggactttgatgagaagcaagctgctgagacgatggaaaagatgaagtcaaacacatttgacttcaatgactttattgatcaaatggaccaagtgcaaaacatgggtccaattgaagatttgttgaagatgattccggggatggcaaataatccagccttggctaacgtcaaggttgatccaaaggatatggcccatttgaaggctattgtgatgtctatgacaccagccgaacgtgaaaatccagatttgttgaatccgtcacgccgtcgccgtttggcggcgggtgccggacgtccaattgtcgaagtcaaccgcatgatcaagcaattcaacgagatgaagaagatgatgagcgggatgatgaatggtaacatgggcggtatggaacaaatgatgaatgcgatgggtggtggcaacatgcccggtatgcctggtggcttccctggaatgggcggcggtattaagggcaagatggccaacatggcgatgaagcaaatggctcgcaagattcaaaaaaacaagaagaagcgtcgttaaaattatgggtcgttatttactagatgataagacaaaggctatgaacgttaagtaccagtcagaaaagaaaggtgctgtgtcaaaggccgataaagttgcaatgctccgtgaacaaatgttagcgaagcgtaagcaaaaataagcttaaaagcgtcattcgattgtgaatggcgtttttaatttacagatttttaacaaattcctcaagttaacctgccataatataaccatcgatcacctgctagcatcgaaacaagcctgtgcacaggggcgtttcacttgttgtgatcacaatatgcaaagagcctgaatagtcgcgacggtgacttgttcgggctctttgtccataagaggaactcatttgctgttggaaaactttggtacgaacagtgagtgagttcctttttatgtaagcgttttcaaaacttcatatattcttgacgtgaccttaacttttgtttaaagtaatattcgataactttttgtaaactaaatgtaacaataagaaaaggacacatttaaggaggatatgacgtatggaatcacgagtaacgagaatgaagcgaacacgcatcacggcaaagttgttggtattggtttttgggttgcttttgttagcaggtttagttacggcgttggagacgacagctaacgccgaacagtcgctcgcacaacgggatacgcatatcgtcacgactgtgtcgacgacgaaggttactgcggaaccagttgtagctgagtaagatggaggtaggcgcttaatgagacaacgaaataagcggatactgacgtttaccggttttggttttattattggtttattaggtgtggcactgacgatgcaagtttggacacatcagcgtcaagttgaagatgcggcggtggcccgttcgttatcggttgccaaagaaatttcagcatcacgtacagcatctgaacaggctcgccagcacgccaaaaatcaaacgacgcaatcagctacgatgagtcaagttagtaagatgacgaccgatccggcaattacccatttaacggttgaagagcggatggctttgattatattggcgagtgatatcgaactaccaatcggtcaaactctgattataagggggcagggaaatggtgataccgatgttatgattgcagccacggatgaggtgttagcagtcgtgtccattatttccggttacgatcgattggtttataatccaatcacaaaagaaacgactaaagtcaatgttggtcaagcttaccaaaacttacatcagacggtggcctataaacaactatgtgaacaaattaaactaacttagcaaaaccagaattcgtcattctggttttgtttttgttaggaatgcgctaaaatataaacttatgtgagcgataatataccaaaaccccgctaaaaacgttgtatttgaataattttcaacgtgtaaaggaaaaacactttacaggcagttggttatttggtatattattacttgtagaaaaacaactggaggaaaataaacatggctgttaagattcgtttgaagcgcatgggttcaaagaagcgcccattctaccgtgtggtagttgctgactcacgttcaccacgtgatggtcgattcatcgaaactgttggtacgtacaacccattggttgagcctgccgaagttaagttgaacgaagaattggtattgtcatggttgaacaacggtgctcaaccatcagatactgtaaagaacttgttgtctaacgcaggcatcatgaagaagttccacgaagctaagttctcaaagtaatttgaggcttgctacataggcatttataagggttttggtcacatctggtcactcaaacaattattcattgtctaggacatgaagagttagctcatcttgagctagctctttttcttttagcatgtgagcgtagatctgaagtgtgacactaacatttgcgtgaccaacgcgcttgctgacatagtcaatatcaacaccgttatggagtaggtaggatacgtgtgagtggcgcaagccgtgaaagtgtattggttgaatatctgcttcacgtaccaagtcctgcatttctaggctgacacgagctgtattcattttattttcaattaggttgtcttgaccggtcgtcttaaagaaattgcttaaaacggctgacaaacgcttagaaatagcaatcgtacgaactgatgattttgtcttcgggtcagttaccttgtgtgtagatgatgaataggccttgttgattgttatatggttatctgtgatatctttcttagtgagggcttgtacttcaccaagacgtgcaccagtttctagtgctactaatgccatgagataaaaaggacgtgcttgcatttcatttgtctttgagtacaaaaagtcttgaagttttgtaaaatcagttgcatttaaaaagttatcacctttatcaactacttgaccggctggttgaagacgagtaaaaatgtcgcgcttgatgatgccgtcaaggtaagcatcacgtaatgacgtcttaatcaaagttagaatgtcacgggcatacttctttgaatgggtttcaccaaattcgtttagctccttttgtaggctcaatgttgtcagtttctccatgatcataccagcgaataccttatcaattaggttagcagcagttgtgtatcgagtataggtcgtcagcgtcagcgtcagcgtcagcgtcagcgtcagcgtcagcgtcagcgtcagcgtcagcgtttgctatcaggtcggcttcaatcgtcgcatctattgtggcgtcatataatgcaaatgctgtgtctgataattcagaagtgctgcagtataagcagttgaggacagccaagttttcaacgattgaatcactgtacaatgctactggaatttctatgcaacgtttaagtaactttgaagagaataaaacaaagccactgataacggaatttgctaagttagttgtggctttcggattagaaaatcaagaagatgttttacgactttcgaagagtttggatgtggattacggtaatcatgattttgttaaaattagcgagattacgtggtcaaaaattacggctcttgctatggacggaagaagaattccgagcatcgggattgcattgttaccaaaggaaaaaagttatgatgcaaagcaaataattgaagaagttgcatatctatctggtaagtcaataagttcattgaataaaatgattgatgatgcacgcaataaactttcaacagcacatcagaatagttccgaagtagatgagcaagatgataactcgaagtatcctaaaaaaacgcaagttgagtatgttaaggatttcgcacagttcatgtacgaagaagaaattgcagattactacaagctaacggttaataagttaaacaaattgcttgagggtgaaaatattacgttgctttctagaaagcaacgcgaagtgctccctattaaagagcttcataataatgtcattcgattactaagaactggccggtcgctagacaatatttctcgtaaacttgatttaactgtggagcaattagtgatgcgtttgagtatgaacacgacttcctctaaggaaagagatgagttgttaggcaaaggcattaaattgcaaaacgaagatacgcttgttgcggaacgttatcgatatgtgattttgcatggtggtgatttaaatgatttaatgattgatttacaaacatcatataatcgtgttcatcgtttgttatacgcttacagtggtgtttatgaacatgattttgctgtacgtgttcataatgggcaacctataaataaggatatagttgcatcgtcatcggttgagccagtttcagaagaatctacggataagtcaaaggcaccctcagtgttgtcggaaaaagttattccgatggagcgaccaacaaaaagtgctgcgaataaggcgtcgacaaatgctaagagaaagagaactgtacaaaaacatattcgtcccgcattcgaacacggtgaaactgaggttgctaatttaaaacgtttctttgctgaaaatcctcaaatgaatgaaatggatcgcatgaattacgcattggccagcgagttgtttactgacttttcagaaattggtaaaccgttgcatatgccggaagggttagtgaaattagtacttacccgagaagataagtctgatttttattacgaaaagattcaaacgtatttgtacaacgtagcggctgtacgtaactttgatatggctcacttacaaaagtacaattgatatctagttaaaacgggtaaatgagtctataattggatagttataaaaagaaaggaggagtggcatgaaaaagaatgttatcagtttctttgccggtgttggcggaattgatatcgggtttgcggaagcaggcgattttgaaacgatttatgcaaatgagtttgataagaatgcacaacatacatttgaaacaaactttggtgatgaatttttagatcgtcgtgacattcgctcagtcaatgctgaggaagtaccaaatgcggatgttttgcttgcgggattcccttgccagccattttcaattgcaggatatcgtagaggcttggatgatgagagaggtgacttattttttgagacacttcgcattatcaaagaaaagcaaccaaaagttgtttttctagaaaatgtaaagaatcttgtcactcatgatcacggtaatacgttcaaggttatacgagaatttttggttcacgcgggatactttattaagtggaaagtacttaacgcgaaggaatatggaaatattcctcaaaatagagagcgcatttatgttgttggttttaaggataaagaagcttatgagcgttttgaatttccagaaaaaattgaattgacaacttcactacaagatattattgattttgaacatgaaacggaagaacggtactactacgtaaaagataaagtacccttctatgatgaacttgttaaagagattaaaagtagtgagacggtatatcaatggcgccggcagtatgtccgtgaaaataaaaataatgttgtaccaaccttaaccgccaatatgggaacgggtggtcacaatgttccgttaataaagacgcttgatggacgaattagaaagttgacaccacgggaaacgtttaatgctcaagggtatcctgaggattataagttacctgcagatgcggctaatggctcattatataagcaagctggaaattctgttgttattccggtaattacgcgaattgcagaaaaaatagatgaagcactgggttctgatgaagttgatttaccacttccagaaactaaagataaggtagcgttaatctatacaaaaatgctcggacgtatggaaggggcatcatatccagtagagttttttgataatcgagaacaacttattgattttgttcagcaaggtcatgaaacaggggaagttccttatttagaatttatggaaaatgaagagttctttgaagcgatccgaaaaggtggcaactatgaattctttacagaactaggataataagtttcggtgtttcataaattaatacagtatactagaagcacgggggcacctgtgcttttttagtaggagtatttgtatggatgagaaaaaattagattcggttaacttaaataaatatattgattatatagacatcttcgcagatcatgatgatgaagaacttttagctaaaattgttttgaaattggcgatgtatgaaacttcgggaaaaattaaagatgacattaagacaacgtctgtgattggcgtttcgaataataatttaatatttgagacaaaaaatagaaagtatcgttatgatgcatttcgaggcactttgtatgtaaatgatgatagtatttttgttcctctttattcatataaaacgggacaaattggagaaaagtcgggaattaatgcctggaacggagccccaaagtctagtttgaataaatctgggcgaccagcatacgaagtctatttaccagtcccaaaagagttacataaaaaagtgaacggctggtttggtaaagatactataaatggtgacggtagtagcataaagtttatgttgcattttccggacggggaagttattcctggtagacttgcacaacagggatataagagtctacagacaaacccacaggctgctttaggaaagtggttaatagataatgttttaaaggttacgaaggggacccttatcaccaagacactccttgatgaaagaggcgtagattgtgttcgcctttggcacgaagaccacaatgatttggaaaatatttggattgattttgctgcaactggtacttttgaacgttttatggctgattaaactaattaattgtaattaacaatcgatattattatgttatcctgattactagagaatattttaattaggagcatgatatgagtaaaaaagcatggggtggtaccctactttttcttgggctgataggaatcatcggagcatttggcgttttaaatgaccaaaaggaacaagcggcggaacacgcatcatctatgtcatctgtggcaaaagaacgatcagaaagcgcaaaaaaagagtctgtcaagaacgctaaaaagttagcatctgtatcgcaagcgttagaggaaaacgtaacgactagttctgtatcaagcacaaccgtttcggaatctgatccgagaaaagttacaacacctgaagaagcgagccgggttgcgttagagtactataaatcattagggcacgatactaatggattcgatccacgtgcaaaaattgcagaaattgttaattcgggagacagctatgctgtgcctatttatgacacaccgcagcattatgttgaggtagatgttgataagtcgacagggaaagcaacagcaccttctttggagacggatcctatggcatcaactagttctgctagtgattctaactcttcctcatctgttcgatttaccgatatggatgcggcatctaaagccaaagaaatggttactgatccgggatataagtatgtatcaacgcaacttgataatgatgggaattatcaggtgaactttcgatacggggaaaaccaatatccttctactgttaaatttgatcaatatggtaactatttagggcgtgatggcttcgataattaaagactaaataaattgggtcaacgatttaatcgttggctttttttaataaaatatcgaaaattggcatgaaattatttcgaaatggttttatatagtgatctaaatggaggatagatcatgatagaaaccgatcttattgaagaaaaatatatatcatggatgaaatccatgaaaaagctactaaaagacaacgttcagaaagattatgttgaggctatagacaagggatcagaatgggcgattcaagttggattaatatctgaaaatatgtatagagtatccgactatgaaaaattccaagatattcttgatattttaacgagctatgagggatacgtggcctataattctccaggtcatgggacgtttcaagctgcactgcataaatatcgtgcatttttgaagcaaagggttccggagaatgaaggtgaaactgacttgcgtgatgaatttacgagctggttaagaaattattattcaatctatggtaacggtacaatcaatagctatgccaaagcgttacgtacgttggtcacacaacttgactctatagacaaaacgtatactaatgttttccactatcagacagtcgaggattttgaaaaaagaaatttagaaattaggtctgcttctaattttaaaaaggtaaacaaagaaaatggtaatcaagtcctttctgcagcgcttaactcctatgggaaatttcttaaagcaaccgaaagtaactggaaagttttacaggaggaaataattggagtttctgatgaagacgtgaaagaaatcactacgatggttggacagtatgtaagtgctcggagaggacaatcgcttttcaggcaacgtctaaaagaacgggagatacattgccaactgtgccaaattaaaattgacagcatgatgattgcaagtcatataaagccttgggctaaggcaaataaccaggaaaaattagatgttgataacgggctttggttatgcgtattgcatgatgcgttgttcgatagggggttaatttcgtttgatgataatggaatattgattattgcggatacagtactcaagcaaggaattgatgattataagttaaatgtgaatatgaaaattgttttgcaaggcaaaatgcttcagtacatggcatatcatcgcaaaaaagtgtatgaacaatttgatcttcactattaacaagctaatcaaattctgaaatatcgcaaaattaagaaaactaacaaggaaagtcagtgtggttttcaaaaaatactgcatttgaattgtgtgccgattaagatttaggcttccataacatgacgttggaatcggataatttaattttgttcgttttaaaagggttaagaacatgatactatttatataattgataaaaagacgaacgattttaatttaggggatgtaaaaatgactgaaaaagtgtactttagccatgacgggggcgttgatgatttggcttcattgacgatgttattgtcatacgaacaacaaggattaattgagctagttggtgtaggggttgtgccggctgattcatacttggaaccagcggtggctgcgacacgtaagattatcaatcgtttttcaaagcaccacgatttgttggttagtgcgtcagatgcgaagtcgagcgatccatttccaaaagagtggcggatggactcatttaccgttgatgctttgccaatcttgaatgagtttggtgaaggggacactgagttatcgtacaacacggcagcagatgacctggctacaattttaacagcagccactgaaccaattacgttagtgttcactgggccagttagtgacctaggtacggtgttagaacaggatccaagtttggcagacaagatcgaccgcttggttgtgatggcaggaacttttggcgctggtaacattgctgaaccggaacaagatggcacggccgagtggaatgtcttttgggatccgcaagcattcaaggttgtctttgattcaaatatcaagattcaaatggttgggttagagagtacccatgaagtgccattgacaccagctgaccgtttgcgatgggcgaagctgcgttcacatccagtaatggactttatcgggcaagcttatgcgacagttcctgtattgacccacttcgagacaaattcaacatacttcttgtgggatgtcttgacgacagcctttgcgcaaaatcccacactggttgagacgaagcaaatgacagttgatgttgtaccaactggtcaaagccgtggccggacatttgaaacaccagtaggacgtgaaattgagtttgtttatcacgttgatcatgatgcgtttttcaaattctttgaagagacaattctagcgattgaaaattattaataaaattatagggtgtctgcaaaatttttgtggatgccttttttaatgttagtgggaatgataaactggttccgaaagtgggttatatataaatgtgggggtgaagaaatgatatcattcattaaaaagtatcgggtagcaattcaaaatatattgtatgtgctagcttttgtggtcatcggcatcagtggtaatttaacgattggcttgattgcatggtggatctatacactatcggtcttgctaattacgatgacgtttaaggaaattgcgtggcaggttggctggttagacacgtatttgacactagcgattgttatattggatttcgtgttcttggcgactaagacactttcatcgagtggcttcttccagtttttggtcatcgcattgactgcaatgggatttggaattgatttgctacgtggacgccatttaacggcaggtggccgttggattataatgagtcgcttgttgatggtgccgacaatggcgtttctgctggtgccatttcacccggttgtgacgtttgtcgttgcccttatgatttttgcctttatcagtagtagtattgaaaagaagtatcgaaaattcgaccggttcgaaatggttcgtgttagcggacatgccggccattaataggtgaattaagtcgccgcacaacattatttgtcataaactccgtacaatttccttaaaagtatttttgaaaggaaaattgcgatgcgaaagtttattttcgggctgttagctctggcaattgttgtgtttggcggcgttttttatttactcgggcgggattataacaaaacattggtgaaagataatccgaatactgtgcaatcaagttcttctgtggccacttccagcgagagcagttctagtagtgaatcggtgagttcaagctcaagtagtgaggcggccgtgccaagtagcttacgactgtccggtgttgaaacagatcaatttgcatcatggattggtaatcaggccgcaaaaatgaatcgagtaggttcagagttaggttttgaggtttcgagcacgtacggtgatgccacgttgtactatgacacagttaacggaccactctatctgaacggtggtaatggtggtgctggtttacaggcgcaggcagtctatggattttataaatgggataatgtgaatttgcatccaggtgtgggacctgactcagataagtcagaggtgacgaatcaaacggggtatgcgcccaaacagacgattatgatcagcccaagtggttattcgggtcatattgcatcgacgaatgagtattcagccgacctatacatcattgcgaatgatggcaatatctatgaatttaaaattccacagagtcaaaacggcatgatgtggcgtcccaattctgatctgccacaaactagtacaaccggcgtagttggacagattacacaagacgcagcagcgcgagcagaattgtcagatttagttggttatgacgctgaaaaggttagccaacattttcaatatgataattgattcatttgtctgtgcttttgtttaagcgtaaaataattttagatggaaatttatttttttggaaacaatacaatttagtatttaaacctcaataggggaagacgtctcgatatacaaacttgctcggccacagcgcagtggttggttgaatcggttgttctttggcggcatctaacaccttgtaactggtaaggataggtatggtagactaaaatcaacttgaacaaaagtaagtgcagggggagagtgactaatgccatatatcagattacgaccaagcgaccttaaggcgttgccgtacgttgtgttcatcgcgacgattttatttttgatggtcatcgatgaccgaacggcacgtattgtatacggtactttcggtcttgtagttggccttgtaggcttgattggggttgcggtgatgaatcactatcatgtgacgaatcatgatgacaaataattgataagcggactaatcatggtggttagtccgcttattttttaccattgcgaaagttgatacaaaggactagactggttttatattagaaaaaggtgataaatttatgagtgaaattacacaagaagagttagctctttacaaagaagcggtgtcagttagtccaaagtcagctgctattcgtaatgcagtcacaaccaatggtatcctgcaagcagcccgtgataacgaacgagctggtgcgttgacgccagtatttagtgttgatttggaaagctcaccggtggccaaccaattacagtcaggacgttgctggatgttcgcggcgttgaacacgatgcgccacgatatgaaggccgtgtatggtttgccaggtgattttgaattatcacaaagctatacattcttctgggacaagttggaaaaggccaactatttctacgagaatattttggcgacagccgacaagccaacggatgaccgcgaagtggctttcctactacaaatgccacagcaagacggtggtcaatgggacatgctagtggcattgattgaaaagtatggggttgtgccacagtcagcttatccagagtcacaagcgtcatcacactcggctgaattcaaccgtttgtacaatggtaagttgcgcaaggatgcgattacgttgcgcaagttagtcgcagccaatgcagcccaatctgaaatcgatgaaaagttggcgcaattcggtcgcgaaaactaccacatgttgtcactgacttttggcgagccaccggtagcgtttgatttctcataccgtgataaggataataatttccatcgtgagcaagccatctcaccattggactttttcgcaaagtacgttggttgggagttgagcgattacatctcaattatcaatgcgccaactgctgataagccttttaatcaaacgtacaacgttaagatgttgggtaacgtgagtggtggtcgcgaagtgaagcacttgaaccttgatttggcgacgtttaaagacttggctgtgaagcaattgcttgccggtgagaacgtttggttcggggtcgacatgggacctaagttggatcgcaaggctggtttgatggatacaaagttgtttaacgaagacgatttgttcgatgttgatttcagtatgactaaggctgagcgtttggaatacggggattcattgatgacccacgccatggtgttgacaggtgttgatcttgtcgacggcaagccaacgaagtggaaggtcgaaaattcatggggcgacaagaacggtaacaaggggtacttcacgatgtctgatgagtggttcgatgagtttacctaccaaattgtgattaagaaggaattcttgccagaagagttgcgtgatatttacgaaacggctacaccaagtatgctagcaccttgggatccaatgggtgccttggcataattggacaagtaaccttgcattttctgggctaaaccgattatcaataaacagcagaccgcacgacagcataagatttctgtcggagcggtctttttgtctggcgtcgtgtgaacgttgacgtggtgtaataaagaagttctaagaacaatctacgttttatgacaaaaacacgttacttagaatccgccgcacgctgagcgaggtgggtgcgatttgctcaaacgaaaggaggacggatggtccaacaagtagaagcgacgctcgaacaatacgagctgatgataagaggggtgctgcaggctggccatgtctatcgccgttcgccggattttgatgattatcgccaggaattacggttgatgattgcggaacggttaatggcgggtgagacgttgacggcacagcacaataatgagttatttcggtggctgctatggcgcctgcgcgatttgcaacggcgatccaagcgccatgaggatcgtggtgtaccgcttggtgaagcgccggagcaagtgatgagtaacgcagcctttgtggatgctgaagcgaccattttactggctgatttagcgaagcaatgtcggctatcgcagccgttacaacgattagcatatgatttaatgcaatatccggatgacacagttgcgcgccgatgtcaccgcttacgggttcatcgcgccacctataatcgttggctgcaacaactacgtcatcagttacaaagtgtttgggtagcctagcctagtcatataaagccaataagataagatgaagcagacgctcggatgatactaatcatctgggcgtctatttttacttgtgaaaaagaagagaactcaaaaacagcaaactgctttttaaaggactaagatatataggacgaattggaagagggagtatgatgaaacggttatttttgaatttgactttaacgaatccacggttagagaaggagattcgggaaacgattattgcgcagtctaatcgtagtcaacgccgtgaacgacaggatatttatccgttgttagagaagtcatggttgttggcaccgattgctgtgccacaaagtcaattacgggtgttgtattcaggctatcaagtggcgattgggcagacagcgaactacccgttgtcgttgctacttgaaaaggatggccaaacctatgtgcaactgtatagtagtacggcaaagtacgaagcgagtgcacaagatttgccgacggtctgggtgcgggcatcggtgatttttgatgtgttggaacaaacgccggaagtggccggcttattgttgaatgatggtacggacgagttaatggtgtcgcgtgatgagttacaacgccaattcccacgccacgagttggtccgtttacgtgcgccatggtatgaacgacagctggcgacggactttcctaagcgattgccagtgccgggcggaaatgaagcttggcaaacccgccagaaagagacgaatcaaattagtaatgcgttggaagaattgcgagtcaagactgagaaaaaagcccgtcgcgcggcaaaaggatctagtctccatcaattaacggtcggactgctagttgtgtcgttaatcgtgttaatgcgtttgggtcgtcatgccttattgccgatgggcgtgctattatttctggcgttggcgagtgcggtatatggctatcgccatccccgcggtcgcacactgggtcgctggctagtctatgagaaacgtggcggcttggcgaagatgttgcagttggaggatgaactgtatcatttgtcagatgctgaaacatttgctaaacggatgccagcggagtcgggtgatgaaaatttaagcgaagtgtacacgacaaatacggattctgataagccagtctgggaggttgtatccgaagatgagatgcgtgaattttttgaagcggtgattggtgcacgacaaacagatgaagatgattctcaatatcttgaggagttgcttacggtcggaaaatattatcaatatacagtacctaatcaagaggatggtgaaatggcaacttattatgttggggcaacgccatacctgcctctttatattgcaccagttgaaggggcaatgccattcggaaagcacgtagtaagtggtcaacaagttgtgcagttacttgagacattggaagttgctggtgttcagattcgaacagcaaatcaacgcattcttttaaagcgtgaacaagtccgtgattggtgggaggataagtaagtgactaactattatttgaattcgtctgtgactaatccacgtttagctgaattattaagatttatgcccggtgaaaataaatctggcgtacgcctacgatatataaggaacatggcagaagcttttaatatttcaaatcttgcttggccgattttaccggacgacactcatccagttttagaatcagatgatggcacgaaaagcattgattttgacagccaacttaattttgtcggatggaatgatagcgaaggcgcgttttatccgatagtgtatttgtctagtgccatggcgattgcagatggttatgatgtgatgattaccggggtggatatgataactgcttttcaattaggcagtaataaaatagggggcttcaattttgagttgcctgatggtcaaattaaacgaattgaagaacgtgagatagcaacattaaagttgcttccgttgccaaacgctgatacgacggtaccaaaactagtacctgtccctaagggtgaagaacggcctttcaaaacaaaagatttagaaaatctgcgggcaattaagcgaatttttgaattagaaaatgacaaacaacgtgtgcaagatgaggcgtataaaactgcgaccaaacagacacacaatgttgctatagccgtagtgagtggcctattgtcaatcacgttgttgagtgtggccgtgcaacatgggcgagcggatctgcttggatacggaggctttgcaggacttgttgcaattgcgctttttgtgacgcggaaagatgagttgactagtttgtataacaaattgttaacgaccggtaagtatggcaaggagattcaagaaatagaggccttgcaaacggatttgggcaactacgatccggaactaattaattttgtacctgaatatctccaaaatttgccagacgttgctgaattagtgggctacatggaacgtggtcaggcccatgatttacccgaagccatccaactatatgaacaaaattagccaaacctgtaaacgttttcaaatccaagtgttcaaaacaaaaatcttcataattgcccggtaatctctgaagtatcaaaagaaattagcgaggtaagtactatggtagatcgtttgacggggaaggttgcaattgtgactggtggaaccactggtttgggaaaggcaattgcccaacgttttattgaagagggtgctaaggttgtgattacgggacgtcgtgccaatgttggtgaggcggcagccaaggaactcggcggggaagatgtgattcgtttccaacaacacgattcatctgacgagcaaggttggcaggacttaattgcctacacagaagaggcatttggtccgttgaatgtgttggtcaataatgctggtatcggagcaactaatgacattgagcacgatacctttgacgcttatcgtaagttgatgagcattaatgctgatggaatgtacctcggtacgcaatatggcttccgtgcaatgaaggaacatggtggtgggtcaatcattaacatgtcatcaatccttggtttggttggtgatacgatgacggcctcatacaacgcgtcgaagggggcagttcgcatgttctcaaagtcagctgcagtctacgcagcgcaaaacgatttgaacattcgtgtgaacacggtgcacccgggctacattgcgacgccaatgacggacggttctggggaaggtgactcagtcgcaccttacgtgacgcaacgcttaaagacaccaatgggacgtatgggtgaaccagatgatatcgcctggatctgtgtctacttggcttctgaagaatcaaagtttgcaactggtgccgaattcgtgatcgatggtggttacacagcacaatagataagaaaagctctgacagtgatgttagagctttttttgcgggtcgttttattttgtgaaaaccataacgtttacaaagtggaagtaaagttgtatcattatttgtgtagtaatgagcaagagataatttatttaggaatttgttatttgagaggtaactaacatgagtgatgtagcatttattactggcgcaggacaaggtattggtgaagcaatcgctaagcgtttagcagatgacggctttaaggtcgcagttgttggtcgcacgttgtcgaaggttgaacgcgtcgcaaacgaaattaacgcagttcaccctgacgcagcgttggccgttgcagctgacgttgcgaagcgtgatgaagtatttgccggtgttgaaaagactgttgcacattttggggatttgacagtcatgatcaacaacgcgggtgttgcacctacgacaccaatcatggaagttgacgaagagacaatgcgctggacgtttgatacaaatatcaacggtacagtgtggggaacgcaagcggcggtcgaagcctttaagaaggctggccacgggggtaagattatcaacgccacatcacaagcgggtgttgaaggaaatccagatttgacggtctacggggcaactaagtttgcaatccgtggtatcacacaaacgacggcaaaggaattggcaccattgggcatcacagtgaatgcatttgcacctggtatcgttaagacaccaatgatgtttgatatcgcccacgaagttggtcaaaatgctggtaaggatgatgaatggggcatggcccaattctcagacggcattgcacttggtcgtttgtcagagcctgaagaagtcgcatcagcagttgccttcttggctggcaaggattcaaattacatcacggggcaaacattggtcgttgatggtgggatggtattccattaatttggacttgttatcaaattcacattgattttattcacagaatagtttacaattattcttgtttgatgatgatttcacaaatagttgtttgaccatttataaacaatactcaagctctcatataatcacactaagcgtgggtgcctggagaggcagcctggtcaagcgaaaagtagatccgaaaagcaccgccgtcgactgagatggcggtgcttttgctagctatggtatagtaaataaggattaaatgagatgaggatgacgacatgatcgaagaacaatttgagcaggcagttgcgcaattgaacgagtcactgaacttggcaaaggtcgacaatattctgaagcctgtgttgatggcggggatgaagcggggctacattgacgcacatttggcagtgtttgcggaagttgagaatatcaatcccgaagaacaaacggctgaatgggttgaccgcgctgaaaagtttgcgacggacaactttgtgacgttagaaaaggttgcccaaaagaatgcttctgatttgtatgcgcaaattaagagtatgttgtcagaagaatatcacgagattacgcaccacaaccatgacaagattggtcaggcgaatgtggtcatgccatactttaacggttggtttttaggtgcgtactacgcctacattgcgctgttcacgcaaatgcagtcagcacaaggcgcagttggcccaacggagacgcaagcaatcgccaaggctgcttcagaccgtgccgaaaaggaagtggaagtcgaacgtcgtaagttcaacaaccgcccaatttatcgtcagtcaatgttgcaagaaatgttggcagcactataaatgcatttaaaaacgccaagcgattcagttcgcttggcgttttgttgtttagtaggaatccccattaacgattgagttcttaacgatgacatagtcgacgtacttaaggtccattaattgacgaccaccggcgtatgaaatggctgattgcaaatcttgttccatttcaagcaaggtatcatcgatgtagccacggtaagggactaacaacttcttaccttcgacgttcttgtattcgcccttttggaattgcgaagcagaaccaaagtatgtcttatacttggcgccgtccatttcgataacttcaccaggcgtttcagcgtggcctgcaaacaatgatccaatcatgaccatcgtggcaccgaagcgaattgacttggcgatatcaccgttataacgaatcccaccatctgcgatgattggcttcttagcagccttcgcgcaaagacggagggcagctagttgccaaccaccagtaccgaagccagtcttcaactttgtaatgcaggccttacccggaccgacaccgagctttgtcgcatctgcacccgcattttccaaatcgcggactgcttcaggcgttgccacgttaccggcaattacaaaggcatttggcaagtgggccttgatgtattgaatcatcttgataacggcgtcggagtgaccgtgcgcaatatcgatggtgatgtattcaggcgtcaagttagcggcttgcaaggcgtcgatgaactcgtattcttcttgcttaattccaacggaaattgaagcaaacgtgccaacttcatggaaacgacggacaaagtccaagcgtgtttctggttcgaaacggtgcataacgtagaagtacccctcagtggcgagcttcatcgccaactcctcgttaatgaccgtttgcatgttagctggcacaacgggaatcttgaacttacgattgccgagtgtgacagacgtgtccgcttcagagcgagactcgataatacacttgtttggaatgagttgaatatcttcgtagtcgaatacagttgaaaagtccatttaaattcccctaagtttgattaatgttcgtgttttaatgttgattctgttgcgttccacccaacaaatcaattataaccgaactaaaaacaaaaacaagcacaacttctctatttatttgtgaatgttctgagagcttgttataataattaggtacgaaagccgtacattaacggggtcgttacggaatcgactggcattgttcgtgctagtactgcgtttaggggttgtggccctataatccactcagaagaattaactgcaaacaattcacaaaacacttacgcagtagctgcctaaaaaacagcctgcgttgcctatgcatagctttgattgtgggttaagctaggttttaaaattaagcaatctgcgcatatttgtctccgcctggggcaggtatgaagaggataatcaggctggtctaactgatcgccgcgcggaatggcgtgcactagacgagatttaaattattcagctatgaacgtagatgtgttagttacgagatggtaggacaggggttcaactcccctcggctccatatataaggttgaaaacgttggtatatcagtgtttcccttgataaatcggtaaacgggtggcaacgtatttgtactgttttgtactcttgtgtagtaaatgccacccgttttttgtgggcaaaacaataaaaaataccgttgctcggcaatgagtaacggtatcaataacatgattaaatttaatattgtggctgcctgccttatgtcgtcttacatgattgtaaggcgttttttattctatacaagtgctcgtgataatcgtttacagtgagccgttagtcgggcatactagtttatgcggtggatcggcttaattacccgttgaaaccgcggcaagttctgcgatacatggcgtcactgttctctctacaatttttcttggaacagggaggacatataaaatgtttcaaagattatccgggagtttagagtggttcacttggcagcaagtggcatctttgcggtgttcgtggtgttaattctgatgttacctaaaatcattcgtgcgattgtcagcggttacgttgatgttaaacgagtgaatagcgagacaaaagaaaagacatccacgtccgaacacgaagatgcctaaccactagaagctcttggaacttgtcagccctgttagtgtccgaccactaacggggctttttctatacattcatattactaggagaaatggctaaaagcaacaaaacaggagtaaaaatacaacgacatacaatgctatgcaatgataacgccaactagccggcaacgtacgtcagcatgtcgtatgtgtcttgaaatgctaagacaaatgttaccagccattttgagcgtacttttttatttggcagcctccggtaggctttaataccaagcttcagatgatttatctggtaaaacaccggtatctattttcactcggagtaaggagcgcatcgcatgtgttaggtaaattttgcgagggtcattttcggcgctccaagttgttgcgccaccggtttttttaaagacgatacgcccgatatctgccgggtttgatttgtgattttcgacgtaatagtggtattcaatagtcgtcgcagtttccttgatttttgtagtggttaccatatggttcgcctgcacagttttttataaaaagcgtgtgttccttctcttagaattttattggtgcttctataacaagtgagtaacattcacgacagccgttaccaacgccagaaatgcaaccaaccagtaaatgcgaatgttgctagtgcgacccatgacagtgaaagctactgccaagataagttgaaaggcgaccccataccaggacgtgatgacgtgaaccacttctagaattaagagcacaaccattacaggaaccaaggcccactggaatagccgtgccaatttagtcatatcagtcattgtaattctccctctaaatgaatgatgctttatctaattatcgcgctactttttgggagattcaacgctacttagcaaatatgtatggcttagatagttgaaaacaaagcgggggataatcgtgaatgataaagattcgaataagttaatgacaacaaaagtttcttaggatggccgaattgtgatacctggttttctaagagaacgattcaacattcacgagggaatgtacctggtatggatagttgatgagttaggtcgaatatacgttgaaccaattccagcgcaatatgactggaacgacattttggtagattggcctattgagaaagttacaccggatgataaagggcgatatgacgcaacagaaagtccggactttcatgattgggtgattaatgggtagtaagtagttgttgaaagtaagcaacgtgttacaaccaatcacgttatctgtattgctgtaactttctgtgttcttacagtgtgtctaacatatcgggattccaaatttcagataacgtctgacctggtacgaattcataggattccaggtcagccagcgtttgaaattttctttcaaaaaatggtgaactatccaatgcggtgtgatttgcccagagccatagttccaaattgccagctttagaggtgatgatttctattgtgtataagttgccgttaacccagaaacgtggtgtcataccaatacgtagccatgtgataattgctgaatatgaaaagtcattgtcatcaggaattacaattggatcatctttacttaattcgtaatctgccataattacttccttgttttgggggtatgtgcgcggttaagcattcatacacccattttaacaggattattgtgttgttgatttcatgctagaaataaacaacacttttttatttgtcaaaacaaaccagtgggtccagaataatcgtcgttgtaatacaagccgaaaaaacggaggtatcaaacatggcagcacatccaatcgactatgaagtgattggtggcaatttttcgacggacgaagcgcgccaaatttggtctgaagaggccaagttggagaagcaatttattgtggaacaagcgctagccaaggtggaaggtgcgcaagggtgtaatacccgcaaacgtagctgacacaattgtgaacttggcgttcggcgatttagacattgatcgaattgcccagatttcacacgaaaaacaacattccttgttgggattaattcaagaaatgcagcgcatcgctggcccagaagctggtgagtatgtgcattttggggcaaccacccaagatattgtagatacaggacttgttttgcaagttgctgttcactatgaacggtatgaagccctactgacaacgttacgtaagcaattagcaacgttaaccaagacatatgcccaaacgccatatatggcgcggtcacataatgtgcatgcggtgccaattacatttggattcgttttagcacgttatctagatgaaattcagcgacatgttgaccggttgacacagatgaaggccgacaccttaacaggcgtctttgctggcgcggttggatcgcattcagcacttggtatggccggaattgcggttgaagaagccttgatggctgagttgcatttacaaactgaggccgttgcatggcacaacgcacccgatcgtttggtggcgtacactggcgaattggcaatgttgggggcaacgttagccaaaattggtcggcaattctataacgaagctagcacggaaaatcagcaattagctgagccgtttgtcgggcaagttgggtcgtcaatgatgccacacaagcgcaatccagaaaacttcgaagcgattgctgcattggctgagccaatttttgccgcgcaaacgcagctgatgcacgcgttgttgagcgtcaatgaacgtgatgcaattgcgtggaagcaattgtggctcgccttgcctgaaattcaccagtatgtggatcggcaattaacttcgctcattgcgatgcttgatggcctagtggtgaatgtcgacaagatgcaggagaacgtggcgcgcctaggtgatttggtttatgcggaggacattatgatgttcttggcggaccgtctggggaagcaaaccgcgcacgaaattttgtttgaggtggcacaacgtagcattgatcagcaaacggactttttgaccgatttgatggcgaatgcagccgttgccaaggtaacgagtttgtcagaattaaagacggtggcgtcatttgaaaagacaaccgtcgcaatcccaacattgattgcacatgttttagagaaggaagtaggttaaacaacatgatgaagaatacaaagatgatgacgttggttgcagcaggtgtcgcaggactagctttggctaatatgccagtgcatgctgctgagaagacgattacattgggatcaactggtgtgtcatatccaacgtcttataaggaaaatgataagttggttggcttcgacgttgaagttgcgaacaaggcgtttgcggcagaaggatacaaggtgaagtgggttaacggtgactttgatagcttgttgcaacaattgagcagcaagaagattcaaggtgtgtcaaacgcggttgcttacaacaaggaccgtgctaagcaataccgtttctcaaagttgtacgcaacgtataaccaacaagttgccgtaccaaaggatagtaaggctaagaaggttagcgatttggctggtaagacggttggtgctgtgcaagggtcaacgagcatcaagaatttgaatgcgtacaacaagaaggttgacgtacgtgcctttgagtcacgcgatgatgccgtgacggctgctaacggtggcaaggttgatggtgtgacgaactcagggccaattttgaaggctgtaatcaaggacaagcaattggctttgaagatgttgcctgacaagattgcagctgaccatgacggtgcagtcttcacgaaggatgccagtggtaagaaggacgcgaagacttttaacgctggcttgaagaagttgtacaaggatggcgaattgcaaaagttgtcacacaagtacttcggtgaagatattatcaatggaaaggcgcttaagtaatgtcatttgatgtgcattatatgattggtgtgatgccaaagctcttaccatatgtgccattgaccttactattgaccatcggaactgtttgtaatcgcaacgctggtcggcgccgtcgtgacctggttgcgtcgtagtcgatatcgctggttacaagcgattgctcggttctatgtgtcagtattccgtgctgtacccggggtcgtgcaaattttcttggcttactacggtttgcctgaaattattcctgcgttgaagacctggtcgccagaagtgatggtcattttagctttgggcttcaagtatgcggcgtatatggccgaaacgttccgagcagccgttgattctgttgatgccgggcaatgggaagcagccacctcgttacagattaataagtgggccttctttaaacacgtgatgctaccgcaagccgccgtaaatgcaattccagggtttggcaattacacgattggcattttgaaggaaactgcattggcctttgtcattggggtgacggagctatttggtgagggtaagctaatcgccggcggttcgtttaagtatatggaagtatacgcagcggtcgcgattatttattggttgttggtagtggcgtattcggctttgcaaaataagttagaacgctattatcgtcggtacatgtaggagggtaacatcatgacaatggcagttaagcagttggttgtgacggtgccaacgaataaaaagcatgtcaccaaggaagtgttgcatgaggtgtcgtttgacatccccaccgcacaagtcctaacgatcctcggcccatctggcgcaggcaagtcaacgttgattcgcacgttgaacggcctacaaccagttacaactggcagtgtgccagatttagctggtcaaacagcgatggtgtttcaacactttaacttatttgcgaatttgacggcgctagataatgttgcctcgccactttacctgactggtcagcaatcgaaagcggtcgcccgcgaacgtgcaatgacgttactggaaaagtttaatttggctggggttgcgacacaatatcctaattcactatccggtggtcagaaacaacgcattggcattttacgagccttgattacggaagcgccggtgctgttgttggatgagccaacttcagcgttggatccggaatcgattcgagaagtgacggacatgattactgaggtggccaagttgcctaaccggacaattatcttagtgacgcacgatattgcgtttgcacgtgatatttcggatgatgtgctattactggcggatggacgggtccaagcgtttgaacgtgccgatgatttcttcgcacctgaacaacaaaatacagatatcacagcattcctaacgcgttagggtgctgaaaaagtaaggacgcaaaccgagttgggcttgcgtccttttttaaatttcttatgaggaatccgctgaaagctgggcagagccactaagctcccatatactattaatcagtatgtttaggagctattgtgatgagaaaagaaaaagtgtgggtatacggcttaattatcatccttgtgttggaatacatttgggcggtggttaaccacttgttcggctttggcgtgaatgtattctggggcttgttgttgattggcctgattaatattctagcggatgaactgttacctaagttaagaaccgtttatatcgcagtaaacggcgtcttcttggcgttggttgtgattggatcattagtgagttggcaggtagaacgccatgaaaaccggatttcattggtcacacaaagtgattatcgcaacaacttaaagcggacaacggcaatcgctgaaaatgagttggacgccgttgttaacgaccgttcgagtggtgattattacatttatatcggtacagcggcatccccagatagtcgcaagttatcgccagtgattaagcaactcgcaaaaaatcatgaagtctactatttcgatacaggggcgtacacgctgaagaaatcattccgcgacagtcttgaggtgacaaacttgccatacgtgacgtatgtgcataatggtcaacgaacgacaggtttgaatggtggtaagacgacgttgcatgagctgcaacagttagctaagaaccagaagtaaaaacttgataaagacctggaacgcacagtcaatcgaccgtgcgttctttgttatacttgaaaactgtaattatttgagattagtaaaatagcattttaaacagaggagagaaacatgaagttgtttgaacgctggttagcgcacagctttgattggcaatcgttgggcttggccttattgatcgtcatcgtgtcatttttgttgattcgtggtgtcgtccggggcattttccactttattgagaagcggattccgaagcgctttgaagcgtggattgacgttttgatggcgtttgaaaatccagcgcgcgtcgtcgtgctgttttcagggttactgttggcgttgcacacggcccatgcaccacatttgctgattacatttgcgacgcaagtttatcgctcgattctaatttttagtatcgggtatgggttgtacacgttgatgggttcattgacaacgttattggcgcacctaggcgaacgcgtgcatatggagattgattcgattgtgatgccattcttgacccgtattctgcaatttgtcgtcatggccttaacggtgacgatgattttgtctgactggggcattaatgtgaatggggtgttcgctggactggggttggttggattggctgtttcgatggccgcccaagatccaatcaagaacttgttaggtggaattatcatcattactgaaaagcctttccaaatcggtgactggattgcgtcaccgtcggttgagggaatcgcggaagatattacattccgatcaacgctcgtgcggacatttgatggcgctttggtgattgtgccgaatgcgacgctatcgaatgaaccaattacgaattggtcacggatggagacccgcaagttaacgttgacgttctacttagacatttccactaagacgaaggatatgatggcagcgatggctgatgtggaagcaatgttagccgctgacgaccgatttgcgactgatacgcaaaaggcgtacatcaattccgtgacaacacgaggtcatgagtttatggcggtcgcacagttcaagatgttgccagacgctgactgggccgggacgcgagctgatattaatatgaaaattattcgtattttggcagcccatgatattcagttatcagccggcattgaagcgccaatggaaaattaatcaaaacggtaagcctgcgggtttaccgttttttgttaaacgctaaccttttttaagttatttggctttttagcgtgcgcagacgtgtgaagcccgttacaatagatgtaacaatattgaaatgaaaaggggaacttgagatggcatctgcattattagcgattgtcgttggcttggctgccgtcgcaaactacacattgttttcggtcgtgccaaccggactaccacaagtcctaagtgtgattggtcaaggcgtcttatcggtattcgccattatcgtgtttgtcactttccaagggcgcaaaacatggcgtgattacgatggtgtaaacggttggacggtcccacgtggtattacttgggtcgcactgatcggtacactgggttcattcgtcgtgatgttacttgcggtgcttggtatcattacaggtcatatttaacaaaaattagttaacgtcgcgttaccgtactggtagcgcgacgttaaacgttttacaaggtttttactatccctttaaacggttgacgctgttaaccaaggtcggtatagtagaccaagttgaaaattataaatagttcttttaaccgtcagtcagagaactggccaaagagcgcgtcacctaggataactgtagactattagtgggccgctctgtacatttttgtaacggagtggccctttttgtttaccttatacctgggtgcaaggaggggaatatggaaaagcagtttggtcaagttgaagcgatttcaactgacaagcgtacaatgtcaaactgggatatgtttgcaacttgggttggtgccaatgccaacaacgggacgtggtacatcggtggtgtgattgccgcagcggggatgtacactgcgtcgacgactttgattatttcgggattggtatcatatgccttattagcactcgcttcgtttatgggctttaaaacggggttgccaatgatggccttgacgcgtgcatcattcggtttgcgtgggtcattcttaccatcaattattaacatcgtgcaatttattggatgggctgccgcaaatacgtttatcgctgccatttcaatttcggtgattttcaaggatttgtttggctggcaagcctatactgcaggcggcaaagctggtttggtcatcgggattatcatcatgtcattgttgcacttggcatcaatttcattgggtgagcgttcggtccggatgattgaacgtatcgggattatcttggtcgcaattttcgtgatttgggaatcaattgtggtcttccaacacgtgtcattagcggatatctttgcctggacgccaccagcaaaggtgcgaatctcatcaggtgccgctatcgatatcttggccgcctttaacctggcctgggtaacggcatcatctgacttctcacgtttcacgaagcgtaagtcaggggcaacgggttggtcattcttgggtgctaacattgggctattctggtttgctttcattggtttgacggcaacgattgcaacggccttgatgaacaacgcgtttgatccaaacgattcagatccatcaacgattgcttcaaagctaggcttggggattatcgccttgttagttattgtgattacgtcaacaacagcgaacgcggttaacttgatggcggctgggtcagcgttgaccaatatgtggcacaagttgaagttgacacctgctttgtggattgtcacgattggtgcaacattggtgtcattcattccattgtggtttgctactttcttggatgctttcatcttgttcttggattacattggtatgttcttgggtccagaaatcgcagtctttctggtggatttcttctttattcgtaagggacaatatgagttgtcagaattcacgaaggttgacggtaagtactggtacaatggtggcttgaactggttggccatcggtgcttggttgattggtattgccttgtacttcggtttgaagtcagttgatatcatcagtcaaacgattggtgtgacattcgtagcgatggcattaacgggtgtcatttactacatcgcggctaagctacttaaaaagtaatagaaaacattaaggcaacctgcttacaaatcggcgggttgccttttttcgtctataatagagctttagcgaaaatacgggatgacaattaagcgagggacttatggcgaactatttaattattactgagaaaccatctgctgcccaaaatttcgtcaaagcacttggcgggaaggtcggtcagtttgaaggcaataacttcaatattacaaacctccgtggccacgtcatgacgttgaaagaaccagaagaaatggtgccagctgagttgcaaaaggcctataagtcatggacgctcaagtacatgccttggcagattagcgatttcaagtggcaacggacgtatatccgtaaccgcaatttgcgaacgggtaagtcggaatcaacgaagaagattgtggatgagattaaggctgagtcgaagaaggggtatgacgccttggttattgcaaccgacacggatccatctggtgaaggtgatttattggcctgggaagcaatcgatgccattggttggcacggccaagtcctgcgcgccaattttatggatgaatcacctaagagtattaaggcggcgatgcgccaattaacggatgtgacagataagtggcaacacggtgcgtatttgaaaggtgaaagccgtaaccgttgggactttatgtcgatgcaattaacgcgcattgcgacgacatccgccaagaaggctggttataaggttgtcgctcgcgaaggccggttgaagtcggtcatcgtttggaaaatctatgaacaactggaagcaattaaaaactatgttcgaacgcctttttatgaggtgaagttcaaggacccagccggtcacgtgtttggtcgcgtgacaaaagatggcgacgtgatcccatggcgatttccgaacaaggccgcggccgaacaagatatggcccagtatcacagcagtgcggtggcacacgaaaagcaccaaactcgaacccaagcaccagggcgtttgctagacttggcaggattggccgccgtgttggcaccgcgcgggtatgcgtcaaaggaagtgttggctacttatcaaaaaatgtacgaagcacaggtggtgtcatacccccgtactgaagacaagacggttaccccggagcaatttaatgaactgttaccattggttgaccggattgccaagttggtaggggttgatacaagcttgttgacacatcggcaaccgcggtcaacgcacgtgaagccacaaggatcccacggggcgaaccggccgggtgtcaatgtgccagctgatgtccaaagtctgaaaaagtacggcgacagtgcgatggcgatttatgaagttctggcgaagaactacttggcgatgctggcggaagattacgtgtatgaccacgtgacggccgacttggctgattacccaagttttaaaacagcgttcaatgtgccgattcaactgaactttaagttggtgtatgattcattcgccgccacgcgcgttgatgatgacgatgaggatgaaaatgcgggcgtcctgggaccaatggcggatccgtacattcatgaaggcgccaacaagaagccacagcaacccacgacgaagtggattatggcgtacttggaaaagcataatgttggtactggtgcgacacgtgtgtcgacgttatccgatatgggtaagggtcaaaaagcgatgttgcgtgaggcccgtggtaagttgacgctaacggaaacgggtaatgtgtcagcggtcatggtgaaagggacttggattgcgtcgccgaagattaccaagcgtctgtttgaaatgatggacgaagtgggcgaatttaaaatgacgatggacaagttactggaatcagtgacacaagtggttgatcatgatatgccgattatggtggcgaatgccgaggcattgcaagcaacattgggggcgccaaagcccaagcctgtgcgcaaggttagtgagaaaacaactggcaccttcaacggtgaagaaatcacgtttgccaaagaatggagcggacataaatttacagatgacgagcttgcgaaactattggctggcgaagaagttagttttgcggctaaatcaaaacgtggcaaagattatacagcagtagggaagttagccaagcaaacatacaagggtagtaccttttatggctttaagctgaatcccaaacctcggaaatagggcttcactaaaaatgatattcgtcatatacttgatgtaagtaagagagtgtattttgtaggttaggaaaaggtatatatgaataaaaagacaaaagcaggtgtgattgcagcagtcgcaggtgctatgggtgtgagtggggtcgcacacatggatgctattaagcacgccgttaagaagcaaagtgatattaccgctgagacaaaaattcccgttttgtctagtttgctacaaagcaagaagtcaacagaagcacgtggtgtgactacgacgtcagatgtggctcgtaagattgtgaagcgcgctggggcggcgttgccacaacgtcagacgccggctaagcgtgccgcagcagcgaaggcaacgacgcctgcatcagaagagatgcaagtggcctttagctctgattcagcagcaccagtagtgaccgtggccgcttcatcagaagcaacgtcagaatcagcgacgtcaactaaggccgctaagtcagcaacaactgaacaaacggcagctgctagttcagcatctgatgttttgacatccgttgcggcgtcatcagcgtctgaaaagcgtacagcaagtgtgtcagccgcaccagtaacgcccgccgaatcggcggcgttggagcaaatgacatcaacagcgcctaagtcaacgacgacaacgggcacttacacggtggtcgatggtgatacgctttcaagtattgcagcggccaatggtgtgaccgtagctgctttgacggccgctaatccaactttggatttggcaatgttgtcaattggccaggtgctagttgtgccagcagccggagcgtcagtaacgccagttgttgtggccagctctgctgcaactgaagagtcaacagctagtgctgcctcatcagttgcgactgcggcctcttcagccgacacaaacgatacgacggttgatagtgctgtagccactgatgacacgacgactgccgtggctagttcagatgtgacatcaacggctgcaactgagacgactttggcaagtgcaacgcctgtccaacaagcagctgtttcagatgctgttgcccaattgaggagtgttaacgcatcagcagcagttgatacgacaacgacgcccgtggcaacttcagatacgacgtcagcggatactgacactacggcagtagcacctgttcaaacagcaactgctgatacaacagccgcaacgcaatcagtttacgatcaatttatcgcagctggtggaactgatgcgctttggaataatatcgttttgcctgaatcaggtggtaacccagatgcggtttcaccaaatggctacttaggccttggacaaaccaagaatgcttggggtaccggttcagttgaaacccaaacgacggggatgttgaactacatcaacgatcgttacggttcaatcgacaatgcgattaatttccgcgcacaaaataactggtattaaaaataaaagcacttcgcattatgttgcggagtgcttttttgccgttagaattggacgatatgtggtgctggttcattgaaccctgcttgcaaaatttcgataacagctagcatttggctgtcagaaatcaactttggtgcgtcatttacaatactgtcgtaggcggcgtcgtaaatgcggccgtagtcaccgtggatggtggggatgaccttttcaatgcgatcaccacttgggttgaagtaggttagttggccataatcttggggcgcatcatccccgaatcctggcatacccggcatgatgccaagcttcaagtcgtattcttgctgatcgatgttgtacttaatgtacgttccagcggtaccatgcagcacccatttcgggtaggcgaccgtcgcgagttcagttgcttggacagtggccttaaatgcatctgggtagtggaggttcacttcaaattggtcatcgattttagcaccgagttcacgagttgcccgcaagtcgtaggtcgcactggttggcttaccgaacagggcaatcatttggtcaactaagtgaacaccgtgaccgtaccaagcaccgtcgatgggaccgccagtggttgtcgcactattaggtcgatagtggtccatatgcacttctaattcgattggtcggcccacatagccggcatttaagacgtgttgcaacgttaaaaagtcactgtcaaagcgtcgattttggaaaggcatgaagaataagttgcgttcgcgagcgatatcaactagttcttgcgcctgggttaatgtttcaaccatcggcttgtccacaatcacatttttaccagccaaaagcaattggcgggcagtgatgtagtgtgccggcgctggtgtcacgactacgactaaatcgagggtgtcatcagcaaggatgtcgtttaaatcagttgagaaaatagtacctgttgcttcaagtgcttgctgttcggcagggcgcttgccaagtgttggcgtaacaacccgagtaattcggaaattgtcttgccgttgcatcaggtagggaatgtgataacggttggtactcttaccaaaaccaacgtaagcaatatttaacataagatatttccccctttaccccatattgtgtccgaactgctaggtgaatgcaaggaatcatttgtgaaatgactgtcgaggcaggtgtccgatatggtatactctactgaaagttaacaacatgaattaattggggaagaaaaatgctcattaagcaagtatttattgaaaatgcggaccaagcccaagacgtccgtgtggttgatggcaagtttgtcgccattgccaatcatttagaagcggtagccgatgagcaagtgatcgacgcagccggtaagttgatggtgccaccatttgtggacccccatgtccacttggactcaaccatgacagccggtgacccagaatggaatgaaacagggaccttgttcgacgggattcgcatctggtcagatcgcaaggaaacgttgtcacatgaagatgtgaagcaacgggccatccaagcgttgcgtattcaagcagctcatggtttgcaattcgtgcgttcacacgtcgacgtgacggatcctaatctaacggccttaaaggcgttgctggaagtgcgtgaagaagtaaagccatggatgacattgcaactggtggcatttccacaagaaggcattttgtcattcccaggtggtaaagaattgatgatcaaggccgctgaaatgggtgttgatgcaatcggggcgattccgcactttgaattcacccgtgaatactcggttgaatcattgaactttgcctttgaagtggcccaaaagtatggtttgttggttgatgcccacacggatgaaatcgacgatccagcttcacgtggtttggaaacaatggcgacgttggcacttgaaacgggtctcaaggaaaaagtgacggcttcgcacaccacagcgatgggatcatataatgatgcctatgtttacaagttgatgcgtttgttgaagatggctgatatcaattttgtctcaaatccattgattaacatgtacctcggtggtcggtttgatacatatccaaagcgccgtggcttgacgcgtgtgaaggaattggacgctgagggtattaacgtggcctttggtgaagacgacattaaggatccttggtacccaatgggtaacggtaacatgatggatgttttgcacatgggactgcatgcaacgcagattatgggttacacagaaatcatgaattcgtaccgctttattaccaagaatggtgcgcgtacgatgcaagtgcaggacagttatggcattgaactcggtaagccagcgaacttcttgattttcaacgccaagaactggtacgatgctttgaacgaacgtgctgaactgttgtattccgttcacaacggaaatgtcttggtcgaaaccaagccagctgaggtgacggttacattaccagaataaaatagtagaacgaggtttgaccatttcaggttagacctcgtttttaagttggcgcgagtgtgtcgttctttcgcacgagccatggtggttggggcgtgacttcgccaaagattcgcctgggtaaactccgccggcgcgagcaccggctagctcccaaataattgtgctaagggtttggctcccatttccttatctaaccggcggtcggccgaacttgtgagttcacccaggcgaatcgctacgtcacgccccaaccaccatgccggcagccgagatagtcgtaattttattgcgtttcattcatgggtaaagctggacataagttaaccttaacgaggaacagtgcctgattatgaaagcatcttgacggaatcgatagtagtcattacgtatccgattgacgtatattttgggggcaattttggctgagatgtgacggcccatatttttccgtcaattttggtgaaacaaacaattaaatcgtaaaaatgcttgataattgaggatgactatcgaacagatagagcacatcttggctgctggtatggggtttgggtggggtgttgtggagttcttgcggcattagtaggcgttcgagggaggtagcggcaccaaagaaatcttagtggttgcgtattttggactcgcttcgaggccaaaatgggtaagcacttagatagattgggaccgtgtcccagccttctaatgcagctagacggagcgacgccccacccaaaccccatgcctcgtcgcaacgcgacgacacagacacacataactaactctaataaaggccagctcaccaaatttcgtcgtataatgctgtaagaaagtaagcgaagggaggcacgtgcagatgacacgattttcagaggacgatacagaaatgtatttctggcgccataaattgccagaacaaatttaccgtaaaacaagttttgcaaaactcatggcgtcgacaccggaatcagaaatgaaggcgtttgcccgtgaaatcttcgataaactcccgccagaagcgcaacagcggcaagaatatgatcaatggctgttagccttggttgaaatgttgcagcaaccacatccagtgccggaagtcatgaccgcactgacgaccgggatgctggcggatgagacgttgacggctgggcaaaccgctgtttggcagaatatgcaaacgacgccatcaccaattcaaattgtgacagggcgggctggttctggtaagtcatatatgatggcgcgcctaattcgattggcccaacaacaagatgtgaacacgttgttgataacaccaacccacgctgcagcgacgaatgcccgtggtcttgtcgagcgtgctattggtgatttacttgacgaacatgaaccggattacttgctgaagccagttgaccacgtcaccattgcgacggcgactagtttcacataccgcaatcacgatgccatgacggaaattgcacggacagggcatttttttgaagatgctgagaaggccagtcggtatccaacgtatgacctcatgattgttgatgaggcgttcgccgcaaatgtgcgggcgttaatcgacacgattctctacggcttagcaactggggcgcaaattctgcttgttggtgatccacatcagctaccatcagtcgagaatgacccagtgccgtttttgaacgcgttggtgctggcgaacttagcaaaccagacgccgaccctacaacaaattaagcgggctaattcgccaattattgcgacggttgcgaatgctgtgctagatggcgatgtggcccagattgaagcaccgactgaattaatgccagccgaagtgttgccggatgttttcctgacgcggccttacacctttgtgccaatggcagaaacggcactgttgtttgtggttgaaacgatcaaacgggccttaatcgctgaaccagataaggaaaccgtggcgctcgtaccaactaacgaactccgcaagctcattaatgcagctgtgcagaatgcgttactggatacagctattttgcggactgaattaccactatgggtacgtgatgatttaacgttatatccaggtgaccgtgttcaagtgatgcagacggtttacgtgacgaaccaagcgagtggtgcgcacgagaaggtacggatgcgtgggggtgaccgcatcaccgtggttgatgtgatgccagattacgacatggtattggtgcaaactgttgatacgccggatccgattttagttgatttgaacgaaagcagtcagactggttttaatccattttcgtatggtccaaagttggtgagtgtccgtgagaatttggacttggggtacgcgactacgattcataaaatccaaggatttacgctggataatgtgttagttgtcttgccgatgatttcaaagttcattacgaccaatttaatgtattcggcagtaacacgggcggcgtcgcatttagcaatcgtcgcgtttccggcggaattaaagcaaacattagccaataaggtgacacatgatcgcgcagctatgcgacgggtgcaaggattgattgcgtcacagtaaggccataacattcattagaaatccgtgttcgccatagaaaacacggattttcttcttgtcatacagaatgtatatccggaaaatgggagaacctaagcaaaaggcaacttattttttgttaattgcaacaaatctgtatttacgttgtataatgttccatataagggaaatgctataaatttggtgatattttccgcccggtgcgtctgttgcattatgaaagtgtgaactttgtttgaacaggcgcgagattttgtagacgttctgtgaaaaaggcccaaatatcagacatcgtttgttattgtggtagatgtacaaataaaagaattttaaattcaagaattcattaaagacggggaataagaatatgaaacttttgatggtcgaggataacacgtccgtttcagaaatgatgggcatgttctttaagaaggaaaactgggatgcatcatatgcatacgatggtaacgatgccgttgccatgtttaacgaagagccagatgcctgggatatggttatcttggacttgaacttgcctggtttggatggtatgcaagtggcagttaagattcgtgaagtctcaaagcatgtgcctatcatcatgttgacggcgcgtgactcagagtctgatcaagtgcttgggttggaaatgggtgcggacgattacgtcacgaagccatttagcccaattacattgattgcacgtatcaaggcattgcaccgtcgttcagaaacggctggtcaaccagcttcttcagaaccacaagtgcacgaagatttcgatgtacaaacacgtacgttcaagttgaactcaaacacgcgtgaagcttacttgaatggtaatttgattcaagatttgacgccaaaggaatttgatttgttgcgtgtcttggctaagaagcaacgtcaagtgttctcacgtgagcaattgttgcaattggtttgggattacgagtactttggtgacgagcgtacggttgatgcgcacgttaagaagttgcgccaaaagatcgaaaaggttggccctcaagtcatccaaacggtttggggtgttggttacaagtttgacgattctaatgtgacgtcagatgaagaatcagaagcttcagcaaaggcctagtaagcgcgtgccaagacagttatactagtggcagtggtgcttacgaaataaaaaagagagtcaacgaaagataaccacgtcgcttttgacgtggttttttggtaataacaaatgaaaatgatgtaccagcaaatgctggccttcttcaccgttattatggcaactttggtaattgtcgggattttgtttacacaatttacgacaaaaatgattgaagataatacttatcatcaattgaatcgatacgctgtagcggtcgccgaagaagcgatgcgttttaaagctgatgatggatcatttgcgtacttcgacacgaaggggttggagaccgatgcttcattgcttgaacaacagaatattaactttacgctctataatgctgaccggaaattggtgtatccagaaacgcaagtgaaggaaaccgccaatgtgacaaacgctgagtgggcccaactcaagcaacacaaaattatccagaagcgtggtgcaaagcaagctaatccggcggataactcagcggctaatacaatggatgtgatgaaaccgttctttgataataagaataagttaatcgcagtcgttgtgactcgagcgaatgtatcgaccgtggcggataacttggacatgttacgcaagaacttgttgattgccttcttggtatccgtcgtcgtcgccgtcatgctgagtttcattttgtcgcagctgattgttaaccgcttgcgcttgattcagttggttacacgccgggttgcgggtggtgattacaccgcccaagttgagatgcatcgtcatgacgaaatcggcgcgttagctgaagacgttaatgtgatgacggcgtcgctggctgcccaagagcatgaaatcgaagaacaagaagagcgccgtaaagaattcatggccaatgcttcgcacgaaatgcgcacgccgttgaccacgatttcaggaatcgttgaagggctgcaatatggtgtcattccggaagatgaaaagatgcactcatacgatttgattaagtctgaagcggatcgtttgacgcgtctggttaaggataatttggactacgaacgtttgcgtcaaaataaggttgtgttgaagaagaaggaattcgactcagtaccagtgatttcaaacttgttgaaccaattgtctggtaaagctgatgtggcgggcgatgagtttaagttgaatgctgactcaccggtaccggtcattgctgaccaagatcgctttattcaaatcatctttaatatcgtgaataacgcgattcagtttacagagaacggtgtaatcacgattgacgcctggcgtgaaccaggtgaggcacattacaagattgcggataccggtattgggatgatgactgagcaggttgataaaatctgggaacgttattacaaagcggacccatcacgaacgaagaagggtgagtctggcttggggatggcgattattcgtcaattgattgaagtccacgatggccaaatttcagttacttcggaacctaatgtagggacgaccttccatgtggtaattccggattcacaaaaaaagacagattaggacattgttgtgcagaaaaaaggaccgatttttcggtccttttttgttgaattcaacgctaattgacttacaattgttaagaattgtttgtgaaaatagcacgtgatctatcaggcgtgaacccgttaaacgcctacatgatagcgttttcaaggactttgcgaaaacgttttaaaaaagttagcgaaaagtgttgtgcaaacgctttcatcatgttatgataaatctcgttgataagtgaacaaaaaatattttgattgtgaaggaaatttaaatatgtcaattttaattgctcttattccagcgttggcatggggatctactggtctagttacgactaagatgggtggaacagccgcgcaaggaacgttgggaatgacgtttggtgcattcgtattcggaatgttgacgttgggactattcgttgtccctcaagcaggtgctgactttgcctttaacccacgtatctggattgttggattcgtgtcaggtttgttctgggctgttggtacggctggacaattcgttggtttcaagaagttgggtgtatcagttggtaacccactttcaacggccggccaaattgtgtcaaacgccttgatggctgcggctgttttgggtgagtggacgactggtcgcatgtggacgtttggtttgttggccatcgttgctgttgtggttggtgccgtcttcacggctttgcctgactcaaaggcgccagctgaagttaaccctgagcacgacttcaagggtggcttggttgctgttttgatttcaacgattggttacatgatgtacttcgtgttccctaacttgttgaacaagattggttacatttcaaactcagttcacaaccgtcacgacggtttggactacatgactgcgattgtgggaccacaatcaatcggtcaagtgttgggtgccttcatcatcgttatcttcttcatgaaggaaggtaagacgatgttccaaaagggtacttggatgaatattgtaactggtttggtttgggctttgggtaacgtcttcatgtttatctcaacggctaacccaaacatcggtcaagcaactgcttcaacgttgtcacaaacgggtatcatcgttggtacgttcggtgccatctacctattgggtgagaagaagtcaaagcgtcaaatggtctttattgttatcggagcgattttggtcgttatcggtgccattatgattgctaagttgaagactttgtaaaattaatgctgataaacacctgcagagcatcaagttctgcaggtgttttttcgcataattgacgtattttttcggtacgattagcgtgtgaaagtacaaaagggggaacttatggaagctaaggactatttggcaattgatattgggggcacacggattaagtatggtctcttagatcgcgcggggacgttaatcgaaaagggggacgtggccacaccaaatgaaacgctatctgaatttgtggcgacggtccgtcaaattgtgcaaacgtaccgttttcgaattcgtggggtcgcgtttagtgcgcccggcaaggtggatcatggggatgagaccatctatgcagggggtgctttgccatttttagaccaagttaatttggctgatgaactacaactcgatatcccagtggccgttgaaaatgatggtaaggccgccgcgctcgcagaattgtggctcggaaatttgactggtattgataatggtgcagctgttgtactgggtactggtgtagggggtggtttaattttgaacggcgccttgcacacgggggctcattttcaagccggtgaattgagttttatgcataagggcgagacacgctttgatgcagattcatacgggaaaattggttcagctgtacaaatgattgaaacggttgcgacggtttatgacttgcctgatgtaaaagatggtcgcgcagtctttgaattaatcaatttgcgggaaggaccagcttgggatattttcaaacgctataccgatgatttggtattaatgctattaaatatgcaggcagtcattgatgtgcaacggtttgtaattggtggtgggattacggcgcaaccgattgtggtggaaacaattcgtcagtcttacgaagagatggtcgcccgtcgtccgcaagtacgtgatggctttacgacaccggagattttaccagcgcgctttggtaacgatgcaaatttgtatggggctttgtaccatctgctactgcgtctaaatcacgaagtataatcattcataattttgacacagttggtataggccgttgatataaaataaatgtaagcggaatcagtcagtatggtaaaatgaatatcgagatagagtttattttttgagactgtaagccgatcaatgaaggggacataaaaatgacgattacagtaaatgaactaggcacaatgcctaatggtgaagtcgcaaagcaaattgttattgaaaacgccaatggtcacaagcttggcttggtatcatggggcgcttcatggcaattcttccaaacaaagtcaggcgaagaacttgtcttggcttataaggatgcgcaaggatactgggaccacccatatttcttgggtaatgcaattggccgtgttgccggtcgtatcgatggggcatcatttgaattgaatggcaagacgttcaatttgaaggccaatgaaggctcaaatgccttgcacggtggggctgacaactttgcgaaccgcaattgggactttacggttgacgaggctgctggttcagtgacatttacaaccacaatgacggaagcaattgataacttcccaggtacgatgccaacatcattgacgtacacgttcaatgataatgacgaggtgagtttgacgttcgccgctgagtcggatgaagatacgttgtacaacccaacgtcacacgcatatttcaacccagccggtattgacacggatgcccgcgaattgcacttgcaattggcatcaccacgtcatttggaattccgcgcagatcaaattccaacgggaaagttgttggaaacagctggtacgccgttcgacttccaagcgggtgctaagattggtgaccaaatcgcaaagatgaatggcgcatatgatgctaagtttgacgatgcctttgagttggtttacgatgctggcacaccatctgctattttgacagatgaaaagtcaggtcgtgcaatcgaaatgacgacggatcgtaatgccgttattttcttcattacgaatcctgctgttgctgatcacgagggtgaccgtgagtggtttgatgcgaacccatacaatgcagttgcgttggaagcacaaacattgtctgatgcaatccaccacccagagtttggtgatattgttttgccagccggtgaaaagcgttcatacacgacgacatacgcgtttaagaacttgtaagctgaaaagcgggcattggtttgactggtgcccgctttttgctgggttggggagtaatttggttgggtaagatgcctaaacttttttaaaactagcgtaaaaatctagataacgtaatcgctttcaagattttttaggaagtgttataattggtctataccaaaagctattaggggaaaacgaggtaagaatttatgacgacgttgacgtttgacacatcaaagttggccgattttgttggtgaacaagaattagggatgatgcaaccattggtgacggttgcggaccaaatgttgcgcgatggatcaggggctggcgcagcttatacagattggctacacttgccaactgagtacgacaaggatgaatttgcacgtattcaggcggcagctaagaagattcaatctgactctaaggtgttggttgtcatcggaattggggggtcatacttgggtgcacgtgcagccattgatttcttgaacgattacttcaataactactacggggatgatgaccgtgacttcccacaagtgttgtttgctggaaactcaattgcaccagcatacttgaacagcttgattaaggtcattggcgaccgtgacttctcagttaatgtgatttcaaagtcaggaacaacgactgagccagccattgccttccgtgtctttaagcaaatgttggaagaaaagtatggtgttgaaggtgctcgcgagcgtatttacgccacgactgacgctaagcgtggggctttgaagacgttggccgatgcagaaggttacgaagaatttgttgtgcctgatggtgttggtggtcgcttctcagttttgacggctgttggtttgttgccaattgctgctgcaggtggcgatatcgaacaactgatggctggtgccgctgccggggaagcagcctatgccgatgctgatttgacgaagaacccagcataccaatatgctgcataccgtaacatcttgtaccgcaagggttatacgacagaattgttgattaactatgatccaactttggttcaaatcggtgaatggtggaagcaattgcaaggtgagtcagaaggtaaggatggcaagggcatcttcccagcaaccggaaacttctcaacagacttgcactcatttggacaatacatccaagacggtcgtcgcaacttgtttgagacgttgttgcgcgtaactgaaccagtttcagacgttgtgattccagaaacagacgctgacgatggtttgggttatttgcaaggcgagaccatgagttatgtgaaccgcacagcttcagaaggaacgttgttggctcacgttgacggcggcgtaccaaacatgatcgttgagcttgataagcaaaacgaattcgctttgggacaaatgatttacttctttgaagtcgcggtagccatttcaggttacctgaacggcattaacccatttgaccaaccaggtgttgaagcatacaagcgcaacatgtttggtttgttgggcaagcctggctacgaagagttgacggccgaattgaaggcccgtttgtaagaaatttagagcaggggactgtagcggtcttctgctcttttatgatgcgtgtcgtcgctggcgcgccgagacatgggtctgggggatttctccgacaaagattttctacggcacacgcccaaccgcgagcactgcccgtggctcccgtgccggtcgcatgcaccaaactggaaacttgtggttttggtacatagacgggcagcggtcgggtcgggcttctctgtcccgtagaagatcgctccgaaatcccccagacccatgtcggcaatcgagatgttctagtctgttgtggtattacatctaggaaaaagaaaatgggtgcactattcatttcgaagtggtgtggtggatgaaaatcaaacagggataaaattgtttggctgctgtgcttggccccgccacgcgtatggacacgtgcggaccttgacccgcaggtgtgggttcttagcgggtaccgcttagagccacgggaggtaaaggtatacgcgccaagggcgtggatgccgctccctgcaggtcatgggctggatgtgttagcgtgccaaagaaggggccaagcactcagaccgtcagggcggacacacggaccacacttaattttccgaataaaaaagcacgcaatactagtttttagacaaaaactctgctaatataattcagaaagacataaatctaggagaattcaatcatggcaactattggtatgaatgacttgaagactggtttgacgatcgagtacaaccaatcaatctggcgtgtgttggagttccaacacgttaagcctggtaagggagcagcctttgtgcgttcaaagttgaagaacttgcgtacgggtgctgttaacgaaatcactttccgtcctggtgacaagttcgaaacggctaacatcgagacgactgaaatgcaatacttgtatgctgaaggtgaccaacacgtcttcatggataacgaaacttacgaacaagtttcaatccctgatgacaagatccaagatgctttgaagttcttgttggaaaacatgaacgttaagatcacgacttacgagggtgaaatcttggacgttgaattgcctaagactgttgagttgactgttaaggaaacgcaaccaggtatcaagggtgctactgctaacggtggtggtaagcctgcaacgatggagactggattggttatcactgttcctgacttcatcaacgaaggtgacaagttggttgttaacactgacaacggtggatcatacacgtcacgtgcctagttttaattagtaaaatcaggtataataaacatactgttgaaagcgccgaccggcagccggccggcgctttcattttgaaggaggatagttccatggcagaagaaaccattgtattggcgcacccaagcgacatttcaggtgagacgcgtgttaacacgcgcgtgcttgagattatcgccggcttggcagcgcaagaagttgaaggtgttgcccgcttgcgtggttcattgtctgagcgtgctcaagaagcctttggtcgtcgtatgcacggtaagggcgttgaattgaagcaaggcgaagcaggattagaagtaaatgtttacgtttacttgaactacggcgttagcgtgcctaaggttgcccacgcaatccaagagcgtgtcacttcacaagtagccgcaatgactgaattgcaagttaccttggtaaacgtacacgtacaaggtgttgtttcaacaaagccaacgttgaccgttgacccaaacaacttgtttggcgatgacgacgatacggaagggactgaagcataatggcatcattgaaccgacaccaattacgacaagccgcattccaatctgttttcggattggcaatgaatccagatgcgcaagtcgaggcagttgtccaacaagtattagatggggatccagaaattacttgggaagatgaactaccaacggatttgttggacatggttaacggtatcgttgatcaccaagatgaattcgatttgacgatttcagaatatttggccgatggttggacgattgatcgtttgaacttggccgacatcgtattaatgcgtgttgcaatgtacgaagtaaagtatgctgaaacgccagccaagattgccgttaatgaggctttgcaattggcccacgactttacagatgatgcatctcgtaagttcattaacggaattttgaacaaagccttgactcctggtgagtaaggctgtatagtatatatctgttaagaaataaagtaacagcggacctgttgttcaccttggcgagtaaactcgtcgggtaaatcactcattattgattgatgatgaatggcgggttatcgtgtgtcgcgatgacccgcttttactttatttcaagttttttcggaggtaaggaccatagcaaacgcgcgccaaccacaacaacaacaagatttgattaatgatcgcattcgtgctcgcgaagtacgtttgatcactgatgatggtgatcaaggtatcatgtctaaggcagacgcccaggcaatcgcagatgagcaagagttggatttggtattggttcaggctaatgccaagccaccagttgctaagattatggattacggaaagttccgtttcgatagtcaaaagaagcaacgcgaacaacgtaagaaccaaaaaatcgtcagcatcaaggaagttcgcttgagcccaacgattgatgacaatgactttaatactaagaagaagaacgcagttaagttcttggagaagggtaacaaggttaaggtttcaatccgtttccgcggacgtgctatcacgcacaaggaaattgggcgtgaagtgatggaccgatttgcaactgatctagaggaaattgcaaaagttgaatctagagcaaagatggaagggcgcagcatgtttatggtgcttgcacccaaggaaactaagtaattaaaccagtttggaggacatatcaatgcctaagtttaagacacaccgcgcttcagcaaagcgttttaagaagactgctaacggtggtttgaagtcaggtaacgcctttacgtcacaccgtttccacggtaagactaagaagcaacgccgtcaactacgtggaacttcaatgatgaacaacacgacgttgaagacttacgttcacatgttgagccgttaatttaaagcttttactttaagttttaatcggttccgaattatattttagaaattactggaggaaatacccatgcgagttaagggtggtactgttacgcgcgcacgtcgcaagaagatgatcaagttggccaagggttaccgtggtcaacgtcacatcaactacaaggttgctaagcaacaagtttggaagtcatggttctatgcattccgtgaccgtaagcaaacgaagcgcaacttccgtaagttgtggattgcacgtattaacgctgcagcacgtatgaacggtttgtcatactcacgtttcatgaacggtttgtcattgatgggttcaactttgaaccgtaagatgttggccgacttggcagtttcagactttgaagcattctcagctttggctgaagcttcaaagaaggctttggcagacaacggtcaagttgttcgcgaagctactgcagctacttcagagaagggtgttaagattaacgccgctgctcctaaggctgctaagaaggttgtttcatcagagaagccttcagacaagaacactgttgctgaaatcaaggcatacttgtcagctaacggtatcgacttcccagcttctgcaaagaaggctgagttgttggcattggtttaatgcttagtaaaacacgcgctgaacgataagttcattgcgtgttttttgtttacactaattttgtcggtacaaatccgaattggtatagttacaactatttcatcgatggctaaaggtggttaagttgtatttgggtatctaacgtgtagtacagcggattcttcaatattttgggcattgttagttttaaggaatggcgcaacgattgctgttgttatccacaatgaaattttacttataataaatgcggacgtagcctgtggagaactttgaagttctctattttttttgcacaaaatttgctagtttaggatgcattgttcgtttattaaagtgtcctataccaatttctgtggataaaacgtgtataactaggaaaaatgtcgcatattatcgaaaacctggtattataatatacgtcgtttaaaacgaaattaaaaagccctcgggtggataagggcacgcaatttgcgtgtaacctaatataaggaagtaggtagtttagaatggtatctaagaaagttatgattggtggcgctgtattggttgtgttggcgggaggtgcctatgcattatcagcctcacacacgagcgcaagcaagaatgatttttcactcgcaatggtttcagatgaaggtggtaatatttcagatcactcattcacggaaatttcttggaagggtgtgaagagttggggagaatcacacgatttgaagaagggtaagggtggctacgactacttcctttcaaagactcaggctgactttgatacaaacttccaacaagcacaagctgctaagttctcgatgattgctggtatcgggtttaacttgcaaaattcacttgaaaaggcggctaagcaaaatccagatacaaagtacgctttggtggatgcgcaagctaacccaaagttgaagaacgtcacatcattgatgtttaagtcagaacaatcatcatacttggctggtgttgctgccgcgatgcaagcgaaggctgaaggtacggatacaatcggctttattggtggtcaatatggccctgtggttggtcgttttgaatacggattccgtcaaggtgtggcttcagttgataagaacatgaaggtaagttcaatttatgccgcctcatattcagatgcggcaaagggaacgttgattgcgaacaccatgatggctaagaacatcaaggtaatcttccacgttgccggtggagttggaaacggtgccttcacggcggttaagagtcacaaccaagccttgaagtcagaccaactggccaaggaaaaggtttggatgattggtgttgatatcgaccagacaccacaaggcgcttacaagacggctgatggcaagaaggataactttaccttgacgtcatcgttgactgaagttggtaacggtttgaagaacgcggctaacgatgccatgaaggataagttccaaggtggtaagacggtttggtacggtattaaggatggcggtgttggtgtcatcacatcaaacatgccagccgatgaaaagaaggctgttacggccgaccaaaagaagattgaagatggttcaatcagcttgaagtacacaggtcaatacgatgcgccaaaggctaatcgcacatcattaacaaactaatagattatcaaacgtgcgaggttgttttagcctggcacgttttttaatgtaactatgtgtttccagtctacttctccaaaaacgtgtggtacgatatgggtaaattgagatcgggggataatctcatgggacaaccaattaagttaggacaaaatgattttgaagcagtttatgatttatatcgatatgcttttcataaagagccacgaggcggtaaggatgcactacgctatttctttggtcaaacaattgcatatggggagtttgatgcgcaacagttaacgagtcaggtgacgcaaataccattccaagtcaattggggtgaacaattgctaaatgcaaacggcattggtaatgtcagtagttatccagaatatcggggtgacggcgcagcttcacgtattatgatggtggcactacaagaagcgtatgaacggggtgacatcttaagctatttggcaccattttcgtatggtttttacggccgatttgggtacgcgcaagcttttgatcggctacatctcagctggtcggcggaacattttccacagggaaagcgtcgtggcgggacaatcacacggatggcgtttgatgaggcgcaagctttgatggatgccgtttatgagcgggcccctcagatgaagcgaggcgggattgaacgggaaaactggtggtgggactattatttcatgatgaaaacaccacatacccaagttgcaatctaccgggatgacgatcacgaaacgcaagggtatgtgatgtacgaattcgtgggagaaacttttaaaattcgtgaatgggtcactttgacgacggatgcattgctaagtacgacccgttttatcggtagtcatgctggtgcatttagtcgcttcgagtatgaagcgcccgttagcgatttgaacgagctcccggtattgcaactcatgcctgaaccgcagtatgaggcgcgggttgtgccttacatgcaggcgcgaattgtcaatttgccagcttttgtgcaagcacttgatatcatgttgccaacagaagttgtgtttaatgtcactgatgaaactgcaccgtggaatggtggtcgttttgaattacgtggtggtgagttgacacgggtagtgcagtcagaagcaccggcaatcactggttcaatccaagcgtttacgcaatggctaatgggctatcggtcgttagataatttgttgttaaccggtgatttgacgacagctgatgcgaaaacgtttagcctgctacaagcacaattaccaaagcaaaagccggtgctagctgattatttttaactattaataaaggcctgtgatagataatcacaggtcttttttcacttaatatgaaaaaacaattataaatttgttgacattattctaatgtaattctaatatattatttgttccagcgttgaagagatgagtacgaacaacagctattagccagagagtcggcatttggtgagagtcgataatagcgttgcttggaataatggtctcggagtggttgtaaagatgagctagtaaggtaagtttttgccgggtgcgcccgttattgcgcaacgatatatccaatttgatttggcgtattgtgaggttaggataatctaacaaactcgggtggtaccacggtgaaaagtcgtcccgtaagtctgtgcagttgcatgggcttacgggattttttgtttaaaaggggaaattaaatgacagtgcaattactaaatggttttacagctaaagaatctgacaaaacaacttgtcggcaaaccaagcaactattggtgttgaatttaatgccgaatcgggccgtaacagaacagcagtttacatcattacttagtggcacagatgttgatgtggctgtgacctttgctataccagcttcacatcgtattcgccaccatccggtagcagtccagcagcggtatacgacgcttgctgatattaaaaatcgctattttgatggcgtgattgtcacaggcgcgccactggaccaaacgccagaacaggcaattgatttttggccagaatttcaggactttatgcggtggcaggtggaccatattgcacggcgtttgtttgtctgttggggtgcctatgcggcagggctggtaaccaaagattttttaccaatcaagctgaacgacaaaatatttggggtgactgaaacgcaagggtttatcatgccgcaatcacgctacttcaccattccgttggcgaacgtcgatacaggtcaagtaattgctggtgacaggaagaccggcgcgacaattattcaaaaccagcaaacgcagacggtctatgtgactggccattacgaatatggtccaaataatttggcgatggaatttcgtcgggatcagcgccggggcctgctgattgcaaagccgactggttacttcggggatgatgggcgaccgatggcacactggcatgaacaagggatacatattgttgaacaatggttgaaagacgaggaaattacaaatggttaaagtggcaacacagttagtacaggggacaaatgggtcggaagatgaccggagtggtgcggtggtcgcgccattacatttttcaacagcttttcgccaccctgggttaggtgaatcgacaggctatgattactcacgcatgacaacaccaacacgcgacctgttggaggctcagttggccaaaattgaacatggcacacaggcctttgcggtgagctcaggaatggcagcgattacgctggtgctatcaacgattctgaaatcgcatgatcactttattacgagtgatgatttatatggtggctcatttcgttacttcgatactttacgtgatcagtatgatattgcctatgaaacgtggaatggccaagacattgatgaattagttttgcgcatccagccaaacacaaaagcaatttggatagagacaccgtcaaacccgaccatgaaggtgattgatattcaagcggtggccagtgtcgtgcatgcaatcaggccagacattttagtcattgtcgacaacacatttttaacgcctatttatcaaaacccactgaccgaaggggctgacatcgttgttcattccgcaactaagtatttgggtggccataacgatattttagctggtgcggtcgtggtcaaggatgcgactctggcagatgccttacgcacccagctgacgaccacgggccaagttctggatccgtttgacagttggttactgatccgctcgttgaaaacattggctgtgcgcatgcgagtccatactgaaaacgcgcagttattggcgaaccgtttagcgacattgactggtgtcgagaaagtgctgtatgcaggcgtgggtggcatgatttcgttctacttagcggagacatatgatgtcaatcaattcttacaagcgctaacgattggttcttttgcggaaagtttgggtggtgtcgaaactttgattacggtgccatttgtgcaaacgcaccatgatatgccggaaagtcagcgacttgggttagggattacgccacaactcattcgcttatccgtcggcttggaagatgcggatgatttgtgggcagatttagcccaggcgattcagaaagcagggcgcgcatgatacgaattggcatgttaggttttggcacagttggtcgttcggtctatgaccttttacaagcgcacaccgaacggtttccagatatgcaaattgtcagtgtggcggttcgccaaattaccgaacagcggatgactttatatccgacggtgcaatttacgacaaacccagacacaattgtgaccgcctcggacattgatgtggtgatcgaggtgatgggtgggcagacagagacgtatcgatatttgcgacgggcgctccactcaggtaagcatgtcatcacagctaataaagatttaattgcaaccaatggggaaacgttacaaaaaattgcgagtgcgcatcaattggcgttgctttatggtgcgtcggtggctggtgggattccgattttggatgcactgactaatctactacctggggacgaaacgatgcaggttggcggcatcattaatggtacgagtaattttattttgacgcagatgagcgatgcggcaatgaattatgatgatgcgttggcattagcccaacgaatgggcatcgctgaagcaaatccagtaaatgatgtggccggttttgatgcacgttataagttggcaatcttggccaaaacagccttcggtgcaaatgtcgtgacgactcagattccgacccaaggtattcaggaaatcaatgcaaccgtactagatgaagcaaaacgactgggctatgttatcaaaccactcgcggttgctcggcggactgggcaagagttagccatgacggtgggaccgcacctagtgccggctgcgcatctgcttggcaaaattgataatgtgcaaaatgcggttcaggtaaagacacgtaatattcaggatttagtttttactggtccaggggctggcgctaagccgactgcaagtgcggtattgtcagatcttgcgattgttcatgacatcgtgtgtggccgtcaactggtgcatgagaagcaggctttgcaacagccagtaattactgggacggcggctggccgctatattcgtgtgacggcaccggctacttatgagattgatgccattgcgcaggctaatcgaatcgggattaaaaccatgtgggtgcgtagtcaccgggccacaatcttgacggacactgtctcgccagcaacattagcccgatttgaagcagctttgcaacaacaaatcggtgcaaaaatcgaaattgttttaccggtctaccaggagtaacaagtcaggtgtggctgacgacaggataacatcagactcggattcaaaacgattgttttagactaaaagttaaaaatcgtccgcaaattaggagagttttagaatttttgacacttctctcatgacgggctaatattgctgcttgtatgaaacgattttagaatttgaacgaggaacatgatgttaatcaaacaaccgcgtttttcagtatggctgagacgcaaacagttaacagaatggcccggggaaagggttgttcgttgtcgtcgccacctgtattaatttataacaacaatgttaagcataaatacaaggggcataaaaatatgagtattaagaagcaattgttagcagcatcggttttgaccacggtcgcattggcggtggggggatcattaagcccggtgttcgcggatagcaagtcagacacatttacctacgcaatcagcagtgatttggaatcaacgaatccaatcacaacttcggatcgttggggcttaacgtttgataatattcaatactcaccattattccacgtggaagaaaatggttcattgacgcctgttttggcaacgaaggatacggtctcatctgatggtaagacgattacagtcgatttgcgtcaaggagtgaagtggagcgatggacaaccgttcacagcagatgacgttgtcttcacgtatcaaaagttggctgataaggcgaacggcaattccgataaattctatattaataacaagccaattcagattgaaaaggttaatgatcatcaggtgaagtttattttgcctgaaaagtcagcttcagccgtcaataatttggtaaccgagaatttcattattccgaagcacgtttacgaaaatacgaaagatttttcaggtagttcattgacgccaggcaacgttggtactggcccatacacattagagagttataagcagggtcaagaagtccgtttcgtccgtaatgacaattattttggtgaaaagccaaagttgaagcacgtggtacttcgcattttgaccgacccgaacacgactgatatcgctttaaagaagggcgaagttgatgcatcgttcgttttgccaactgagttgaagaacttaaagggccatgacttggccgtacacgcgttctcagaagatcgtgtgggttacttgggcttgaacacgcatgttaagaagttggcaaataagtcagtgcgtcaggcgattttctatgcactagataagaatgaaatgaataaggcggcgtacctcgataagaagtattacaatacgccaacttcattcttaccaccaaagaattcatttgcgacgactgatgttgcggcttacaagacgaacgtcggcaaagcaaaggcactccttaacaaagcgggtgtgaaaaatctaacccttaacttagggtatacgtctggggatgctgcacaaaaaattcaaggtagcttgattgcctcacaattaagtaaggctggcattaaggtgaatgttgaagcggttgatgccaccgcgttgtcaacagctattcacaagaaggatcaaaccaagtacgatgcctttttgaatggctacatcatgggaacggacccttatcaatacacgccgttgtacacgtcaactggttttgctaactactggcagtacaaggatccaactattgataagttgtttacgaagggcgatttagagagttcagcgtctgctcgtcaagcaacgtacaagaagttacaacaaaagattgcggatgccgcagtgatgtatccaattgttgataacaagaagattttggtgatgaataaggacgtcaagggcttctctgaggcgaagactttgccagtttacacatttgctgactggtcaaagttgtcaaagtagacgggagacgcatatgttaaaaacgatttttagtcgtttgctgcaggcgattccgttattaattgtgatttcgtttttagtctttggcatgatccatctcgcaccatttgatgcagtcgatgcaatcattaaacctaacatgtcacctggtgttgttcatgtattacgcgaacgttatggtttggacaaaccttttctgacgcagtatgtgttgtggcttgaaaattttgtcatggggcattttgggcactcgattattaaccaacaagatattggtcaggcgttggatgaacgaatccccaacacggtcatcttagtgttgcctgcgtatgcgacctcagtggtaattgcaacagtgctaggcttgatcggcggtcgtgcaccacaaagttgggcaggtcgggtgattgatacggtgactgcggttggtttagcaacgccgtcattctggatagcactattgttaatttacttcttgggctacgcagctaatttattcccgctctttggaatggggagtgcgcatcagccactcgacgttgtgtggcacatggtgttgccgtatatcacattggttgtggcgtacttcccggagctcgcacggtatgtccaaagtaaaacaattggtgaataccaacaggattatgtgatggtccaacgggcgttcggtgcaactgaacgacaaattctattccaccacgtgttaccaaatgtcctgttgccaattgtgacgcaaattgggcaatcgttaccattactcgtaacgggcgccatgattacagaaacggtgttcagttggccaggcgtggggacttacatgatggatgcatcagtcaagctagattatccggttattttagcggtcatgttgttgtcagcgacgttggtggtaatcggtaatttgttagcagatgtcctttataccgtggttgatccgcgggttaggaggtaatcatgcgcgaacgatttaaaatgaccattcggcaaaagccaacctacttaacgtggttgattgtaatggcagttctggtcttagctgtcttattagcaccaattttgcccttacatccaaatgcggtcgacgtggtacacatgtctcaaggaccaagctggcaacattggtttggtactgacgatttggggcgggattatttagcccgcgtcgtgtatggtggtcgcatctcgttgggggttggtttcctagcgatgttggtatcggttattctcggtaccactattggggtgatggccggttatttcggtggcctagctgatacggccttgatgcggttactagatgtgttttcatcggtgccatggttggtcttggttgtggtattaagtgcattcttacgaccagggctaactacgattattatcgtaattagtgccttttcatggatgtcgattgcccgtttagttcgggccgaaacggtcacggttaaggaacgagattttgtgaagtacgcacaatttgtcggcatgtcgccttggtatgtcatgtggcatcatattttgccgatggtgaccccaattattgtggcagctgcaggcgcgaatattgcgaatgcgattatgacggaatcggctttgagctttttggggatgggggttcaagacccagctgcctcatggggttcgttgctgaacgccgcccagtcacggttgcaggatgcgccgtacatggcaattattccgggcttgtttatcatcatgactgttttagcctttaataaactgggtaatttactacgagatatgacatcaccggaggacaatcatggttaaacctattattgacatgcagggcctgacggtgacggttccaagcaaacaggggacgatggtccctattttgaatggggtgaatttaacgattatgcccaatcaagtattaggcctagtcggtgaatcaggttctggtaaaacgatgaccatgcgcacaatcctggggctgttaccgaagggtgcaaccgccactgccgatgtctggcagctggcgggtgaaaatagcccggttggccaacaccagcagttgcgaatggcgatggtctttcaggatcctttgacgggcttgaatccggtccggacgatcggctttcatttaaccgaagtggttaagcgagtccatccacgttattcacgtttgcaacaacaagctgcggcagagcaggcacttgaaaaagtgaatattcccaagccaacgcaacgactaaaacaatatccacatgagttgtcaggtgggctgcggcagcgtgttttgattgcgatggccttattggcggaaccagatgtcctgattgcagacgagccgaccacagctttggatgtgacggttcaggcacaaattttaaccttgttaaaagaactgcaacggacagaggagttgacgatcatttttatcactcacgatttaggggtgatttcagcagtcgcagacaatgttgccgtcatgcgggatggtcagattgttgaggcggggactagcgcagatattttccaacaggcgcaacatccgtatacgcaggccttattagcggcggtaactgccgtaacagatggtcacgcaagtagtttacagactgtgccacataccgatagacaacaacatgaagaaatctggttgtcggcaacacatcgtgtcctagggggtgtaccagatggccaatgagttactaaaactaacaaatattacagtgcaatacccagggcgacatggtaaaccagagttagtggcgctagatgatgtctctttaacaatttacgaaggtgaaacgcttggcttggtgggggaatccggttcagggaaaacgaccctcggtcaagtggcgttgtcactattgcagccgacttcgggtgaaatagccttcgctggtcagccaattacgaaacacaatcggcggaccgttatggatgacatgcagctgattttccaggacccctatgaatcattgaaccccaagcatactgccttagaattggtccgtgagccattacgacgacactttgatctgtcgactgccactgagatggcaacacaggcacttgcagcggtggggctaacaccggcagacggtgaaaaatatccagtagcgttttccggtggtcagcgccagcgcatcggtatagcccgggcgattgtcggtcagcctaaatttatcgtggctgatgaaccaatttcagcgttagacgtgtcgattcaggcgcaagtcctatcattaatgatggcattgcgtgagcaacaagcgttgacctatttgtttatctcgcacgatttaagtaaggtgcaggccatctcagatcgtgtcgcggtgttgtactttggccacttagttgaattaggtccaacggcggccatctttgaaaacccgttacatccgtatacgcaagagttgcttgctgcaatcccatcgattggtaaaccactaatcgcgcagcaacggcaaaccattacggttggcacatcatgggttgaagtgacgccagggcattttgtccgacgataacccagatgaagctaattgtcagggccgggacaaacgggagttgttcagccttgcaataattagccagtagcagttggagtaagcaggctaatgtcagccaaagtaaccagttggttccagttaaccaacaggcaccagctgctaatatatccaaatcgccatttccaagaaatttctcttggaggtggcgatttattattaaagcaacgatatatgacacaaaaatagttaggcaggggagatcatgctgtaaacaagcaatgaaagttggacaggctaaccagcgcgaatcaattaatttcatttgccaatcttgttttgctaagatgaaaagtggcataataatgaagacttctaaatagtgcataacgtcatcctttgtctgtttgctgattaaagacgtgatatggcgcagtttttccaaaaaagacacgcccggaattgtttgcaaaatgaatgcctatataaaggcatttttaaacgactaaaagggttgcaacatttagtaagcagtgttatattattatttgtgcttttagtgagcagggtgtttgcggtgacgcgacgtgctgaactcgtgaacgaaaagtaccattcagctacgtttttagacttgttattaaatgacacgcctggaaatgtggactacacattatatagaaaattgaaaggggactcttagacatgcctactattaaccaattggttcgtaagcctcgtaagtcaaagagcacgaagtcaaagtcaccagctttgaacttcggttacaactcacaatcaaagaagacgactaatgtttcttcaccacaaaagcgcggtgttgcaactcgtgtcggaacgatgactcctaagaagcctaactcagctttgcgtaagtacgcccgtgtgcgtctttcaaacttgatcgaagttacggcatacatcccaggaatcggccacaacttgcaagaacactctgttgttttgatccgtggtggacgtgttaaggacttgcctggagttcgttaccacatcatccgtggtgctttggatactgccggtgttgacggtcgtatgcaatcacgttcaaagtacggcgcaaagcgtcctaagaagaagtaattaagggaggacatataaaatgccacgtaagggttacactaagcaggctgaagttctgcctgatccaatttacaactcaaagcttgtttcacgtttgatcaaccgcttgatgcttgatggtaagcgtggaactgcttcaactatcttgtacgaagcattcgatcgtatcaaggaagctactggtcaagagccattggctgtgttcgaagaagctttgaacaacatcatgcctgtattggaagttaaggctcgccgtatcggtggttctaactaccaagttcctgtcgaagttcgtccagaacgtcgtgtaacgttgggattgcgctggttggtgcaatactcacgcgctcgcggtgagcacacgatggatgagcgtttggctaaggaaatcatggatgctgccaacaacactggtgcatctgttaagaagcgtgaagacacgcacaagatggctgaagccaaccgtgccttcgcacactaccgttggtaataaccaattgatggctacagtcgatatgacagtagccatttttgtataacttacggtataatagaaccaacgcaactaacatgtgttggatgtaatagaatttcaaggagaaatactcatggctaacaagcgtgaatacccattgctacgtactcgtaacattggtatcatggcgcacatcgacgccggtaagacgacgacgactgagcgtattttgtactacactggtaagatccacaagattggtgagactcacgacggagcttcacaaatggacttcatggatcaagaaaaggaacgtggaatcacgatccaatctgctgccacgactgccgtttggcgtggattccacgaccaatacgacaaggaaccataccgtgttaacatcatcgacacgccaggacacgtggacttcactatcgaagttgagcgttcattgcgtgttcttgacggtgcggttgccgttcttgacggtgctgccggtgttgagccacaaactgaaacagtttggcgtcaagctgagacgtacgaagtacctcgtatcgtcttcgttaacaagatggacaagatgggtgctgacttccaaatgtcagttgactcattgaagtcacgtttggacgctaacgcaaaggctgttcaatggccaatcggtgccgaagatgactttgaagccatcatcgacttgattgaaaaggttgctttgtacccaatcgatgatttgggtgaaaagtgggagaagcgcgaaatccctgctgactacgctgagttggcagaggagaagtacaacgaattggttgaagccatcgctgatgttgatgacgatatcatggaaaagtacttgggcggagaagaaatctctgaagcagaattgaaggctgctatccgtcgcgcaacgatcgctttggagttctacccagttcttgcaggttcagcctacaaggataagggtgtgcaaatgatgcttgacgcggttgttgactacttgccatcaccaatggacgttaagccatacatcgcaacggacccagatactgaagaagaagttgacttgattgccgacgatgacaagccattcgcggctttggcatttaaggttatgacggacccattcgttggacgtttgactttcgttcgtgtttacacgggtactttggagtcaggttcatacgttttgaacacgtctaagggaaagcgtgagcgtgttggtcgtttgctacaaatgcacgctacgaaccgtactgaaatcgacgaagtgttctcaggtgatatcgctgccttgatcggtttgaaggatacgacgactggtgactcattgactgctacggatcacccattgatcttggagtcaatggagttccctgacccagttatccaattggctatcgagccaaagacgaaggctgaccaagacaagatgtcaactgctttgcagaagttggctgaagaagacccatcattccgtgctgagacgaacccagaaactggtgacacgttgatctcaggaatgggtgagttgcacttggacatcatcgttgaccgtttgcgtcgtgaatttaacgttgaagctactgttggtgcgccacaagttgcttaccgtgaagcattcacgcaaactgttcaagcacgtggttactttaagcgtcaatcaggtggtaagggacaatacggtgacgtttggattgaattctcaccaaacgaagaaggtgccggattcgagttcgaagatgccatcgttggtggtgtggttcctcgtgaatacatcccttcagttgaagctggtttgaaggactcattgaacaatggtcctttggctggattcccattggttgacttgaaggctaagttgtacgatggttcataccacgatgtcgactcatcagaagctgcctttaagattgctgcatcattggctttgaaggaagctgcaaagactgctggtgccgttatcttggagccaatcatgaaggttgacatcgttgttcctgaggataacttgggtgatgcaatgggtcacgtttctgcccgtcgtggtatgttggaaggacaagagcaacgtggtaactcaatgatgatccacgctaaggttcctctttcagaaatgttcggatatgcaacgactttgcgttcagctacgcaaggacgtggaactttccaaatggcctttgaccactacgaagctgttcctaagaacgttcaagaagacatcatctcaaagtacggtaagggttcagacgctgagtaattttaattaccagcgactcacttactaattgagttgaaaaattaaggatgaagataattctttcgagttatcttcatccttttttgtttggttccagtccgatttcgtggcctttttttcaacaatctgcttaaatagtaagcgacatgtattaataaacgggaaataatcgggacaaaactgccgtattgttataatcaaaggtgttgttagtctgatttacctcaattctcactactaataagaattggactagcaacatccccgtgagtcggtttgaaacaggagtgttttgaaccgctttttttagagagtcgcagagtttagaggagagtttttgctatgttaaagacaattggtcaagtgatcaatgatgtgaggcgagagaaacatatctctttagcgcaaatagcagatttgggcattagtaagtcccgctattatcggtttatcgatggtgaaattgatatgccgatgtttgacattatgacgattatggacgcgctgaccctatcattcgcagaattgggtcagttgaccaataaagcgtgcctacaggatattacgctacattggttgttaacaacagatattgcggaattgactgatcgcgcgaacggatcagatgaacaggataccgattttcggcggttgatttttgcctatgcacttgcattgcgtgaagataatatcaaccgagatcaagatgaggctatttttcagcgtttagtaaccttggaggctttcacacttattgacttggttggcttcgcattaattgcaccgaccatctcagctgataagttcaaattattgtatgttcgttacgctgctggcatggctaattttcagaattttttgaatagtgatatttatgatttggtattaacgattcacatggctgcaattgataaattactcttacagccggagaatcgtagttacaatagtacgatgtttgtaattgaaacaatcctaaatcaatatacagaaccacaatatatggaactgcgattactgcagcaagtcatgcaattgctaaagacaaccactgatggggtgacgtttacgacgactaaccgaatgacaacattgcttttaagcgccaagacacatcaaattgcagtgatgacgacgcgcttaatgagcctcgatttgagcgcgttgtggactgaattccaagttggtgcgtcaaagttttgggtaaagccgagtgaacatgtgcaactaccgaagttttcaacgttaccaccagaagaaatgtttaatcactacggtgacgtgttccgctggattataaaacaaaaacatgtgacgcctggtatggttgttgacgctggtgtttcgacttacaagctatataaggcttacaatgagaatggttatctgcaactagaagaattattgaaattaatgcacctattagacctgatgccaagcgacatcgatgttgttttgcgacgccgtttgattaatgtcactaactcgacttggtatcaatatagttggcaacacattcaaccacttggctatgatgcgcttgcaaggtcaatgcagttaaaatacgagactgatcaccaacgcaaggatttggaggcatacttcgaatttaaggccttggatggattatttgtgcatcagaattggttacaaagtccagcggctgctgaattaagtaagacaattagtgatgaattgatggcgatggaaacatggacgtacgcagagttccgtgtggcacggtatgccatgttgcacatcgaaaatccggcaggtattcagatgtgggcacaattgttgaatcgggcgatgaggaaagttgatcagcgttacatcaaccgcaatacggtgcttgatattttcgaatggcctttgttacgggctatcttgctggggaagcgagaattagcagaaaccttgttgcaggtggcacaggtgcctgatactgatccggctgatgtgatggtgtttggacgtggtcagcaacgcttatttgatatttacgcggctattttgcatgatcacccccatgcgcgacgtgatttacaagagcatctaagtgattttgttgtgctagctggtgatcgtaagttcagtgatgcctatcaaaaaatcctacgaccattgtgggaagaatagtaaaaaacacacgcttcgagttgtcggagcgtgtgttttgttatgtaccgtaacatacaaaattgcttatttttggtaaaataaaggttatgtaaagaaaggtggtactcagtaattggcacaacccattattgaatttaagcacgtggctaagcaatacgatgatacagtcgtattgaagtctgtcgatttagaaatcgaagcaggaaagttctataccttgttgggaccttctggatcaggtaagacgacgattttacgtttgattgctggatttttggaagcctcatcaggtgacatcctgtttgaaggggaacgcattaatgacgttccagctgaaaagcgccgtgttaacacggttttccagaactatgcattgttcccaaatatgaatgtttttgagaacgttgccttcggaatgtcgattaagggtaaaccgaagaatgaaattaaggccaaggtcgctgaaatgcttgaactcgtcaagttgggtggctatgaggaccgtgaaatctctgaattgtctggtggacaacaacaacgtgtggcaattgcgcgagcattggctaacgaccctgaagtgttgttgctcgatgaaccattgtcagcattggattacaagttgcgtaaggacatgcaatacgaattgcgtgaaatccaaaagcgtttgggcatcacgtttatcttcgtgacccacgatcaggaagaggcgttggcaatgtcagactggattttcgtcacgaacgaaggtgaaatcgttcaaaatggtacaccagttgatatttatgacgagccaatcaatcatttcgttgccgactttatcggcgaatcaaatattgtacctggtgtaatgcgcgaagactatttggtgtcatttgccggcaaggaatttgaaaacgtcgacggtggtatgcgaccaaacgaacaagttgaagtcgttttgcgtccggaagacttggatttggttgctgaagaagatggtaagctcgttgtgacgattgatgaccaatcattccgtggcgattactacgaaatcactgcgcacgatgatgatcaaaatgaatggcaagttcaagcgacgaacccagctgttattggcgagcgacgtgggttgtacttcgaccctgaagatatccacatcatgcgtttgaatgaatcagaagaagatttcgatgctcgattggagcaatacgacgattctgaggaagacgaggagggcgctgatgagcaataagagaactttcagctacaccgttccgtacattttgtggctcgttctctttgtcgttgcgccagttgtgctgttgattgtgcaatcatttggcaacatctacggccactttacgctcgacaactacgcgacctattttagctcaggaacgtatttacggatgacatttaattccgtgttctttgcctttattgtgacggtaattacgttattaattagttatccaatggcttatattatgagccgtttaaagaatgcccaattctggttgttgttggtcattttgccaacttgggtgaacttgctgctgaaggcgtatgcgttcatcggtctgttctctaagacaggaaccgtgaataactttttgtcattcatcggtattgggccacatcaaattatgtttacggacacatcatttatgattgtggcggcgtacattgaaattccatttatgattatgccaatcttcaattcattggttgaattagatcgtagtttgattaatgcagcccgtgatttgggggcaacgccttggcaaacgttgactaaggtcatcattccaatgtcaatgagtggcgtcaaggctggtattcaagcggtctttattccaacattgtcattgtttatgattacgcgtttgattggtggaaatcgtgtcattaccttgggaactgccatcgaggagcacttcttggtgacgcaaaactggggaatgggatcaaccatcggcgttattttgattatcgcgatggctgcaacaatgttcttcacgcgtgatcgtaagaagaagggaggtcgccgtcgtggataataagccaaagaagtggtcgtacatttacttggtcttcgtgttcatcttgatgtatgcgcctatcttttatttgattttctactcattcaataaaggtgactatatgaatggctttgacggcttttcattgcgtcactaccaggacatgtttgcggatacacgcttgatggaaatcttggtcaacacgtttatcgtggctttgctgtcatcagtgctggcaacgttgattggaacctttggtgctttgggcatctacaataccaagcaccggacgacgaaaaatctattgttgtcattgaacaacgtgttgatggtgtcacctgatgttatcatcggtgccagcttcctgattttcttcacgatgattggcatgagtttgggcttcggatcagtggtcttgtcccacattgccttctcaattccaattgttgtgttgatggttttgcctcgtttgaatgaaatgaacccagccttgattgatgcggcccgtgatttgggtgcctcaaactatcaagtattgtcacgtgtggtgttgccatatgcctggcctggtattttggctggtttctttatggcgattacgtactcacttgatgatttcgcagtgacgttcttcgtaacaggtaatggtttctcaacgttgtcagttgaaatttactcacgtgcccgtcaaggaatcgatttgtcaattaacgcgctgtcagcgttgatgttcttgttatcattgctgttggtaatcgtttactacttcatttcaaactacagcgtgaaatcaagtaagaagaagcgtggtggcgcagcaggaatggtggtgcatcaataatgaagagattagcatggttaactgggattatcctggccgttgtcgctttgttgttcggtattaacgttgcgctacaaaagtcggctgaatcaggattgaagaccggttcaaataagaccttgacgatttacaactggggtgactacgttgatccgtcactgattaaaaagttccaaaaggaaacggggtacaaagtggactatgagacatttgactcaaacgaagcgatgtacacaaagattaaacaaggtgggacgcactatgatttagcggtgccatcagactatatgattcaaaaaatgaagaaggcccatatgttggttaagcttgatcacagtaagttaacaggcttgaacaactatgataagcgcttcatgaaccaaccatttgatcgtggcaatcaatactcagtaccttatttctggggtacgttgggaattgtttataacgacaaatatgttaaggcgggcgacattaagacgtggaacgacttatggaacccgaagtacaagaattcaatcatgttgattgattcatcacgtgacatcatggggatgacgcttgcttcaagtggcgagtcggtgaatactaaaagtattcctgaattagccgcagcgaagggaaagttggacactttgatgccaaatgtgaaggcgattgtcgccgatgaaatcaagatgtacatggcccaagacgaagctgccttggcggtggattactcaggggatgcagcggaaatgattgctgaaaatagccacttgcattacgtggtgccatcagatggtggtaacctctggttcgataacattgtgatgcccaagacggttaaaaataagccagccgcttatgctttcttgaacttcatgagccaaccagaaaacgcagcaaagaatgctgagtacgttggttatgccacaccaaataaggccggtaaggcgctgttgccaaagtcaattcgtgacgataagcaatggtacccagccgaaaagaccttgtcgcacttggaagtgtaccaagatcttggcccatactgggtcggccaatacaacgattacttcttggaattcaagatgacaaatcgttaaatctaaacgctactggatgtaaggttcagtagcgttttttgttgtgtccgggaaatagtttggggtagttctgattagtgaacgtgacataataatacgggaaattttatggtagatgatttgttgcaggtaaactaacttatcaggagggggttttcatcgctcctgataggttaattatgcggctactcacgtttaaagctaaatttacctacttttagatgcaagttctctctcgaattttcttgtttctaaaacccgggttcttccctgcccggatacatattgaagcaacgacttgatgacaaaaaaattatcgagtagctttacaattatttatggattactgaaatttgatgtttttctaaagctaagcaacgtataattagctgtactgcgtcttagcagaataacgacaggtgggagttttaatccatgaaaaagattaaaccagaaattattattgctgttgtggctgtcatcttggttgctgggggtgttggctttgccatgaagtcagcacaacaaccaaatgtaccaacaccacaactttctacaaaggtcgccaagaaagagagtgaagtggtgatgcatacgtcaaaggggaacatcaagattaagttgttcaacaagtatgcacctttggcagttaagaatttcattacgcacgctaaaaaaggttactataacaacacaacgttccaccgtgttgtaaaggactttatgattcagggtggtgaccccaagggaactggccaaggtggtgcgtcaatttggaagggcaagaataagaagattgatagtgggaatggtttcaagaacgaaatcagtaagtcactattcaacattcgtggggccctatcaatggccaacgctggtgctgataccaacggttcacaattcttcattaaccaaaacagcgatgatcaaacaagcaagattagccaatctgattatccagaaaagattttccaagcctacaagaagggtggaaacccatcattggacggatcttacacggtctttggccaagttatttctgggatgaaggttgttgatgagattgctgaccagaaggtaaaggataatggctcaggcgaaaagtcaaagccagttgatccagttaaggtcacatcaatcgatgttgtgaaggaagcaaagtaaagcattcataaaaaatgccatgcctcaaagttgagacatggcatttttacgttaaccagcactttccgtttgggcatcacgcgcagcagcggtgttgttgaccaaaagttggaaatagttatcaaagccgggcttatcatagctttgcatcaaagcgataaaatcaaccgttgaccattcacttacaatcacggcaccatcattatattgcaatgaacgtgcaattgatgaggtgttttctaccaagtagaaggtgtcgtttgtgtctaagtacaagagttgcaatttaatattacgatttgcacccaatgcagctttagttgccaaaaatggatctgacactagacgctgactaacattctcgtgacgaaacttgtgaatcgtctccaacgtgttaccgataatcttcatagatggatcctcgactttatcgaataatgagaaattaaaaattactctaataacattttaataaaacgttgatggatattatcataccactagttatagaaaagggctagatggttatgtgtccaaaaaaagaaagacatcaacctgcgagtttggtcgacgtctttcttgttcttttaactattgaacaatcaaaacgtctgacttggcgttttgaacaacgaatgaggcaactgaaccaaccaacaaacgctccaacgtgttcaagcctgacttaccaagcatgatcaattcgttaccgtggtcagcagggaagtcgcgggcgataaccgtctttggtgaaccaaaacggacgtggatgttaacatccttagcgccttcgttgtgagcaagttcttggtacttagccaacttttcttcggcgtcttgtaccaattggtaaaccacatcaccagaaattgacatgccggccaagcctgacaatgagtttgtatcgatgacgtacaacaaatccaacgtcgtgttgttacgaacggcaaccgcagctgccttctcaactaacaccgttgaaatctttgaaccgtcaacgggcgccaaaatgttcttgtatgcaatcttatcttctgccatggttctgtaccatccttttgtaatccttaggaagcacatatgtatgtgttcctttgatgtattttattatatacctaatgatacaataatgtaagcgtttaccgtgagatatttatgagattaaacaatgattggtttttgtgatttcatttgcattatagcccaaaatgttgagaaagtttgtcattacgtgtccaaatttcttttgcttgcggatggttagccgagtgtgtataatactacctatgcgatgagtcgagaagatcatgttctgatctttgtaaacggtcctcatataacagccgcattgctggaggatgagatagggagttgtggaactcgcttctctgcacatgactaacttcggtttcgaccgttggtgtacgttgactggtgggcaaccaccacatgagctagagcatgtcaattctagcattgccaagcggaaaacgtcggtcttcggaccggcgttttttgcatccaattgtgtcctgaaaatagccaatttaaggtcatatgtagttttatgcgctataatatgtatgtaagttacatgcgattgggggatatgaccatggagaagctaattcaaattcgtattgaagaagaaattcgtaatgcagccgatgaggtatttcgtcgcaatggtttaacaacgcaacaagcggtaaaaatgtttttgacacaggtggctaataacggacaatcaccatttgataatctgtttacaccaaaacaacagtagtttgaaaaaacgccatttgtgtgatgcaaatggcgttttattgtttcttcataacatgttgcgatatggtttgctataatgaaagtattaaaacctgggggatgaatatgaaaacagttacttttcgtcgtttctcgttttggcaacgattgctaatcaatacagtgatgttgcttgctttggcgggattgttccaccaaggtctttacattagtaactttgtgacagccatcttagcagcattaatcttaggtgtgttaaatgctttggtgaagcctgtgctccaaatattggcgctgccatttactattttaacttttggcttgtttgggttgatcgtgaatggggtagtactttggctcgcttcgcagattattggggatgggttccgctttgctagttttggctgggcggttttcatcgcagtggtgatgtcgattgttaatttgattatctcaagttactttagtcgtaaagacgacgctgaaaaataaggaagacaacggatatggcaaagaagattacagttaaagatttgctggccaacacgcacgtaaacttggtggctggtgaggagtatctggatcgcgaaattacaacggcagatatttcaaggcctggtttggaaatgaccgggtacttcaattactatgcaccagaacgcgtgcaattgatgggaattacggaaacgtcatttgcccaccgtatgaaccacgatgagttattgatggttgcacgcaagatgatgcaacccaatacaccagcttttgtcgtttcaaccggacgccaattgcccgaagagtttatgcaagcggcaattgaggcgaagattccggtattggcaactgatttgacatcatcacgaattttgtcgaatatgacttacttcttaagtggtggtttggctgaacgccaatcagttcacggggttctggttgatatctttggacttggtgtgctgatcaccggtgattcaggggttggtaagtctgaaaccgcgctagaattggtgcaacgtggtcaccgtttaattgcggatgatcgtgttgacgtgtacgcgcaagatgaggaacgccttgttggtgagccacctgctattttgcgtaatttgatggaattgcgtggtgttgggattattgatgtcatgaacttgtttggtgctggtgcggtgcgttcacacgcaacgattgcctttaacttgcacttggctaagtggacagatgatcaaaaggttgaccgtcttggaaatggtgaagagaacattcgcatccaaggtgtcgatttgccacgctttgtgttgccagttcaaaccggtcgtaacttggccgttttgattgaaacggcagctaagaatttccgtgctaagaagatgggctttgatgcaacggaaacatttaatgataatttaaatcgtctaattgccgaaaattcggaaaattaagcgaaattattaagaaaaccccgttgtgacggggtttttcactttaaagcattttcaaattaatggtttatggtattattattgtgttagttttggcgtcagaccagcactaacaacaaggaggaacattgtgagcaatgaagtgattgcagtgcttggcgccggttcatggggaacggccctcgcaaatgttgctgccgagaacgggcatgacgtgcgcctttggacgtacaagcctgaacaagtagttgagattaatgagcaacaccgcaacagcaagtatcttggtgataacccactcgacgagggtgtcgttgccactgcagatatgactgaggctgtgcgtgatgcaaccatcgtgttgagcgtcgtgccaacgaaggccacacgtgaggtatcaaagcacttgtctgaagtcttggcagagttggatcaacaaattgtgttgattgccgcaacaaagggattggagcctggtacttataagcgcgcatcagagatgcttgctgaagaggtaccagcgacgcaacgtttgggacttggaattatttctggtccatcacacgctgaaggggttatcaagcatgacccaactttggtatcagctgttagcgaagatttggcaactgccgaacgtgtgcaagcagcttttactaataatgtcttccgtgtatacacgaacactgatttgattggagccgagtttggggcggctctcaagaacgtgattgctattggtgcaggggcccttgagagcctgggatttgatgcaaacgccaaggcaggattgttcactcgtggattggctgaaattagccgattgggtcaagcattcggtgcgaacccaattacattcatgggcttgtcaggcgttggtgatttgtttgttactgccacatcagtgcactcacgtaattatcgtgcaggggtgcaattgggtgaaggtaagaagcttgatgacatcgtcgaaaacatggggatggtcatcgaaggtatttcaacgactaaggttgcgcacgagctagccttgaagaagcacgttgaaatgccaattacatctacaatttatcgcgtcttgtacgaaggtcaagatatcaaggaagccatcaatgagttgatgggtcgtccagtttcacaagaagggaagtaaattcatatgaagccagtacgtaaggctattatcccagcagcaggtttgggaactcgttttttgccagcaactaaggccttggccaaggaaatgttgccaatcgttgataagccaacgattcaatttatcatcgaagaagctttggcttcaggtatcgaagatattgttatcgtcgatggaaagtcaaagcgttcaatcgaagatcacttcgattcaaaccctgagttggaaaacaacttgaaggaaaagggtaaggatgaattgttgaagttggttgaagagacgactgacatcaacttgtacttcatccgtcaatcacacccacgtggtttgggagatgctgttttgacggccaagtcatttatcggcgacgagccattcgtggttatgttgggtgatgacttgatggcagatgagacgccattgacgaagcaattgatcgaccgttacaacacaacgggagagtcaacgttggctgttatgaaggtgcctcacgagcaagtttctgaatacggtgtaattgcacctgaaaaggaagttgaagacggcttgcaccaagttaactcattcgttgagaagccaaagccagaagatgcaccttcagacttggccatcatcggacgttacttgttgacgcctgagatcttcgaagaattggagaacacgaagcctggtaagggtaacgaaatccaattgacggacgccatcgattcattgaacaagcgtcaacacgtatacgcccacgaattcaagggtaagcgttttgacattggttcaaagattggtttcttgacgactaacatcgaatatggtttgaaccacccacaaacgggtgaagctttgaagcaatacatcaaggacttggccgcaacgttggactaagccaaaataacgattaaaaacaggactttctcctttttgagaaggtcctgtttttttagaataaattggttaatggtatatacgtatttccattggaaaggataaatgaaccttaaaatttcccggttttgagacactgttgttgagaatagttcaccaaaatatacactacgggactgaaaattcccgcttaatagtaaattgctccgctgacgaaagtatagtgttatcatgctctttgttaatgttaggtatggttacttcatgatttagtgaagacttaacgcaaacggtatggttatacagaggaaagtgggtaaaaagaggaatggttgataaagaaaccaatcgccaaacaaaagtacacttcaagatgtacaaggatggtaagcagtgggtcacccgtggcctggcactatttgcagtgtcattgatggtcggcggccccgttgcaaacacattaactaatgtgaagaataacgttgcatttgcacagacaacagatagttcatcgagcgattcagttgctttgacaagcactaacaacgttgtttcagctaatcagaaactaaacgctgattatgcagcttggcagaagcaagaagttgaactgcaaaaggacgcaacattcaatcaatttatgtttatggatgatgttgttcgaaatgcggttttggatggtcacaatgcagctggtcgtggggattatgctggtgttgtctcagccgacgcccagttattgcactatgtatcaattgtgcaagaagcattacgtttactgaaaacggttgacccagcaacgaagggatacaatgatttgttcgaggatttgcaccttgcaaatcaacacgatcctaaggcggttgaggcacacgtcattgcacttggtggtgtcgtcaatgatttgactaatgcaaatgactttgatgatacaaaagcacctgatatggcaggtgataagacaccagcacaaagtaatgatttgacggaccttgaaaaccgcattcaaaattactatcaaaatcacggccgatttggtattccggctgcagtgattaaggatgtatacaacgagattgtagcagaagagacgacgccatcaaagagtgctgatgctgacgaagttaaggtattgcaagatctctttaccaagatgaagcaagcagacctagcttacgtggacagcactgtgcatgcagttgttgcccaggcggtcgatgataataatcaagcaacacatgatggtgtaccagcttcagtaaagagtgctgattttaaggcaattaatgatgcggctacgaagattttggccggtatggataccattgaaaatgatgcacttgatgaccattacgataacatccatattcaagttaacaacttgcaacaacaagtggatgatttccaaaagaagattaatgattataaggctgatcaaattcatcaagctgctcaaaaaatcgtggatgccaaaagcgacgctgcacgaattggtattcattcttcggatgttgatgacttgttcaaccaggggatggctgaagcaggaaagccatcctcaactaatgtgcgcgatacagttaagaaattgaacgatatcgctgagcaaatgaaaacggcaacgaagcagtcttgggacgatcaaattggggcatttatgtctgacgtgcgatcagtttacgccaaggcaacacatgatggtgtgccagctagtgtgaaggaaccagcctaccaggcgcttgttgctgaggcgactaatcaaactcaccctgatagcctggggctggagttacagacgttaggtaacttgttgcaaaagatgattgatgcaattaacgcttataagccaattgatttaccagctggttcgacagcagcaaatcaaacggccgttgtatcagatgctaatagcttctttgcaagtaacttaatggatcaaggacgttcatcgtacggatcaatggcccaatctttggcgacgtcagcagctaaggattcagcgttgagtcaaattaatgtcgatgcaggtgctaattcgggtaaggtatcagatagcgacctagcagccgacgtgacaaatgcaacttcaggtattgatagtgcagctaacgtttctgatgttaatagcattgttaactcgtatgagagcaatttggtaagccaatctgttgccacgtcaaattcaattgccacgtcaattgctaattcagttgcggcttcagagtcagcgtcaatttcagcatcaacatcagcgtcaattgctaattcgttggttcaatctcaaattgctagtcaagctgagagttcagcagcgcaatcaatgatcgatgcgggtcgttcagcggatgcgtcacaagaggcgtcgctagcatcatcagcggcagcgcaatcaatgattgatgcgggccgttcagcagatgcatcacaagaagcatcattggcatcatcagcggcagcgcaatcaatgatcgacgccggccgttcagcagatgcgtcacaagaggcatcgctagcatcatcagcggcagcagaatcgatgattgaatcaggacactcagcagatgcatcgcaagaggcatcattggcgtcgtcagcagcagagaattcagcagcgcaatcaatgattgatgcgggtcgttcggcagatgcgtcacaagaagcgtcattggcgtcatcagcagctgagagttcagccgcagaatcgatgattgagtcaggccgttcagcggatgcgtcacaagaggcatcactagcatcatcagcggcagcagaatcgatgattgaatcaggacactcagcagatgcatcacaagaagcgtcactggcgtcgtcagcagcagagaattcagcagcgcaatcaatgattgacgcaggacactcagcagatgcatcacaggaagcatcattggcgtcatcagcagctgagagttcagcagcgcaatcaatgattgagtcaggccgttcagcagatgcgtcacaagaggtgtcactagcatcatcagccgcagagagttcagccgcacaatcaatgattgaatcaggacactcagcagatacgtcacaggagtcaacgttggcatcatcagcggccaactcagcggcgcaatcgatgattgagtcaggtcgttcagcagatgcatcacaagaagcgtcactagcatcatctgctagtgcaaagtcaatgatcgaatcaggacgctcagcggacgcgtcacaggagtcaacgttggcatcatcagcggccaactcagccgcacaatcaatgattgaagcgggccgttcagcagcgatgtcacaagaagcgtcattagcagcatctgcctcagcacaatctttgattaacgcaggacgtgattcgttgattgcacaagaatcacaattggcttcagaagcagcacacgagaagagcgtggctgatttcaataaggcaaagagtgatgcggtagcttcaactaaggctgaagctaagtcaaagggtgttgcgaacgacaaggacgtcgtaaaggccatcgaacaaattagcaaggcaacggatcaaaagtcattacaaaatgcggttgatcaagcagcgattgcgattgctaatgcggttgatcgtgctaagaacgctaagagtggtcaccgcgatggccacacaactagtggtaataacaacactaagggtggtgctactaagaaccaaaacccagaacaaggtcaacaaggcattgttaatggcggttcaaacggtcaggcaaatccaggacaaggtcacaacggcactaagggtgataaaaatggtcaccagaagtctgaacaaggtcaaggcattgttgctggtggttcaaatggcggttcatcaaatggtggcgtcaatggtaaccaagtagctggtcaaaatggtggctacacagacggctcaaacgttgctggcgtaacgaatggtcaagttgcaggtaataatgcaggtgatgttgtgttgccaagtttgaatggggtgtcaacgactaacgtgtcaacgccaacacagtcaacaactggtaatgcgacggctggtgcagtgacgccgttggtaaatgcgacaacaggtacaaataccacgggagcagcaactgccggtacaacgactggtagtgtaccggtacaagcaacgggtgctacgtcaggtacgacaacaactcataacgataagcctacgaagactaagacagcagccaagacagatactggtacggccacagttcaaggtgcgacgggatctgcagctgatccggccacacgagcattgcgtgattcgcaaatgaagcacaatgacaatagtgcattgttgacatcattgctatcattgttaatcgctgcagctgccggattctggttcttcctatggaagcgtcgtaaggatcaagaagagaagatggacgcgaactttgctggcgatgatgaggcattgtcaaacgaagttaagaacattaaagattcttggaagtaattaaataggtaattaaggccggtaaatgggacttaattgccatgcaaagcgacattttgactgatatttcggtcagaatgtcgctttttcaatgaaatgattagagttatgtcataaaacgtgcaacgacggcgtttttggcttactataagtaacgaagagttttaatcaactttcaattagggagcacgaattatcgtctcgagagaaaggggtggatgcttgtgttggagagagcacaaggtcacggggaaggtacaacccgttttaagatgtacaaagatggcaagcgttgggtaacacgaggcttgactgttgctggggtagctctagtggtaggagcgcctgtggcgacggcaacaatgcagttagctagtgtatcaacaacgtatgctcaaacggtgacgagtcggcaattgacagcaactgagactgatcaaattagtcgattgcagtcggtgatggactcatatagtttcgtgcgatcaattgcattggatggtttgaattggcaagatgatttgacggcagcgtataacaacgcaacgcagatgattcaaaccattcagtctggtgaattcacgcacgcaaatggtgttcaaactgaaggcacaactttttctgatcaacaagtgacaaacgcagttaaccgcgttgaggattacgcgttggccattgaagttgcggacattcgcgcgcaccatgccggttggtatgctgaagtggtaaatggccaaaagttttcggacattcactatgatgttttgacatcttatgcaccgggtgcacaagatggttttgtttggatgaagccattgctgttggaaattatcaatggtaatcgcgctgaaacgaataatcagactaatgtggtgacgtcgtcagcagttgatgcccaaccagcaaatgtagctggttcggattactatgacaatacagctgcaaagtcatcagcagttgattcagcattgtcagtgcaagaatcatcagcggttgattcagcgttgtcagtacaagaatcgtcagcagttggttcagcattgtcagtgcaagagtcgtcagcagttgattcggcgctatcagtgcaagagtcgtcagcagttgattcagcgttgtcagtacaagaatcgtcagcagttggttcagcgctatcagtacaagagtcatcagcagttggttcagcactatcagtacaagagtcatcggcagttggctcagcattgtcagtgcaagagtcatcagcggttgattcagcgttgtcagtacaagaatcgtcagcggttggttcagcgttgtcagtgcaggagtcatcagcagttggtcctgctgtttcggcaagtgttagcggcaagtcatcaactatttccaacgctagtgctggatcgtcatcgttagttgaaggaccaacatcatcagcaaccagtagcacaactgctactgccgatgttgagcgaccagcgaatgcttcacaccgtgtaacggctagcaacaacacatcattcactaaccacggtcaggtaggtgatgatgtgagtgcgtcgacacatttgatgacgtctcaatcagttgcgcctgttttaagtgctaaggcggttaccttggatacattgccaacggttatggcaagtgatgcaggtcagacaactcgtcaggttgcgacagtaccaagttcaagtgttatggtttcttcaggtacgacggctgttgtatcaagtgccacaagctcgacaacagttagtgcgacatcaagtgcagcaagttcatcagttgttagtgcgacgtcaagttcagctacgacgcaaaacgtagcaagcaacaatggtgggacgccagcatcgacaactgctccgaatgttgccggtaacaatgcacctgcagctgcacctgtaaaaactgcggcagtagatgatggggcaacagttcaagccggtgtgaatacggctggtaacgatgccacaagtcatttgaatgacacgcaattctcgttgaatgacaatacccaagttttgggaactattttgtcaacaatcatcgcgattgcatctggaattgcctttaagattgttcgcagtcgtaagggtgcccatgcttctgaaaatggcgaatttgatgaagaagatgagcaattatttgatatggttgcaaaattgaaaaacttcataaagtagtagaagaatatttgctacgaactaataaatctccagtgttatcagctctgtttggctgacgaaactggagattttttattaatttgaaattgcgaaaccaaagccgtgtttttattttttgtaagcagtaaaattggaacataaacgaggaaatttgggattttgcctcgtttacgaaactgctgagagaggtttcaaaaacagggaaaggggtgttttcttatgattaaggagacacaatcaacattaaaaaattacgaacataaaagcaatcgacactgggtggcaagtggtttaactgcgcttggcgtgacagtcttgactatttcaccattggtcacaacgacaactagtatcttgcaaccaacgacggtgtttgcgacagataatgcacgcaacttaacggtaacggagcagttgcaaatcgcccgtctacaggctgctattaccaattaccaagccgttgcaaatgtgcagttgcaaaatgaagccggttggccagcacaattgacgcaagcaattgtggatgcccaaagtatgattcaaacaattcaaactgccagttatttaacgggcaatcgtgatcgtggtggtcaaccttttggtgatgatcaggtcacaaatgcgaccaatcgtattatgagttatgcactcgccattcaagtcgcccaaattcgtcaagatgatccagcgtggtatgccaagatgacctcaggcgctcttactagcaacattacgtacgatccgctaacgtcaattgcttttggcgcacaggatggcttcccttggatgcaggggatgctccaacaaattttggcagtgtatgcagataacacggcaaatgatttagttaactcagaagcgcccgttacctcatcggcagctgatgcatcagacgtaacgtcgtcaagtgctgtcgaggagtcaaacgcaacgccagacgagccatcttcaagtgaagtttcagatagtaccgtgtcatcgagcgctgctgatacgtcatcgagcgtagtagcgccatcagttagcgcgacaccagaatcatcatcatcatctgacagtgccgttgattcggcttcaagcacgactgcagacagcagtgtttcgtcgagtgcagtagatacatctgtcagcgcagtaacgccatcggctggcgtggcgccggatacgtcaggttcggtgagtgctggtatttcatcagatgtgacgtcagatacagctgtaagtacggcaacgtcatcggtcagtgtggcttctgagacgtcaacaaagactagcgcaggggcagccacatcaaacaagacaggtagcgccgattcatcaagtgcagtcaatccatccgtcacaaacgtgagtgatgtaactgttgcgagcccatcatcagttagtttggcgtcagaggtggctagtgcgacagcagatggcctaaactcgctggttgctaattcagcacccataactgaccaattgacgacattacagccaaatcaggcgttagctacaacgacgctacgcaatatgactaatctagctaatgggttaacgacggtggctgggggtgtaacgactatcccttcagcaccacaagcaagtcaagtaacccgtttcctagcaggggcggcatcagcagcgacagcaaataacgtcgcgcaggcccaagcggcgtacacggcttcagcagcgtcaagcgtggctgcaacggcggctaacggcagcacagctaatgggctcgatacaggggcaacggtacaagcgggtacagtgaacgccaccgatcaggccacaacacatttgcgggatacccagtttgacacggctacaaatcagctgccagtagtcgcgtcaatcctttcaacgttatttgcaggtttgggtggcttgttcttcacgctttggcgacgtcgcaaggagtcctcagttgaggaatcagaacgtttggcagctgaagacgatcaattctttgacgaaattgacaagatgaaagataactggaagtaatcgtaagcggtgaactcgcccgtcactaaaagtaacgggcttcggcgtcgagacctgcaactaaataggctctatccgaaaacgtttaggcaatgcacccttacgggcgggcgtcagctaagacactcaaacaacgtgtcgtgcccgttttcactaggtcagggcaatacgcaccacgtttattcttacagccattaaggacgacaaggttctgtctcgcccgtaattcttaattgatagttactagactacttgcgcttaggcgtgggtagtcttttagtttgatgtgatgctcagggttcaagccccaatataggatattccaacttgcatttaggtcacggttaatcagtttgccggtaagtgttgaaacccacttacggactgatgtatcatgcttttcttcatgtgtcgtgccgtactcgacttgtgatgtcttgtaggcgtcaaccttgattaaggtcttaccggtacggttcgccaacatttcaatgaattgcgccatacgatacggtttaatcattgccagtttgcggttagcgctgcgtgcttgtcgcttcttggcacgcatgtctttggcgtccaaatcttcaataacaatcacatcgtaatcgttcatgagaacatgtgctagttgcttgtaatgttcatcaaggatgttttcgcgtttgatgttcagacgcctgatttcgtcgttcatttgggctacacgtcgtgagtttttccccaaccaaacagacttgtcacgtttcgacttcaaaccgttaatttggcgttctaagacttcagccttaactataacgtcattgctgatgtagatttcctcgtcgtttgacgtgtggaacaccttgttgttagtcatgttccagtcaccagcaaccttagtcgttggctcaatacgagcaacttgtcgcttgaatacgagttgtaactcaaattgaccgttgtttttacgcttcaatttcgtaatcacaattgtagagttacgtagattgctgacgttctcgacgacttgtagatcaccgtaatcttgtatcttgatgtgatgtgctgatacgatttcaacttggttgttgtttggtagtgaaactgtcttaaatgatttggtgccacgcaagtagttcaaagatcccttgcgataccatgaacggtgttgtgaattgttgccgtgaacgttgttcacgtagtccaacttctcgtgcgtcgtcatttttgaagcgcggtacaaagtcttgcgatactcaccaaagttggtcatcaacgttgtcagaaactcgttggcaccttgtgagtgcaacccaacaatcactgcgttccaacggtctaggttgtagttctctttgatgaacttggccttgatgtcgttgattacataattcttttgcgtcttgttgttaggatatggacggttcaagtgcttacggccatacgtcttttcaagatacttgtttccaaagttccaaagctgattttgcgtctgcatgttgcgcgcatgatgttcaatcagttctggtgtcgctaccacacggtagcgtcgaacgtaaatgttctcaacaatcttagacagattttctaatttcatgtgatagcccctttatttgatatattgattatattacaacaaaagaaatgattacataagattaaaaaaattgcagataattaaaacgaacacggttatctctacaatttctcgtaccatattgtatgggttacaaagtatcgcaagcccgtattcaccacacctaagctcgttcaagatatgaaaggcgctatcaattaccttgctgataatcatgatgtcgaaattcaatctatgaaagttatgcccgaccacgtacgcttgctggttagctttaagccaaaacttgcaccgactgatgtcgtcaagatactcaaaggttctagcgctcgattatggttcacggctcacccagaaacgaagcgcaaactgcggggtggtcacttgtggtctcccagctactacattggtatgttgggttaaatgtcgaagcaagttgtcgaaggatatatcaacaatcaacgtacagaaaaaagcaacgctggccgtccctctaagaagggcaactaacattgcttttcgttcggcttcatctcggcaatgaattaccgagttttcgccttggctaccgagatggcgggagctaggctccgtaataaagcatggcccataataatgggttgtgctttatttttgtaagtagcccccttttcatttgacatcagaaccggtagaataggtcttgtaatcttaaagatttatgagaatccgaacatagcgattctgaacgaagggggaagttaaaatggcacaacattatgacacaattattctcggggctggccctggtgggatgaccgcagcaacgtacgcatcacgtgcgaacatgtcagttttgatgattgatcgcggcatttacggtggacaaatgaataacaccgctgaagttgaaaactatccagggttcgagtcgattcttggccccgaattggcggaaaaaatgtacgcatcgtcaacaaagtttggtgctgagtacgcctttggatcagtcttgcatgttgaggcgcaacacgatgggacgtggcatgttgtaacagacatggatgactatacggccaacacagtgattgttgcgactggggctgccaacgttaagctagcagtacctggcgaagatcagtacactggtcgtggtgtttcatactgtgcagtctgcgatggggccttcttccgtggccaacacgttattgttgtcggtggtggtgattccgctgttgaagaagcaacatacttggcaggattggctgacaaggtaaccatcgttcaccgtcgtgacaagttgcgcgctcaaaagattttgcaagaccgcgcctttgcaaatgaaaaaatcgacttcatttggaacacggaagttgaagaaatcattggtgatgacaagaaagtcactggtgtccgtgttcgcaataaccaaacggatgaagtttctgaaattgcggctgccggcgtattcatctatgttggtttgacgcctgtttcagaaccggtccaagcattgggtatcacggatgctaacggctggattcacacaaatgatcgtatggaaacagcagcgcctggtatctttgctatcggtgatgttcgtgacaaggaattgcgtcaaattaccactgcagttggggatgccgcaattgccggtcagaatgccttttcttacaacgaaaactttaagatggccgcatctgaagtaacagaataacaattaaggaacttgtttctgcaagttcctttttatttacctaattcgttaccaaaattcagtaacatagcgtaaaatgaataagagcatttttgctgatatgaaagaaaggggtccacatatgacgcaaggaactaagattattgcctcagctcactacgttccaagtgatattattacgaacgatgacttggcggcaatcatggatacgaacgacgcgtggattcaagcacacactggtattaaggagcgacgcatctcattgcaaggtgagaatacgtccgatttggcaacgcaagcagctcgcatggcgttgtcacaaaccgaccttaagccagaagatattgaactaatcatcgtgacgacgtttacgccggacggattagcaccttcaacggctgcgctcgtacagcgtaacttgaaagctgaaggggcgtgggcatacgatatttctactgcgtgctcaggatttgtctttggtatgagtactgcagacaagtttatccgttcaggtgtttacaagaacgcattggttatttcagcagaagttaattcgaagatgatggactttacagatcgtacatcaactgtcttcttcggtgatggtgccgctgcaatggtgctggttgctgatgaagaaggcggtattgtgaagggtgaggaaatgcataccattggggacgctgaagttgttcactctggtcgtatccaacctttgacagaaatttctgcagaaaactatcctaagacggatgccttccatcaagaaggtcgccaagtctttgaagaagttgtgcgcttgattccagatcacattgtaaagttcttgggtgatcgtgatttgacgccaaatgacgttgattactttattacacaccaagccaacttgcgcattattgaggcgattgctgaggcgattgaccaaccaatggacaagtttgccacgaatattacaaagtatggaaacacgtcatcagccggaattggtattggcttggatgagctgaacaagaaaactgatttgacgggtaagcgagttctgttaacgggattcggtgccggatttacatacggaagtctgttgcttgaattctaaagtcttatgaaaagtaatgaacgtgtgcgtttttgaaacaaacacgttctttttttattctttaaaaatgcaccggttttcatgaaagtttgttaaaatagtaacagttaattatgacaggaggggtcagctatggactatgaagaaatgcttgagcaattacgatctggcgaattagaagagttcgttttggaagcaaaggacttcaaggaattttacgaagtttggcgtaattacccttatcagaacgcgattcgtggcgttgccgcacgtggcggggttgtcacgtatacggcgaagaataaggccgagtagaatcatcgccgcttccacttattcacaaaaagttcacaaaagcctaatgaaaaggtaatgtaagcgcttgcgcaaaagcttcatacctgctagaattaacgacatagagttggttagaaagatttcgaaagcgtatctcatttagccaagtcaaaaattatacaaagatagatattttttaatctagaggagattatcaccatggaatcacgcgaatttcacattgtagccgaaactggtatccacgcacgtccagcaactttgttggtacaagcagcttcaaagttctcatcaaacgtaacgttgtcataccaaggtaaggacgttaacttgaagtcaatcatgggcgttatgtcattgggtgttggtcaaaacgccgatgttaagatttcagcagaaggtgatgacgaagctgaagcattggctgcaattgcagagacgatgtcagcagaaggcttgactgactaatttttagttaaaaatttatttgaacatttactttgagggataagacggcgatggcaaaagaaattaaggggattgcagcatcaaacggtgttgcaatcgcaaaagcatataagctcgttgatcctgatttgtcttttgatactcgtacagtagacgatgttcaagctgagaaggaccgcgtagcagcggcctttttagcatctaagacagatttggaacaaattcgagacaaggcagcaacttcaatgggggctgaagaagctgaagtgtttacagcacacattatggtgcttgaagaccctgagcttttggggggcatttctgctaaaatcgacagcgactcagttaacgctgaagccgcgttgaaggaaacgacagacatgtacattggtatgtttgaggcaatggccgatgataatccatacatggctgaacgtgccgccgacattcgagatgtgacaaagcgtgtgctaagtcacttgttgggtaaggaattgccaaacccagccttgattaaggaagaagttgtgattgtagcgaaggacatgacgccttcagatacggctcaacttgaccgtcaatacgttaagggatttatcaccaatgttggtggacgcacagcgcacgcagctatcatggcacgtacgttggaaattccagcgattgttggttcacaggttgcaacggatgaaattcaagaaggtgacatggtcattttggatggacttgacggtgttgcaatcgttgacccttcagatgaacaagtcacagaatacagtgccaagggtgaaaagtacgcagcgcaaaaggctgaatgggcaacgttgaagaacgaaaagtctatttcagctgatggtaaggaattcttggtgggtgccaacattggtacgccaaaggacttaactggtgttgtggataacggttcagaaggaattggtttgtaccgtaccgagttcttgtacatggattcaaaggaattgccaactgaagacgagcaatttgaagcctacaagaaggttcttgagggtatggacggtaagcctgttacggtccgtacgatggacattggtggtgataagtatttgccttacttaccattaccagaagaggaaaacccattcttgggttaccgtgccatccgtatttcattggatcgtgatgacattttccgtactcaattgcgtgccttgttgcgtgcctctgtttacggtgacttgtggattatgttcccaatggtggcaacgttgccagaataccgtgcagcgcgtgatatcttcaatgaagaaaaggcgaagttgcaagaagctggtgtaccagtagccgatgatatcaagttgggaattatgattgaagtgccagctgcagctgttttggctgataagtttgcccaagaagttgatttcttctcaattggaaccaacgacttgattggttactcaatggcggcagaccgtggtaacgacaagatttcatacttgtaccaaccatacaacccatcaattttgcgtttgattaagaacgtgattgactcagcgcacaagtacggcaagtttgctgcaatgtgcggtgagatggcgggtgatccaattgccgtaccagtgctagttggtatgggcttggatgaattctcaatgtcagcaacgtctgttttgcaaacacgttcattgatgaagcgtttggatacgacgaagatggcagaattggctgataaggcattggatgctgagacgaacgatgaagttatcgcgttggttcaagctgctgtaccagctgaataagaagtaacgagaaaccagctttgtggcgagactactgatgtagcgtcatggagctggttttgtgttgtagctgatgtgaagggctgtttgctataataaaagcatatatgaagggcggtgaagctgatgagtcgacaaccaatcgtcgttgcaaattggaaaatgaataagttgccaagtgaggccgaggggtatattcaggaggttgcaccaaagttagccaagtatccgaacgttgatacagtattggcggggcaagatgtattattgaacgcgatggtatcggcggccaaggggacatcggtgtgcatcggtgctgaaaacgtgtattgggaagatcggggtgcctatacaggagagacaagtccagctgcattagctgatttggggatccaagtggtcattattggccactcagagcggcggaattatttccgtgaaactgatgaaatggttaatctgaaaacgttggccgcgctacggaatggcctaatgccgattattgctattgatgaggcagtccaattggagtcagaaaacgatcacgcccattggattgtgaatcaagtcgttgaatcgctaaaaggggtagcgatagcggacctaggtcgcgttatgctggcctatgagccaacggcagcgattggatctggtcaggcgatggggccagaaattgcgcaaaaaagtttgcggattattcgccagacagtggctgatatgtttggtcaaccagccgctgatcagatgcgtattttgtacgggggttccgttaaaccaactaatgcctatgaattgttagcgcaaccggacattgacggtgtcttggtgggtgatgcggcacttgatgccatgacgtttattgagttggttagtctagctgatcaagcgaagcgatctttgcaaaaagaggcgtgaaatattcagattccgttacggtttgattcacgagttagccgtacctaagcgataaactgatgtgtatagatgaaataatacacaatgaatcagaagcttagggggacatgagtgatgtttgaatttatgacgaagattttgtcagatggtaattttgtgaaaatctatctaacgtcaggtgagtcattcattttgaatgaacttgatggtgaatcagagggcgttatatttggatcacgtgatgcttcagggcgtaaggtacgttatgcagtgacggttgccgaaattgcggcagttcgcgaacactggtaaaaagaaaaaagacaccgcaagttgcggtgtcttttactatttaagtgtattttgttcaggttcaaccatcgtgactgtgtcatcacttgagctagccgggtggataccagcagcaattaacttatcattaaagttatgttggttgtcacgcgtgtttgtcacgtgcgtatcagcgctttgataggtggtatgttcagtggttggtgctaggcgctccatggcatacgaggccccaaatagataaagtggcaccgcaattaataatcccattaaccccaaaatagaaaatttaatctttttcatttaaacgcagcctcctcctcgttggtatgcgtacttacgttttaactatgcatataaagtaacacgagatttcatgacatagtggacagtaatgtaacaaatgcaacacggaataattgctactgtttatcagtaagtgtttcgtatgcggttcgcacaataatcgtaataaagggcaatgaattgctacacaacgtgtgaattatgttacaataaatgacaagggatattcccagataactatacttttaaaacaagtaaggagaagacaacatgtctgcaattactgatatttacgcacgcgaagtcttggactcacgtggtaacccaactgttgaagttgaagtttacactgaattgggtggtttcggtcgcggaatcgttccttcaggagcttcaactggtgttaacgaagccgttgaattgcgtgacggtgacaagggtcgtttcttgggtaagggaacattgaaggccgttgaaaacgttaacaaggttatcaaggacaagttggttggtatggatgttactgaccaagttttgttggaccgtacgatgatcgaattggacggaactccaaacaagggtaagttgggtgccaacgctatccttggtgtttcaattgctgctgctcgtgcagctgctgacgaattgggaacgcctttgtacaactaccttggtggtttcaactcaaaggttttgcctacgccaatgatgaacgttgttaacggtggagcccacgcggacaactctgttgacttccaagagttcatgatcatgccagttggtgcaaagactgttgctgaagctatccgcatgggttcagaaactttccacgcattgcaagcattgttgaaggaatcaggtcactcaactgctgttggtgacgaaggtggattcgctcctaacttcgcctcaaacgcagagccatttgagttcttgttgaacgctattgagcgtgctggttacaagcctggtaaggacatcgccattgcctttgacgttgcctcatcagaattctacgaccacgagaagaagatctacacgttggcaggtgagcctgataagaaggaatacacgactgacgagttcatcgactacttggagaacttggtaaacaagtaccctgttgtatcaatcgaagaccctctagcagaagctgagaacttggatgatgaagagcaatgggataactgggtaaagttgactgaccgtttgggcaagaaggttcaattggtcggtgacgacttcttcgttacgaacacgaagttcttggctaagggtatcgaaaagggtgccggtaacgccatcttgatcaaggttaaccaaattggtactttgactgagactatggaagctatcgaaatggctaaggaagctggttacacggctatcgtttcacaccgttcaggtgaaactgaagacacgacgatcgctgacttggttgttgctacgaacgcaggtcaaatcaagactggttcaatgtcacgtactgaccgtattgctaagtacaaccaattgatgcgtatcgaagacttgttgactgacaaggttgctgaatacaagggtatcaacagcttctacaacatcgacaagactgctcgcgaagctatcgttaactacgagcgctaatcacgagttcgatcgaatagattgatttaattaaagacgacactaactcgaatgagtcagtgtcgtcttttttacgcgcgtttccttttttaatgtgcataatattagaatacaattagaaaatgaaaagagggggggacgaaatggtcaaggtgagagaacaggatattgcaacactttcattggggctgcaacaggggaagtttactagtgtggaactaacgacggcctatcttgaacggatggcattttttagtacgccaccattcaacgttaacgcagtggtccttgttaatcccgacgcccttgatgaagcagagacgcttgatggggaacggcagcacggtcatgtccgtggcccgttgcatgggataccgattttagtgaaggataatattgatgtcgccgggctgccaacaaccgctggtgctttggcattaacgaataatgttgcaacacaagacgccgaattaatacaaaagttacgcgaagcaggtgccatcattctcggtaagacgaacttatcagaatttgcgcattttaagtcggatattgaaccttcgggattttcagtggtgggtggtcaaacgattaatgccatctttccagatttaacgccaagtggctcgagttcaggatctggggtcgccgcttcgctgagtttggcggccgttacaattggcacggaaacaaatgggtctattttggcacctgcgcaagcaaatagtgtggtagggctgaagccaaccgttggggcgtggccagtagttggcattctcccattggcccattcacaagatgcgcctggaccgattggtagaactgtggcggatgttgcgacggtctggcaagcactcggtggcgcaacgactgcatcagtcagtgatgtgacagtgttgcagcctgacgagaccgatgtgttggcacaacatgtggtcaatcaaatgatgaccaatttaacgagctttacgtttaaacggtacgacgcggtattaccaccatctgacgaggctgccgaatatcaacgattgttattcgaatttaagcacgacttggatgaatatttgcgggaacggggccgtaaccaatcattgactgatatcattgcgtataacaatgctgatttggcgacacgtgcaccatttggtcaaaatttgttgctggctgccgaagcaaccaccggcgaccttagttcgcccgtctatcaagatgctgatcgacgggcacgcaattatgccacaacgagccttgaaaaattgctgtcagcaagtgacgttgttgtcggtgctgactttaggttggttgattttgctgctgtggcggggtatccaagtattagtatcccattcggccaatttggtgatgttacatttggtgggttagcaagcgttattgcagttgcccggccacatgaagaggctaagctactgacattcgctcgggcggctgaagaaattgggcaacgcgttatcccaagtctaggtgaagactccgaaacaatggcttggcaaagggattagcttttagtgaaaacaaggatgtcatgagtgaaaacatggcatcttttttggtgcttttattcagacacctattacttcaggtgctatactaattggtgataaaaaataaggaagtaagcatatcatgcaagagagtcaaagcggtttgaagctatggttgtcgatgacggcggtcgggttgttcacctttatgagcaccttggacggctcaatcgtcaacattgcattgccagttatgtctaaggaaatgaatattcccatgaaccaggcaacgtggacagtctcaatttatttaattgttatttcaggattgttggcgttgtttggtaatttgggtgatcaactgggcaagattaagatttttagaattggaacggttgtctttacccttggttctgtcttggcgggaattgatttaggtttgccatttttgttatttgcccgtttcgtacaagccgtcggggcgtcgatgaccatgagtaattcattcggtattacgacaacgcttgcgccacaaaatttgcgtggccgtgcgatgtcgtttatcgctgcgtgggtgtcacttggttctattttgggaccagcccttggtggtatgttgctgcaaaatttgagttggtcatacatcttctggatcaacgtcccaattggcattatcgcgattgtcgcgggtgcattcttgctaccaaagtcttctaagcaaggcgttaagccagaaattgactggtggggtgccatctcactcttcttgtttgtcgctatcttgttcctaggcttcaatattgcccaagtgcaaggtttcttagctcctgtaccggtggtgacaattattatcgcaattatcttctttgttttgttcgtgcgtcacgagctacatgcagagaagccactgcttgatttgacgatttttaagtcaaagttgtttacgattagtttgattacggccttcttggtctttgtaacgaacttctttatcaatgtgttgatgccgttctaccttgaaaacttgcgtgggttgagcacgggtacctcgggtatgtatatgctcttgtggccagtagcaatgttggtattttcagcggtttctggtactttggctgataagatggatcgtgaatatgtaactttatttggtttgacggtcttagccgttgtaatgtttagctggttctttgctggtgccaacacaccaatgctagtggttggtctgctattggctggttcaggattcggaatggctttcttccagtcaccaaataatgccttgattatgtcaaatgcgccacaagataagctgggtgtggcaggttcactaaatgccttagcacgtaacttgggaatgattacaggtacgacattggtaacttctgtcttgtacgcagtcatgagcgcacagcttggtacatcagttacaacgtatcctgctaagcatccggaagcgtttgtagccggtatgcacgttgcatttgcagtcgcaggtattttgcttgtcattgcgtttatcatgacgtattaccgcgtttggatgcgtcgccgtgagaagcgcgcctagctaattattacgatgataaaaagtcacgagatgttcgataatcgaatgtctcgttttttgttgagagacaggcgttcgtatgttatgctagacaagtataaaaacccgacatgatcgggaatgaagaggaggcgcccacaatgtacaacgtattgttgacagcgatgattgtcgttggcgtgttaattattttggcagtgttgatgcaaccatctaagcaacaagatgctttgtctgccttgtcaggtggtggcggcgatttgttcgcaacgcaaaaggcacgtgggttcgaggcagtgatgcaacgaatcacggctattcttggagcaatctggtttattttgggattggcactagtttacctatcttcacactaaacacaaacagcgctactgacctctcgtgacttgttgcgaggggtctttgattatatagaagagtgagattttaatggacgcacaaaaattacaggaccaattatttggtttcctaaaggcgaatccaacccaagcctatccagcacaaacgttggtcgatggtttacgcttggatgacgcaaatgcctttacaaaggttgttcaagctttagcagctttggaacgtgccggcaaagtgaaggttaatgatgaaggcgcattccaatatgacgccgataaggaaggtgttatcggaacgttcaagtctaatgataagggctttggtttcgtgcactatgatgataaggctgaagatgtcttcgttaaccctgacaacacaatgttcgccgtacaaggtgatgaggttcgtgtgaagttgttaagtaagggtgacactacgagcggtcgcgggccagaaggtaaggttgccgagattattacgcacgcccgtgagcacgtggttggtgagtttaagctgggctcagaatacaagggttacgttggtagcatcagcttgacggacaagaagtttgcgtcatttgaattcctagttaaggaaggtggcgtggcagcgactgacggcgaaattgtgatggcgacgattgatcaatatccatcagcagttgccccaaagcgtttcacgggtgcgattactgagaagattggttacaaggatgagcctggggttgatattctacaaatcgtgtacaaccacgatgtgccacacgttttcccagaagctgtcctagaacaagcgaacaagattccagaagacgtacaagatgctgaacgtgaaggccgtgaagatattacggaccaaccattggttacgattgatgcgattgaatcaaaggacttggacgacgcggttgttgtctggaaattgccaaatggtaacttccaccttggtgttcacattgcggacgtttctcactatgttgttgaaggcacaccgttggatgaagaggcctataaccgtggtacgtcagtttacttgacggaccgagttatcccaatgttgccacgcaatatctcaaatggtattgcgtcattgaaccctggtgtggatcgtttggcgatgtcagctgaaatggaattcaccccagctggtgacttggttaaccaccgtttgcacacatcagtgatgcgttcacacgcccgtatgacgtacaaggcagttaacgctattttggctggcgatgaggaaactcgttcagaatacagcgacttggtgccaatgttcgaagaaatggaacaattgcacaacgccttggctgcaaagcgtacagaacgtggggcaattgaatttgatgcgccagaagctaagattattgtcgatgagacgggtaagccaacggatattgaattgcgtgaacgtggtttgtctgaacgtatgattgagtcattcatgttggcagcgaatgaaactgttgccatgcactttgaccaagccaacgtgccattcttgtaccgtattcacgaaacgccggatgctgatcgcgtccaaaattttgtggacttcgtgaaggccctcggtgcaccggttaagatcgatccagaaaacatcaagtcaactgatttgcaagccatccataacttcttcttggatcgtccagaagaacaaatggtttcaacgatgatgttgcgtacgatgaagcaagccaagtattcagaccaaccattgggtcactttggtatcggggctgagtactacacgcacttcacgtcaccaattcgtcgttaccctgatttgacggttcaccgtttgattaagtggtatgagaagaatggtttgggtgaagaagcgcaagctaagtaccgtgatcagttggctcaaattggtgaagacacttctgttcgtgaacgtcgtgcggttgacacagaacgtgatacggatgccatgaagaaggccgaatttatggctgacaaggttggcgatgaattcgaggcagtcgttaatggtgtcttgaagttcggtatgtttgtgtcattggagaacacggttgaagggttgattcacacatcaaacttcacggatgatcaatatgtttacgacgaggcccacatggccttgattggtcgtcgtttccaccacatctatcaaattggacaacctgttaaggtacgtttggtacgtgtggataaggaacaatcagcgttggactttgtgttagtggatcctgatgctgcgccaatcacggatattaaggtacctgaggaccgtcgtggtgcctttggtggtcgtaaccgtggtgagcgtcgtagcaacgacaaaaataaccgctcaagcaagggtggtaagacgcacaacggtggaaagccattcggtgcgaataccgaccgcaagccagagtcaaagcaccaaaacacaaaccgtaagggacgacactaaaaagagcgtagagtggtggttttctcgcaacgcgagaaaatcggtcgtccggagttaagccgaaaatttttcggtgcgccaaaggcgtgcggaaaatttttgacttaatgcagtgatgaccgaagccacggcaggcgtttaaaagagcatagagtggtgccaaaagttgtggcaggcgtttaaaagagtatagaatggtggttttctcgtgaaacaagaaaaccatctaaacggagaaaagctttaggaggtcattatggccaagaagaagtcaaataacgatggtgcacttgcaaccaacaacaaggcgaagtacaactactttattggtgagacgtacgaagcgggtattgaactaaccggaacggaaattaagtcggtccgggcaagtaagattacgattgctgatgggtttatacaggtgcgtgatgggcaagcttggctagataatgtgcatatcagtccgtttgaacagggaaaccggtttaaccatgagccattacgtagccgacgtttgttactccacaaaaatgaaattaaagcgcttggtgaagctacggcgcaacaaggtaagacaatcgtgccgctgcgagtttatttaaaacatggtttcgcaaaggtattgattggggttgcaacgggtaagcataattacgataagcgtgagacaattaaaaagcgtgatcaggaacgcgatttgcgtcgtaatctgaaagttcgctaaaaaaatgagccgatattactaatatcggctcattttttgcatagttttgataagtaaagcgctataatgggggtgttttagaacaattatttttgggggaaaagaaaatgaagattaataaagatttagcatatggggcagatgcgttacaaaaattagatatttacgagccggaaagtgacgcaattgccgatatcgtccttgttcatggtggcggctggtggcaaggtgataagcgtaaggaggatgaactggccagtgcgcttgtcgcggcaaactttcgcgttgcagcgattaattatcgtttagcgaatggtgcgacggtcgagaatatctttcccactcaacggactgatgcggttacagcggtaaagtggcttgttgcaaatgaaaatttccggttagataagctagttatgtggggtgcctcatctggtggtaatatcgccttagaggccgcgcaattattagcaacgccaacggtctcatggtcaggattaaatgatttagccggattcatggcaacgcatcctgacgtcgtgggtaagcaactaattattggggctgatgtgaagtcaaaagatatcgatcaagatggtgaaaaccaagcctactataagtggttagttgataatctaacagcaaatggacaagtaccatatgaaacggcaaccatttatgatcggttaacacccgcaacaaaaccggtctttattgcaaattcgatgactgagttagtgccagttggcgaagttgcgaccttaatggatcgcttaatcacattaggggtcggggttgaaaccttggttttgccaggcggacgtcatggtgaagggtatatggctgatgctttgccggcttcaatcgcctttgtgatccgtgtgttggacttgagggtagcgtcatgagtgagacacaaaattcacagtcgattacggtctcattaggtgctttttcatttgtcacggctttatctggggcgagtgtgacactggctttgccacgcatggcacgtgcatttgacgttagtgcatccttaagtactcaggttgtacaagttggcctcattacgacggttgtcttcttggtcatgtttggtcacgcgggtgacgttttttcgaaaaacgcggtctaccgagctggtggctgggtgtttattatgggctcgctcttaactggtatcgcacctaattttattggtgtgttagttggtcgctttgtgcaagcagtgggttcagcgatggtcatggcgaatgcgatgggtatcattaatgaacactttgctgacaaggaacgtgccaaggcactggcttataattccatgtttatctcagttgggtcaatttcgggccctgccgttggtggcttaattacatcgattttgtcatggcggtggatctttttactaaacgtaccggtcgccgtcgcgattatgttctgggcgaagggggcctttcctcggccacgactaacctgggctgatattcgtgaacaagcgcgacgtgttaactggttaggacaattaattttttcagtcggtgtcgttttaatgttcagtagtggttggattacattgccaggactgaaccaattcacaaatatgatggtctttctggtcggtggtggaatcgtcacggcgttatcattcttgcaggatgatttcgcaccgtcaccttggattgacccacaagtcttacggaatatcaccttcttaacgtcaaccagcgtgttgttcttggccatgttcgtcaattcattttctaacatcttgttgccattctatctacaggattacttaccgttttcaccgggcgtgagtggtttgattgttgccgcccaatctgtcgtgatgttattgctatcaccgtttgttggtcgattagcatcaacgcctgaacgacggccgcaactagtgacaattggcttagccatgttgttagtgtcgcaaattggttatgctttctatggtggccagagtggcttaggctacgtactgtggccaattattctaaacggggtgggaatggcatttaccttaacgcctaacaattcgattacgatggggttggtatcaccgaacctggctggtgttgccggttcaatgaattcattattccggacaattggcatggcggtcggtattagttttgcgacaaacttcctgtatgcacaactaccaggcgttaagcacatcacgcgtggcctaggcacaacctacctgcacgcaagtcggattgtcttttatgtcgcagtcggtgcgtcgctgatcgcacttatcataaatgtttggcggacagcgaccagtaaatcggaaatgtgagcaaatctgacatcacacaacatcttttttctgaatgagagtaagatactagcatatagaataatatgggtgatttaggaggatttcgtcatgcgcaaatggctgaccggcctggtagtgctagttgcgaccgtcatggggatgacagtcggcgggcaaacgatgcatgcagcatcgcattacacgattacaacggatacgacgttcccaccatttgagtttcaaacccaaggtggggattatcgtggtatcgacatggatatgctgaaggaaatttcgaagcgcgaacactttacgtatacgttgaagccaatgagctttaacgcgggtgtgcaagcggttcaggcaggccaagttgacggtatcttggcgggtatgtcgattacggatgaacgtaagcaaacgtttgattttggtacaccatactacaagagtggtatcgttatggcagttgctaacaagtctaaggtggattcactgaaagacttgaagggtaagaccgtggcagccaagacgggtagttctggcgcgatgtatgcgcaacgaattgccaaaaagtacgatttcaagattacctactttaatgattcaaacacgatgtacaatgatgtcatcatcggtaacaccgtggcggcttttgaggatcagccagtaatggcctatgcgattcaacaaggcacaaagatgaaaattgtgacggacccagctgatggtaattggtacggctttggggttaagaagggcactaatgcagcgttgctaaaggatttcaatgctggttatgccaagttggtcaaggatggcacttacgataaaatcgttaaccgttaccttggtgaaggtgggtacaactacaaggaaaatgcagctgctaagtcggctgctgaccaatctatttggtcgttgattaaagaaaacaaggcggctttgcttgatggattgattaagacgttgcaattaacaattgttggtatcgtcttggcagctctttggggtgtgctacttggtgtgatgggtgttgcgccaagtaagcttatccgaggcttatcatcagttattatctacatcttccgtggtttgccaatgctagttttggccttctttatttatattggaatccctaatttgaccggccagaagattccagcctttacagctggtgtcattacgctgattttgaatgaaggtgcctatatcggggcgttcgtgcgtggtggctttaagtcagttgatccgggtcagctagaagctgctcggtcacttggtatgccatatggtaaggcaatgcgtaaggttgtgatgccacaaggaattcgtttgacgattcctagtttcattaaccaatttattatcacgttgaaggatacatcaattttgtcagcaatcggaattattgaactgacgcaaacgggtacgttgatcattgcacgtaacctccaagggttcaaggtctggttaatgattgctgttttgtacttgattgtcatcacgttgttgacgtggttatctaactgggtagaaaagaggattaactaatggcagcgattgttgaagtgaaggatgttcacaaaagctacggtaaaaacgaggtcttgaagggcattagtttagacgttgcagaaggcgaagtggttgttatgattggaccatcaggttcaggaaaatcaactttcttgcgttcgcttaataagttggaagaaattaatgccggtcaaattaagattaatggttgggatttggttgacccaaagaacaacattgataaaacacgcgaaacgattggcatggtgtttcaacactttaacttgtttccacatttgacggtgttggaaaacatgatgttggccccagttgaagtaggtaagcaaagcaaggctgaagctgaacagacggcccgtaagttgcttgatcgggttggcctagctgataaggcggatgttaagccgaacactttgtcagggggacaaaagcaacgtgtagcgattgcacgtgcgttggccatgaatccaaagattatgctgtttgatgagccaacgtcagcccttgatcccgaaatggttggtgatgtattggctgttatgaaagaacttgcggaagaggggatgacgatgattgtcgtgacccacgaaatgggctttgccaagcaagttgctgatcgggttgttttcttcgctgatggttacattcgtgaagaaggcacgcctgacgaagtctttaataaccctcaagatgagcgcacacgcgacttcttgaataaagttttgaatgtctaatgaaaaatcccgctggtcattgttgtgaccgcgggatttttttattctgtaaatttcaaaccaacagcggcggctaagatgatggcgataaatagaatacgtttccaatcgcgtgattcgccgtaaaagagcataccaaccagggtaccaccgactgtaccaatgccagtccagacagcataggccgtacccaatggaatatcacgaatccccagtgagagtagtgatagactaaacccgaagctaatgagtagcccaacaatggccgaccagtgccggcgacggtgccattcattcatcatgacgacaccactggtttcgccaagtccagctaaaataataaataaccaagccattatgcgtcctccattaatttcaaaccaataaccccgaagagtagggccgcaattaagcccaattgcacgacaccgagtgattcaccatagaacgcccagttggcaatgatggtcgcgacggtaccaagaccaacaaaaatggcgtagactgtgccgacaggtaattcatcacttgccttaagtagcatgaagaaagaggcaatcagggcgaaaatggttaacccagtcatccaaatagtgtcggcgtgtttcatccccaacacccacatgggttcaaaaaccactgcagcggccacctttagccacggatttcgtaataaagtcatcatatttcctcctttgaccgcatcaatcgaaaagcctgggagttagcggcatatgtcgttaactcccaggcttttgtccttccgtgtacgtgcgagcacgcggtcgctcttggaccagaccacagtaactgtgcggaaccctagcgacgcttttgatgcgatttaattgatgtcccaagtgtaacaaattgggaatggcttggcaaactgggctttaattcgcgatatgacgatccaagtagcggttcacgaccagtcatgaaagtgaaccaaggcgccgttcgaccactcgcgatgaattgccaacggtccagaaatgctgtgattaagacgagggcaacttcattatcgacatcagcgatttgaatggttaggcggccatcgccttttggaaaagaggctgccagttggtggcgcattttgctgatttgaaaacgttgtttatccaaattgccgaggattaaccaattcacgccactcacgaagagaacttctcgaagctgcaatgataagccaattgacccaacctgggtgttagctacccgtaatgtaaaacggggcaaaaagccaagggaagcttgctctaattcggctaagacgtgagcacttttatcaagaatttttaaacgattaccagtttgtcccatttctccggtaatatagtatgcaatagtccccaattcgttggtgaccagactcatgcctgttgcggcatgggtgacttgtgttagatataattcacgcatgtgggcacccccttagccctattatatagttaaaccaaataaaatgtgaggcataaccatggcagatttaaccgacaccgactggctgcaacctttgactgagcgattagggcagtcgtattttgatgcagtccagcaatttttaaaaacagtttatgcgagtggggcagtttatccagctcgtgagaatgttttcgccgcttatcgggcaacaccactcagccaagtgaaggtcgttattcttgggcaagacccatatccgaatccagatcaggcacaaggccttagcttctcggtgcctgccggcatggcattgccaaagtcacttgtgaatatctacaaagaatatgtcaccgatttgcatcagccagcaccacggacgggtgatttgcacgcctgggctgagcagggcgtgcttttactgaatacagtcctaacagtgcccgctcaccaggcaaatgggcatgctggtaaaatttgggagccattgaccgacgccaccattagtttggttgcccagcaatcgcaaccaaccgtttttattctgtggggaaaaccagcgcaaaagaaggtcccgctaatcacggggccaaataacttgattttgcaggcgccacatccaagcccgctgtcagcttaccgtgggttctttgggtcacgtccattctcacaagcgaatgcctttttagaggccaatcagcaacaaccaattcggtggtaatgatttctgtgtgaaaaaaatcacaaaaattgtcacttttgactagtaaacaaaagcgatatttgtcataataaggttgtaataaaaaacgctatcaagctataaaaaaacggaggttttccatcatggaactctttgagcaattgtcatcacaaattaagggccaaggtaagactttggtattcccagaaggtgaagatgtacgtattcaaggcgcagcagttcgtttggctgcggaagaattggtaaagccaatcttgttgggaagcaaggcagctatcgaagcaactgcggcagcaaacaactttgatttgtcaggtttgcaaatcattgatcctgcagaatacccagcagatgcgcgtgagaagatggttgatgctttggttgaacgtcgtaacggtaagacggatgcggcaactgcttcaaagtggttggaagatgttaactacttcggtacgatgttggtttaccttgaagtcgctgatggtatggtttctggtgcaacgcacccaactggggacacagttcgtccagctttgcaaatcatcaagacggctccaggttcatcacgtatttcaggtgccttcgtgatgcaacgtgacgacgaacgttacatctttgcagatgcagcgattaacatcgatatcgatgcccaaacaatggctgaaattgctgtgcaatcagctaacacggccaaggtctttggaattgatccaaaggttgcaatgttgagcttctcaacgaagggatcagctaaggccccacaagttgataaggttgctgaagcaacgcaattggctaagacggctgcacctgaattggctatcgatggtgagttgcaatttgatgcagcgtttgttgaatcagttgcagctgctaaggcccctgaatcagaggttgctggtcacgcgaatgtctttgtcttcccagatttgcaatcaggtaacattggttacaagattgcgcaacgtttgggtggctttgaagcaatcggacctgtcttgcaaggtttggcaaagccaatttcagacttgtcacgtggtgcaaatgaagaagatgtctacaaggtagccatcatcacggctgcacaagctttggcataatgattaaataataactagaaacgcaaatttgccacgtgcaagtttgcgttttttgttgccctgaaacggtcagttgactccctttttcacctgtaatatgcctgttaaaaatggtatacttgacattatgagattaacagtaaacacagttgaagaaacacaaacgctagcggcccgactagcaaaactggttcaaccgggtgatacaattttgttgaatggtgatctgggtgctggtaagacaacctttacacaaggtttggcgcgggcgcttggtatccgtcgtcctttgaaaagcccaacttttacactagtacgcgagtatcaaactgaaaactttcccctctatcatttagacgtctatcgtttaggtgaagagggcggcggtgatgaattaggtttggcagaatacttcgatggtgaaggagtcgcattaatcgagtggtcagagtttattcaatcagaattgcctcaagatgtgctcatcattgatttggcacgccttgaccaggatgagacgggactattacggacgatatcagtgcgagctaccgggcctcgttcagaagctattttagctgctttggagaaataacatggaattaatgattcgaccagctgaaggtcgtgatgccgaaaagttgctggcgttgctacatcaattacagacagaatcgacaacttttatggttgcgcaagatttagaaacgattgatggggttactgaggcggataatatcagttttctgcaagcaaccacgaataatattattttagtggttgccagtgatgaagacgatttgtttggtttgatttcggcggctgcgattccaggcaagccacgcgaagttgaagtcggcgtcgccgtattggcagcataccaaggatttggccttgcacaagcactgattgatgaaatgctgacttgggctcgcgagtacagtacggttgatgtcattcgtttaaccgttcaaagtcataatgcgccagcaattcatatttacgaaaaggtgggctttacccgcgtacctaattcggaaacgttggtagaaaatagtgtgggcgaacaggtgccagcgtttgatatgctgttaaacttgaagtaaataatggggtgcacgatttatgaattttgtcgcaatggactttgaaaccgcgagtgcccaacgccatagtgctgtttcaatggcacttgttgttgtacgtgacaacatactcgtggatgaattttatacattaattaagccggaatcgtattttgatgcccgaaatactaaaattcacggcattacggaagctgatgttgttgatgcgccaaagtttccagaagtttgggaacagattaagcagttttataccgcaaatcaacttgtcatcgcgcacaatgcaccgtttgacaacggggtactacgtgagacattaggccactatggcatttcagccccacattacctgtcattagacacggtgcggacgtcacgcaagttgtatccacagctaccaaatcacaagctgaacacggtagccgatgccttgcaaattgatttgaagcaccaccacaatgccttagatgataccgttgcagcggctcgaattttggtaacgcaagccgaacagtttggggtcgatcctttgaagcaactggttaaggtaatttaacgaggaaaataagagagatgaacacaaatgaacttataacagcctttccagggctagacattcgtcaacatgtggctttatctgcgtacacgaatacgcgtgtgggcggtgaagctgatttggtattttggccccggacggtcgctgagttacgtgaagtggttgcttatgcaactgcacatgacgtaccgatgacggtgttgggcaatgcctcaaacttgattattacagacgatgggttgcgcggcctcacgattttcgtgacgaagctgaatgaggtggccgtgtcaggcaaccgcattaaggcaaccgctggggcaaccattattgatgttacgcaaattgcccgtgagcacagcctggctgggattgaatgggccgctggtattcctggttcagtcggtggtgcggtcttcatgaatgcgggcgcatatggtggccaagttgatgggtggcttgaatcagctgaagtcatcacaccagctggtgaaatcaaaagctatagcaatgccgacttgcagttcagctaccgtcatagtttggtccaagatacaggcgatgttatcatttcggcaacgtttaagctccaaccagatgatggggcagcaattgaagcacgtatggaagactttaatcaaaagcgagctagcaagcaaccattggagtttccatcgtgcggatctgtcttcaagcgtccagaaggctacttcgcgggtaagttaattatggatgctggcctacaaggcttccaaattgggggtgcccaagtttcaactaagcacgccgggttcattgttaaccgcggtaacgcaacgggttcagattacgtcaatgtgattaagcacgtacaagcggtggttaaagagaagtttggggttgatttggaaactgaagttcgtattttgggtaactaatgaattgaattaagggaggaattatggaactattacaaaccattgtggggctaacctcattggtggtcatcggtaatattttgtcgcatttcctcaaacgtgtgccggtcagtttgatccaaatcagtttgggtctgctggccgctttgtttttaaatgtgcacattgaattagatacagaatggtttttgctattatttattgcaccgttgctgtattcagacgcctggcgatttccgaaacgagaactttgggagttgcgcggtgcgatctttggaaatgctattttactagtctttttaacgaccattctggggggctttattatttatggcctcgtcccagagttaccgttgccggtcgcatttgcgattgccgcgattttgtcaccaactgacccagtcgctgtggctgcgattgccaagcaagccaaattgccaccgtcaatcatgcacttggtggccggtgaaagtttgattaatgatgccagcgggttggtcggctttaactttgcggtcaaggcagcatctgctggcaccttttcattattagccgccaccggtaattttttctacatctcattgatgggaacgttgattggattggtgctcgggttcttactgaatattctgggtgatttcttatcatcaaagggtgcgactgatgtcgtcttgcgcgtggtattgcaattatttagcccattcttgctatacttattggctgaagaagtgcatgcgtcaggggttattgcggtagtcgtttcggcgattgtgcaaaacctccacacgaagaatgacgctgactattcgggtgagttacacgtcgtcggtatcaacacatggaatgtgtttggttatttgttgaatggttatattttcgtgattttgggaattgaactaccattggcaactgaattgggcaatgtgatttctgtaccaatggccatctggtatgcctttattacttgggttgttatctttgggatgcgtgtcatttggacatacattaaccaatgggttcgattaaaaaatcaccataacgaaacagcgtcatggcgggttgccttgctatctggtttgtcaggtgtgcgtggggccgtgacaatggccggtgtgctatcggtaccgttggtgactgatgcggggatgccattcccacaacgtgccttaatgctctttattgcagcggtggtcattatcatttcattgttggccgcgattattttcttgccgttgctggctgaaaagccaaagacgcaggttccgccaggtgaaaagagtccgcaggcggtggtcgcacagcacatgtccgagccacgtgcccgtgtgtatgtcttgcagtcagccgtccgtgaaattgagacgcgccgtcgagaatcaaatcaagccattgcttatgaaattattctgcgttatcaaatgcagattcgccaattgcagatgcgatttatgaaaatcgataaacttagtccgattttgaaagccgaaatgaacctccgtgaaatcgcattggacgcggaacgaagtgcattgcgagggctgttggttgatgaaaaaattacaccattggtatttgcaagtgagaatcgccggattgatcgtgtggaagcggacttggatgatttgattacgcatgataaaaccaagcggacatggcgccaattgaagcgttttgtgatttcaacccgtcgatcaattcgcatttggttgagtgacgattcatctgatcgcttaattgcggaatacaagcttgcacgtcatgaatcatcgaaggctgcgattgcggcaatttcaacgtatttggcaagtgaagatggtcaagcgtcaaagactgaccaaacggcagcgtacaacttaatcattatgtatcgttcacgcttagagcatcagaaacataatggtgggcaatcggaggcattggtgcgcatggaccttgaagtggctggactaaacgcacagcgtgaagccacccagcatttgtatgacgcgcactttatttccgccgagacgggcttgcggattcgtcaaatgattaattttgctgaagctggtctattaacggatgaagaagagtagggggcagtacaatgaattttaatattgaagcactggtgaagagtgtcagtattgtccgcattattgacgtggtcattgtttggtggctcctttatcggctaatgatgctgattcgcggtactaaggcggttacgctgctgcgcggtgttggtattgtgattgtggtgaaggttgttagttggtacattgggttgaccacgatttcatggttaaccgaccaaattattaattggggtgtgattgcactagttgtcgtcttccaaccagaaattcgacgcggtttggaacacctgggtcggtcggccttgtttaagcaacgacaggcttatcaagatgaaaccaagctgattaatgaattggatgatgccattcaatatatgtcaaagcggcatattggggcgttgatttcaattgaaatggaaaccgggctagaagaatatatcgaaaccggaattaagattgatgcggaagtgaccagtcaattgttgattaatacttttattccaaatacgcctttgcacgacggcgcggtaattatcaaagatgcccggttggcagcggcagcggcttacctgccattatcagataatccaacgatcccgaaggaactgggtacgcggcaccgtgcctcggttgggatttcagaagtaacggatgccttgacgattgttgtctcagaggaaaccggggcagtgtcaattacgcgtaatgcagaattgatgcagtcgttgtcgcgtgaggactatcgcaaatatttgacacgccaattagtgcctgaaaatggggcggtcaagcaaaactggtggtcacgctttgtaccgacatttaagcggggtgagaagtaatgaaaaaaagttacgacaaactgatttatctaggggcaacgttattagttgccatcttaatgtcggtctatgcggatggccagtcaacgaagaccacacgcaattcaacagaaagtggcgcaacaaccacgggtatcttaaaagggttggtgtcatcaaagtcagaaaaagtgtcggttccgttgcaattgaacggcatcgatacggatgaatactacatttcgggtgcgcctgatacagttgatatcaccttgactggttcgtcggctttggtaaccgcagctaagaacaccaaaaactttcaagtctatgcagacctaacaaaactgactgatggtacacacacggtggcactaaaggtgtcaggtttgaaccgcgatttgacgtataagctagccaagtcgaaggtaactgtgacgatctataagcggacgtcagcttattacaccgttcacacggattacaataaggatgcgattgcggacgggtataccgttggtaccgtgacgtcatcagttaacaacgttcagttgatgggacgtgaatcagcagttaacgaagtagagactgtggttgcggtggcacaattgaaacgcgacacgagtaagtcagtcacacagacagtgacgttgcaggccctcgatgctaaggggcacccagttgacgttggcatttcaccacaggtaacgacggtgaaaatcccagtgacagctgggacaggtaccaagcaggtaccgctaaaaattaagacaaaaaacgggtcggcttcaaactttaatcttacgggctctgtaaatgagatcacagttcgtggtaagattgatgtattgaataagttaaaagagattcctgtgacggtcgatttgaacggggtgacggcagcgtcatctcaagatgtcacggtgaatacgccagacggaacggatagtgtaaatccgacaacggtcacggtaacgattacgcccaaggagcaataaaaaacattatggttgaattacattattttggaacagatggtgtgcgcgggattgccaataaggaattaacgccagaattggctttccgtctcggtcgcatgggtggtgcagttttgacgcgccacgctgaaggacgccgaccacgcgtgctagttggtcgtgacacacgtatgtcaggacaaatgttggagcatgctttgattgctggattgctatcagtcggcattgaaattttgcgtttgaacgtcatttcaacgccaggcgttgcttacttagtgcgtgcccaacaagcagatgctggtgcgcaaattacggcatcacacaatccagccgaagataacgggattaagttctttggcgcggatggcttcaagctatcagatgagttggaagctgaaattgaagcgttgcttgatgcaccggaagatacattgcctcgtccagccgctgaaggcttgggtacagtgtcagacttccctgaaggggctgctaagtacctagagtacttgcagacaaccatccctgatgatttgtcaggcatgaacattgccattgatgcagccaacggtgcaacgtctggtttagtcgcaaacttgtttgctgacatgggcgctgactttgtcacgatggccacatcacctgacggattgaacattaacaagggcgttgggtcaacacaccctgaagcgattgcgaagtttacggttgaaaatggtgcccaagttgggttggcatttgatggtgacggtgatcgcttgattgctgttgatgaaaacggtgacgttgtcgatggtgataaggtcatgttcattaccggtaagtacttgtcagaacacggtcgtttgaagcaagacacgattgtcacaacggtcatgtcaaacatcggtatgtacaaggccatggctgaaaacaacatgtcatcagttaagacagctgttggtgatcgctatgtggtcgaagagatgttgaagtctgggtataacttgggcggtgagcaatcaggtcacgtggtgttcttggactggtcaacaactggtgatggtatgttgacagctttgcaattgctgcatgttatgaaggcaacaggcaagaagctgtcagaactagctggtgagatgacagtcttcccacaaaagttggttaatgtgaaggtccaagacaagaaggccgcgctagagaatgaagcgattaagcaagtgattgctgaagttgaagccgaaatgggtgacaatggtcgcgttttggtgcgtccttcaggtacgcaagatttgttacgtgtgatggcagaagctcaaaccgaagaattagttggggcttatgttgatcgcatcgttgatgttgttcgtgcagaagtaggagtggattaagaacatggctgcggattatcaaacgcttgatattattgaggagattacccgtaacgacggatcgacttataaggaaattggcaatcttttgcacaatggtcaagccgaatacgccgctgaacaggggatgattcaatcggttcgtattttaaaaattaacattcctcactcaggaaacgttgaaaaatacgaaaagtacgttaatgaacattttgaaatacctgagatggttgccatcaaagaatacacagaatggactaagacgcccgaaatggatgatgttatccaaaaaattctaactgagaatcaagttagttaaacaattaaacccggtctggcagatgcgccagaccgggttttttgttacttttgattagccttatttgtgtggctcagtgataagtgggcttgttgaaaggcgttagtaattgttgttgtttcattaaataaccagtttgattgattcatgataaactcgctttctcaagatattgtccttattataggattaaaacgatggttataaataaatggtgctaaaagtgaaacaaaatataccgttttttcaaaaatgtcccgtatcctagtaattaaggaagttcacgattgggggaaacgcggatgacacagacattagctgaaagaattaatgaaataaggcgcaacaaacaggtgtcggttcaaacaattgtggcgaatggtatttcaaagagtaaatattttgcgtacatgcgtggtgaacgagatttgtcgattcgcgatttgcaaattttgatggatttgttgacggtctcctttgcggagttggtgattgatacagatgtcattccagaaccctataatttaaatttattacgtgctcgtaatttgaccgttgaccagttagaaacgtttcgggatatgttacaagctaaatatgcccagtctaatttagtggcacaccgacagtatggtctggcttttaattacttggtggcctacaagagcgatgctgattgtaaaccggatgtaacggcattatatgatgaacttaaaaattatcgggtattcacgttctttgagatgcaactattttcgttgattgccgaatcattaacccctaagcgtttttatcggctctatgaaatttttgtgcaaagcatcgggttgtttagcggctacatgccaatgccgatttatctcactattttacggattcattattatgccttggttcatctaacacgtccttcacttaagtcttggccgacaatgttatttgttttagaggcaattgaaaatcaacctgcgcgcccgtcaaatattgaattgtttatgctacgcgaatttgccaagatgttgaaagcatactacacagttgatagtccggcagcggaacaacaattccgaagttggctaaatgttgcgattgcgcgtggggtggttgaaattaaattaacctacgatacattatcgtttcctggtttatggcaagccttaacgatgaagcgttcacacatggctgttaatggtaagtcaatgtttacgacagattatgcccatattcagtcggcggagttagcagataactttggcgatgcgctccaaattttgttgaaagggaaatgaattaccgggagcgagttagaagaatacggcatcacgcggtcaaagttatatcgtattatgcatcaggacgtggtcatccgcttaaatgatttgttcgaaatgatgacctacttacggttgttgcctgctgatttaacggtgttcttctttaaaaatccaacgtcccgagcgcgggaacgtttcgcagcattcttggtggatccaaccgattatcaaacagtggtcacagaggctttggatcattatgaaatctcgcatagtaatgctgattatgaaacggcacttgaatttcaagtctatgtcaaccaacaactatctgattttgatccgacgagcattgtgcaattagacttagcacggacaattacggactacttattaaaactggatgaatggcatgaagcggagcatcggctagtgatgtattcatttatcgacattgatgatgttgagatggtgataaaacgcctgaggattgcagatgagtacatgcatcatcgcaatgtatttcgagcaccgattagttcagttctgaataatgccgagtattctttactgaaggccgtcattttaaaccaacgagcagattttgataaaatcatgaccgtggttgctggcgaacgggagcgtgatccgcaaattttccactttgccacttggcgctggcgggttgacgtctttgactactacgagatgatgtttgacaacccggccgcggggttggcggcgttcgaaacgtttgtgaccgattatcaagttttaacgggcaaaccgctgtttccaaaaaacagaaatttcattgctgatacattgaagcatcactttgcgacagttttaaaagagggagataccgcaacaaaatgacaattcataaaaccattagcttgacagcctgaacaaaacggtgaaatttgtatcgtttttggcactttttggctgaaatggcaggggataccttactctaggtacatagcaaaacgagaaacaggatgtgcttagaaaagagaggtaagggacatgaattggattccagagatgatgaagcgcgcagccaagtatggtggtgatttagaccatccagaagtggttgcttgggcacacgagcaatggcaaaatgcagcaaatgaatggcgttatgaagtcgatggtgaacaccgattcaggacccaagctgaactggccacttacttgcacgttggtaagatgcaactaacaaagtttatctcacaaggcgtggaagaattccaattgcggggccaccgcatccgagttaatgatgatgtttatatggctcgtgaaccacaaattagctaattgataaccacttgataattgatcaggtggttttttattttgtaatgaaaatgtaaagtaaaacgtaaaccgtgatagagcaacacgtaaaacgtttaaatttgttaactagtaaaattagccgcgtttaccattttacttgcgagtgctatattaaatgcaacaacaaataaccttttaaaaagtagtccagtgaggctatgaagggttgccgttggttgggggaatttaaggggataactgtattagtccgcctaaaaactaaccagaagcaaaacctcgtgaatcactgattcacgaggtttttttgatgcacagaaagggagtcaccatgcaaaactttgttaacttgaacgagttgccactcacgacaattcaagacatgattgctgaagcactagcctacaaacaaggcaagcgtcaaccgacgcagacgccaaaattagtggccaacctattctttgaaaattcaacccggacgcacaccagctttcaggttgcggagacaaaactagggtggcaacggattgcgattgatccacaaacgagttctacgcaaaagggtgaaaccctgtcggatacgttaaagacgttagggtcggttggtgttgatgtggttgttctacgtcatcatatcaatgactggtatcaaccgctggtcgctgagcaatcagagttgatgccacaactggtcaatgctggtgatggtagtggccagcatccgtcacaaagtttgttggacttggtgacaatctatgagaattttggtcactttgaaggattaaatatccgtattgttggtgacttagcacattcacgcgttgctcggtcaaatgcagcggttctgcaacgccttggggcaacggtgacatttggtggacccaaggcatggtacccacgtgaatttgaaacctatggcacgtacacggggcttgatacagaactagagaaggtcgatgtattgatgctcttacgtgttcagcatgaacgcttagatacagatgaaaacacgaatttttcagccgctagctaccatgctttacatgggctaacacgtgaacgatatggacggttgaaggaacaggcaattatcatgcaccctgcgccagttaaccgcggtgttgaaattgctgatgagttggttgaagcaccgaaatcacggatttttgaacaaatgaccaacggtgtatatgcacgcatggcaattttggcggcgatcgcacgagggggagaatgatgacaacacttttgtttaagcaagttcaaattgtagaggctgaccaagtggtcacacgagatgtcctggtgactgacgatacgattacggcagtggccccacaacttgatgtaacggctgaccgcgttattcaagcgacgggccaattattaacgcctggtttggttgatattcacgtccattttcgcgaaccaggttttgaatacaaagagacgattgcaacggggtcccgcgcagcggcccgtggtggttttacgaccgtggcagcgatgcctaatttgaaccccgtaccagctactttatcagcgtttgaaactgtccaagcacgtaatcaagcagcaggtgttgtccacattgcgcagtatggtgcgatttctgaaggactaaccgctgacgaaattggggatttgccagcattggctgctgcaggtgcaattgccttcactaatgatggtaaaggggtgcaaaccgcagccaccatgcttgatgcgatgacggccgcagccaaggtgaatcgaccactagtcgcgcacgttgaagatgaatcgttagtcagaggcggggtgatgaatttgggggcacggtcagctgaactgggcttgccaggtattaatccgcttgctgaatccgcccaacttgcgcgtgacctcatgttggcccaagcaactggcgtccattatcacgtcgcacatttatcaacgaaagaatctgtcgccttggtgcgcttagcgaaacaaaacgggattcatgtcacggccgaagtctcaccacaccacttattgttggatgaaactgatattacaggggatgatgccttgtttaagatgaatccaccactacgtgcgccggcagatcgggcggcagtcattgctgggttgttggacggcaccattgatatggtggcgactgatcacgcaccgcacagtgtggctgagaaggaacggtcctttatcggggctgcatttggtattaccgggattgaaaccagttttcagttgttgtacacgcacttagttaaacctggtattgcgacgttagcgcaattattaacttggatgaacgcagcaccaattgatgtgttccagttagaggcaccaaaacaggttgctgtcggtgaacgcgcggacttggcattgttcgatttagaaacaccatatcaaattaatgcgcaagatttcttgtctaagggtgtgaatacgccgttcattggggaagttgtctatgggcaaacgcaactaacattagttgccggtaagattgcttatcaagcagagggggagttatgaagcgctacttagttttagcaaacggatcagtttatgcgggtgaagggtttggatcaaccaagccagttactggtgaagttgtttttaatacggggatgtcagggtatcaagagtcactgacggatttgtcataccatggtcaaatcttgactttcacgtaccctttgattggaaactatggcattaaccgggatgattttgaatcactccgtccggctgcaagtgcaattgttgctcatgaaattgctcgacgcccgtcaaattggcgttcacaaatgtcattggcggagtgggcagagaaaatggatttgccaggtattacgggaattgatacgcgcgcgttaaccaaagaaattcgggagcacggtgtcatgaaggccacgattgttgatgaagtgaccccagacgtactggcaaccttggcggatacgactttgtcagatcgacaagttgctgaggtaacgacgcaaacgacatacgttaacccaacggatggtgtgtcaattgcgatgattgatttcgggttgaaaaactcaattttgcgcgcgttagccaagcgcggcgttaatgtgacggtttttccagcgacagtagatgcccaaacgattttggatactaacccagacggggtgttactctcaaatggaccgggtgaccctgagtcagtcgagggggtattgccggttattcgtacgttgcaggatcgcttgccattgatgggcatttgcttgggtcaccaattgtttgccttagccaatggcgcagaaacttacaaattaaagttcggtcaccgtggctttaaccacgcggttcgcaatttgaacactggccgaattgattttacgtcgcagaatcatggttatgcggttgatgcatcatcaattgttgatacgaagttagagatcacccacgaagaaattaatgaccacacagttgaaggattacagttgacgaaccgaccagccttctcggttcaattccacccagatgcagcaccaggtcctcacgatgctgagtatttatttgatgattttttgcagatgattgccaacgaaaagcaaggagtgcaacatgcctaagcgtacagacattcgaaagattttagtgattggttcaggacccattgtgattggtcaagcggccgagtttgattattctggtacgcaggcaacgatgtctttgaaagaggaaggctatgaggttgtcttggtaaactcgaaccctgccaccattatgacggatgcggaaatggctgaccgtgtttatattgaaccgctaacgttggagtttttggagcgcatcattcggaaagaacggccagatgctattttgccaaccttgggtgggcaaacaggactgaacttagccaaggatttgtctgaaacaggtatcttggccgaaatgggcatcgagttactcggtacaaaattaacggcgattgaagaggcggaagaccgggaagcgtttaaagatttaatggatcggcttcatgaaccagtccctgagtcaacgattgccacgacggttgatgatgcgttaacatttgcgacaacgcatgggtacccagtgattgtgcgcccagcgtacacccttggtggaaccggtggtgggattgcggccacaccaactgaattggctgagattgcggcaaatggtttggaattgtcaccagtgacgcaagtcttgattgaaaaatcaattgctggctttaaggagattgaattcgaagtgatgcgtgatgcggctgataacgccttaattgtggcatcgatggaaaattttgacccagtcggtatccacacgggtgattcgattgtggtcgcaccggtgcaaaccttgtctgatcgtgagctgcaaatgatgcgtgatgccgcgttgaaaattattcgagcactcaagattgagggtggcgttaatattcaaatggcattgaacccagagtcattccagtactacatcatcgaagtgaacccacgtgtgtcgcgctcatcagccttggcttcaaaggcaaccgggtatccaatcgcgaagatggccgccaagattgcggttgggctcacgttggatgaaattattaacccagttactggtacgaccatggcacagtttgaaccagccctcgactacgtgatcgttaaaattccacgttggccattcgataaatttgccaacgctgaccgccgtttggggacgcaaatgaaggcaactggtgaagttatggcgattggccgtaacctcgaagaggccatgaataaggcaattcgatcattggaaattgggacgctcagtttgcgtgacaatcgttttgagaacctagcaactgctgagttagtggatatgttaatgccagcccgtgatgatcggctgtttatgattggcgagttattccgtcggggtgtcacgctggccgaattacatgcagcgacgcaaattgatgaatttttcttagacaaagtgctgcatttgattgagattgaaacacaacttacgcatgaagtcggcgatgctgacacgttagcattggctaagcggaatgggtttgcagatcaaacgattgcggacatttgggggatgacgatggacgatattcgccagcgtcggcaacagttacagttgcagtcagtctacaagatggttgatacggtggcggctgaatttgcctcacaaacgccatattattatgcaacttttgaacaggaagatgaatcagttgtgagtgagaagccaagcgtgttggtattgggttccggtccaattcgcattggtcaaggtgttgagtttgactatgccacggtgcatgcggtgaaggcaattcaagcagccgggtatgaggcaattatcatgaactcaaaccctgaaacggtgtcaacagacttctcagtctcggataagttgtactttgaaccgctcacgttggaagatgttctgaatgtcatcgaccatgagcaaccgcttggggtggtcgttcagttcggtggtcaaacggcgattaatctagcagcgccattagcagcacgtggtgtcaacattttggggacgacggttgaaaatctggatcgtgcggaagatcgtgaagcctttgatcaagtgattaaagcactgcaactgccacaaccggttggtaagacggcaacgacagtaccaggcgcgttggcagcagctgaagaagttggctatcctgtcttggttcgaccttcatacgtgttaggtggtcgtgcaatggaaattgtgaccaatgcggctgaattgaccgactatatggggcgtgcggtgaaggtttctaatgatcacccagtcttaatcgattcttacttagtgggggctgaagccgaagtggatgtgctatccgatggtgagacggttgtgattccaggtattatggaacacatcgaacgtgccggggtgcactctggtgactcgatgtcggtttacccaagtcagacacttagccaaaaggtcaaggatgaaatggtggcagcgtcaattgcattagccaagtcactgcagaccgttggtttgatgaatgtccaatttgtcattcatgataatacggcgtatgtcattgaagtgaacccacgcgcatcacgaacagtgccatttatttcgaaggtaacgcatttacagttggcccaattggcgacgcaagtgatgctaggtcaacgattagcagaccttggcttaacaaccggcttggtacccgaaccaacaacggttcacgttaaggcaccaattttctcattcaccaagttacctgaagttgactcattgctgggaccagaaatgaagtcaactggggaagtgatgggatccgacacgacgtttgaaaaggcgctatacaaggcgtttgaagcgtcaaacatcaaggtgccaacgtttggtaacgtgctattgacagtcgctgatgaagataaggaagaagcgctggtgttggccaagcgttttgctgacttagggttccaattggttgcgacggcggggacaggtgcttacctacgtgataatcagttagccgttgagattcttgataaaatcagtgaatctgacaataatgcggtatcagcattgcgaaacggtcacctacaaattgcgattaatacaacgcgtcaagatggcgcaacgattagtgatggccaacggattcgacatgcggccatcgaaaatgcagtcccactctttacggccttcgacacggtgggggctttgcttcgcgtcttggaatcacaagggtttgcggttacagcaatggcctagacagttatttggggagaactaacatggaagaaacacgttattcagtatcattgccaggattggagttaaagaatccctttatgccttcttcaggggcatttatgtacggcttggatcacttgcaagattttgacttaaatgaaatgggcgcgttggtcttaaaaacaacgacggttgaagcgcggcgcgggaatccaaaaccttgggtgattggcactgatagtggcattatgaattcagttggtttggctaatccagggatggcgtcggtcgctaatgaggtgctgccagaactggcgacggccttaccagacctgccagtgatgatttcagtagccggggaaacggtcttagaatatcaaacgttagccaaggtgtttgatcggattgactatatcaaggcattggaactcaatctgtcatgcccaaacgtcgacaaaggtgggatggaatttggtgttgatccggaaacggcggccgaagtagttgccgccgtgcgtgaggtgacggataagccattgtacgcaaaattatcaccaaatgtgacggatataaagccgattgctaaagcggttgctgatgcaggggcggatggcttagtgctgattaatacggtggttgggatgagccttgatttggccacgcgccaaccacgcttgtaccgcggtactggtggtatgtcaggagcagccattcacccaatcgctgtgcgtatgatctgggaagcagcttcggtggttgatattccaattattggggtcggcggggttgattcaattgatgcggcccttgaattaatgcttgccggtgcgtccgctgtgcagattggcacgaaaacagccgaagataagcaatttattcccaagctaattgcggctttgccagcggcccttgataaatatggttttgacacggtgcgtgatgttactggggcggtggcaaagttcccactacccgttacggcttgggaagcgacgcattaggagagatgatgacaaaaccagtatttattgcgttggatttttccgacgcgcaggaaacaatggcctttctagagcagtttccggctgatgtccggccagcggtaaaagtggggatggccttgttttatcgtgaagggccagcgattgttcgccaactaaaagcggctgacttcactgtgtttttggatttgaagttgtacgatattccaaataccgtggcccaagcgacgaatcatttggcccagttgggcgttgactatttgacgattcacgcagccggtggtgttcggatgatgacagctgctcgggagggtgccgtagccggtgccacattggttaatggtcaggtgcctaaattattagcaatcacgcagttaacgtctttttcagaacaagagatgcaagagacacaacttgtgacggtaccactattaacgagtgtggttcatttagcgcaactggctgcgacagctggttttactggcacaatctcctcagcgttcgaatcacgcgcaattcatgaagcgacaccaacggactttttatcgattacaccaggtattcgcttagcaggtgatgcagttggcgatcaaaatcgcgttgtgacaccggcacgtgcgcgtgaaatgggggcgaacggtattgttgtcggacggtcgattacacaagcgccagatccagttgcagcttatcagcgcgtggtcgctgaatttcagggggaataacgatgacagattatcaaacagaagttgccgcggcattgcttaaaatcgaagcagtcaagcttcaaccgacggcaccgtttacctgggcttcgggcattttgagcccaatttatactgacaatcgtaagacaatcagctttccagctgttcgtcggttgattgcgcaaggattggcagcgttgattaagcgtgaatatccagatgtccaggtgattggcggtgtggcaaccgccggtattccacatgcagcctgggtggcagaagtgctagatttgccaatggtgtatgtccgttcaaagcccaaggatcatggggctggtcaacaaattgagggggttgtactacctggacaaaaggtcgtcctgattgatgatttgatttcaacaggcggctcggtgttaggggcagttaaagcgacccgagcagctggcgcggaagtattaggtgttagcgccatcttcagttatgaactgccagcagcaatgcaaaacttcggcgaagcgcaaaccccatttaacgcgttaacaaactacacgacattgttaacggtggcacagcaaacgggggctattcaagcgtcggatttggcaacacttcaagagtggcgtcaagatccacaagcttggcaaccaaacaattaatcataaaaaaccagttccagtgtggactggttttttatgttgttgggacgcttattttttcaccagttaatatttagctaaggctagcggtgaaatgtccccaaaattggcctttgttgataaaatggaacataagactatttgtgaaaggtgaccaactatgaatatcggattattcacggacacttattttccacaggtttctggtgttgcaacgtcgattcaaacgttgcgccgtcaattagaagccaacggacataaagtgtatatttttacgtctaccgatccgaaggtaaaaaaaggcaccctggaacctaacgtatatcggtttgcgagtctgccttttgtgggctttaaggatcgtcggattacgtatcgtggggccattcaagcggtgcaattagcgaaaaaattggaattggacttagtgcacacgcaaactgaattttcgttgggcgtcattggtaagtttgttgcccgccaactgaagattccggtcgtacatacatttcatacaaattacgaggactatttgcactatattgcgaatggtaaaattattcggccaggtagtgttgctgtgattgcccgcaattttatggcgggaatgacaggaattatctcaccatcacgccaaacttacgacacattaaccaagtataaggtgaaagcaccaatcgaaatcattccgactggcgttaatgtgctacatggtgctaatgaagacacaagtgctaagctacggggtgagttaggtttggcgccagatacaccggttgtcttgtcacttgggcgcgtagcgtttgaaaagaacttggatgacgccttatcggtctttgcggaagcgttagaaacagtgcctgaagcaaagttcgtgattgtcggtggcggtccagcaatggaagccctccaggaacacgtttcggccttggaaattacggatcatgtcatttttactggtgaagttaatcataatgacgtttatggctactataagatgggggacgtgttcgtctcagcttcagtatcagaaacgcaagggctgacttttatcgaagccatgacggctgatacgccggttgttgccattcacagtccgtacttagacacgattgtgactgataaaaatattgggcaactggttgacgatagctttcaattattagaaccgatggtctcgtacttgcaagcaaaagagatggggacagtcattggtaatccagacgcccgtcaacaagtactgcatgaaattgatgaacggacctttggtaagcgggtgattgatttttacgcagaagcattggcagtctaccatgaagaggaggatacggaagcagctgaagcaaatgacgttgagtactcaaagacattcttgcttcgcaaccccttccgacgtgataactcatgattaaaataacgatgttttcatcagctgaaaccgtgccaggacaaggggtgggttcagcgtaccgcgagttggttaatttactaacgacccgttttaaagacagctttaaattacgctttaattcattggcaccagctgatgtaagtcactatcatacaattgatttttggttctacctgaataccttcctgccgggacgtggtcaaaaggttgggtacgtccacttcttacctgaaacattggacgggtcaatcttattgcactggccggttaaaaatattttctactggtatgtgatggcgttttacaagcgtatggatcacattgtggtggttaatccaacgttcattgagaagctggtggctttaggtgttaagcgggacaaaattacctatattccgaattttgttaccaaaacgcaattccatccgttgccactagagcaaaagcagactttacgtcagcagtttggcatcgaccaagaggcatttgtggtgttgggtgttggccaaattcaagaacgcaaagggatttgggacttcattgcactggcacgagaaaatccacagtggacctttgtctgggtagggggcttttcatttggctcaattacagccggttatgatgaattgaaaaaggttctcgctgatccaccagctaatctaaaattcccagggattgtagatcgcgcagtcattaacgggtattacaacgttgctgacgttttcttattaccaagttattcggaattgttcccaatgtcagcgttggaagcatttagcaccgggacaccgacagtcttgcgtgacttagatttgtaccgagcgattattgacggctactatttgccggctaaagataaagcggatatgcaacaagagcttgcaaccttagcgaccgattcagatttgcgccaacgtttgtcagaacaggcactcgcggcttcagaacgttattcggccgattatgtcgcgggcatctggcaaaagttctacacggaacaggctgcactaggaaagaggtagctagatgacaaaacgtaatgggattgtctttgttattatgctgttaatcggcctaggcatcttttactggtcatttcgtacggtgaatttgcatgagtttgctcaagatttacggcagactaactggtggtggcttctggtcgccgttggcgccatggtgatctatttgttgcttgaggcagtcgttgttaaggtctttgttaacgatgcacatgagaaattaagctggaaggatgccattcgggtaccgttggttgaacagtttggtaacggtattacgccgtttgccaccggtggtcagccaatgcagatgattacaatggcacaggctggaattgaccccggccgtgccggttcaattctattgatgaaatttgtcgtatatcaaggcatgattgtcgtgaactttatcctggcgttggtgattggctaccagtatattgcggataagctccatgcttgggcactatttgtaattttagggtttttggtgcatttggcagtcattgttggtttgttgttagtcatgtattggccagcactaactaatacgttggtgcagtggctgtttaagccgattcagcggtttaaacctgataaagcgactgcttggcgggaaacggttgacgctaagattgtgaatttccatcaagagagtgttcggatgagtcatgattggccggctttgtggcgggccatcgtggtgacgttcttccaaatgatggtttattacctaattccgtacttcatactgctggggttgggtgtgtcacatgttaacgttatcttggtaacggcctttcacattttgattgtcatggtcatttcgctgtttccgattccaggtggaacgggtggggccgaggctggttttgcgatgttattcgcacagtttctgcctaatgcagcgttacttgtatttgccatggcgatttggcgcctgattacctactatatggggatgtttgcaggcatcctagccttcagcttaagtgccgataagatagaaagaggaaaagagtgagtcgagaaagtgatttggtacaaatcgctcaacgtattcgtgccatgatggtagatgaccgtgatgatgtgcaaacacgacattttgatgcattcggggtcacagttgttacagtcatgtatgatcggccatcacaaacatttgcagttgagggactacgtgataataaccgacgttttgcgtttgatgacgcagatttggttgcgatcgatatctatgaagcgttgcaggactttaaggagaccttttaaaactgtgacgaaaagttggtatcattaagtctcttttatgtttcgttaatggaacagctgtatactgaaagaatataatttaagaacggattgtcgttcgagataaaatggagcgtaataaaatgcaacgagtaatttcagctatcaaaaaatggtggccggactttaactcaacggttggcttcttcttgttgtccgtgttcttggtttggttaaaaacctactgggcatataagacgaaattttcactgggagttagcggatctttgcaagagttcttgctatttttgaatccaattccaacagcaattattttgcttggaattgcgctttacttccgtggacgaattgcctactggttgatgttgttgatcaatttagtacagacgatttggctgtttgctaatatcttgtactatcgtgagttctccgactttttgtcgttgaatattatgaattctggtggctcagtcgaaaataacttgagcaagtcaattgcaggtattattcaaggatcggatttcctggtctttttggatattattgtgttgattgttttgttgttaacgaaggtcattaaggtcgacaagacggccgtccaaaagcgatttgccgcattaacgaccgtgtttggtatcttgttgatgctggttggctacggtatttcgtcaaaggatcgctcaggcttactgacgcgaacatttgataacaactacattgttaagtatttgggtttgaatgaatacgcggcctataacgtctttaagacaaaacaaacggcagatgttaagaaggaagcgaaagcctctgacttggataagattaagcaattcgtgaagaacaatagtacgttgcagaattctgtttacttcggtaaggagaagggcaagaacgtgatcatgttccacttggaatcattccaacaattcttgattgattacaaggttaatggggtagaggtgacacctaacctcaataagttctaccatgatcaaaacacattagcatttgataatttctacaatgaagttggtcaaggaaagacagctgatgctgagatgatgttggaaaccggattgtttgggaccgcttcgggctcagcaatggttaactatggtacgtcaaatacgtaccaagcagtaccagcatggcttgaccagcaaggttatacaacggctgccttccacggggacgtcgcgtcgttctggaatcgtgataatacctataagtcatggggatacgattacttctttagtaagccatattacaaggatgctgataatgccagctacaacatcggctacggtatgaaggataagattttcttgcaagatgcagctaagtatgttgaacagttgccacaaccattctatgcaaagctgattacggttactaaccactatccatatgacttggataagcagaacatttcaattgaaaagacaacgacaggtgataagacggttgatgggtatgtgcaaacggcccgttacctagatcagtcatttgctgagttcttaaattggatgaagaaatctggcttgtatgataagtcaatgattgttttgtatggtgatcactatggtatttctgaaaaccatccagctgcaattgctaagttgatgggtaagagttcagttaacaagtacgaccttgcgaactggcaaaaggtgccatttattgtgcacgcacctggtttgcagggtggcgtgaaccacacgtatggtggagaaattgacgttatgccaacgttgttgcatctactaggtgtctcaacagcgaatgatgtgcaatttggccaggacttgttggcaacaaaccgtaagcaagttgtgccattccgtaatggtgattgggtatcagcagagtacatgaagtatggtggcaattactatgtcacaacgactggtacgaagataaatccaaaggaagatccacgcgcaaaggaaatcattgaccagacgcaggagtacgttaataagatgttaacgtactcagataacgttcaaacgggagacttgttacgtttctacacacccgaaggctttaagaaggttaaaaagtctgattattcatataagaagtcagatggattgaagttgttgaagcagatggacaagaagcaagacacaacgttgaaggatcaacatgatcagaagtcgaccatggctgactatgtcacggatgcaccagaacttggtggtcaaccgcagacgattcaacaagcatcaagtagcagcagtacatctactgacggggcagcgactgatagcgccgctgttgacgatagcggtgctgcaacggatagtacagcagttggacagtaataacatcacaaaaagcacgcagatttaagtctgacgtgcttttttattgttcggaattaattgatgaattaaagtagttgacgaacgttcgcgaatgcgatatattatttaagcactcgaaaacggaaacgtttcttgtgaaacttgaataaaacaaagtgttgacatcgtgttgattgcttggtaagatatttaagttgtctcagagagatatataaatcgaatgagattgatattgaagttgttgaaataagttgttgacaatttactttcagtcattcacagatatttcatatctctgagacgacttaatatataatacagaatgttttttgataagtcaacaacgagttttaacaacgttttcttattatcaacacaccctcgctcgagtgcttaattaatataccgcttttcataatgttcgtcaactgctttgttttcgaaaatttttccgaacatttactgcaccttcagtaaatgaaaaaagcgctccatgatagctgactatcacgaaacgctttcgttccatcttattagaatagggccaattgattttcatccggcatgccagcaagcacgccattctcatctaagtaatccatcaacgtctttgacacaccaccacgctgtgcaagatcttcctttgacaggaattcacgttcagcacgcgcagcaatgatccgcttcgcaacgttatcacccagaccaggcaccgcattaaacggcgcaatcaacatatcaccatctaagacccactgctctgagtcagacttatacaaatcaaccatattgaacttaatgccacgctcaagggcttcattagccaattcaagcacagtcaataaatccttatccttagctgaagcttcatttcccatttttttgatttcttgaattcttgccttagttgaattcaaaccacgtgacatggcaacgatatcaaagttgcttgcgcgcactgagaaatatgccgcgtaatacaacgtcgggaagtataccttaaagtaggcaattcgcaacgccatcaaaacgtaagcggccgcgtgagcacgcgggaacatgtacttaatcttcaatcctgactcgatataccactccggtacgccagctgcacgcatttcggcttggtactcatctgagattcccttacccttacgtaccttttccataatctggaatgatgactctggctgtaccccgtagttaatcaagtcggtcatgatcttgtcacgcgttccgataaccgtaccgattgtcgcaaccccacgttgaatcaattcatccgcattaccacgccacacgtcagttccgtgggacaaaccagaaatttgtagcaattcagaatagttcttcggatgtgtttcctccaacataccacgaacaaacgccgttccaaattcaggcacacccaacgtacctgacttcgagaagatctgttcttcatcaacgccaagggcttctggtgatgaaaatagactcatcacccctggatcattcatcggaatcgtttgcggatcaatgccggacatatcctgtaaggcacgaatcattgtgggatcatcgtgacccaggatatccatcttcaggatattatcgtgaattgagtggaaatcgaagtgggtcgtccgccaagtggctgacagatcatcggctgggaactgaattggtgtgaaatcaaaaatttccatatcgtccggcacaatcaagataccagccgggtgctgaccggtagtccgcttaaccccagtagcgcccaaagccaaccgttcaatttctgcacctcggaaactaacatcatgatcacgctcatacgcctttacgtatccaaacgcggtcttatccgccaccgtcgcaatcgtaccggcacggaatacattgttctcaccaaacaaagacttcatatagttgtgagcaaattgctgatagtcaccagagaagttcaaatcaatatccggcaccttgttacccttgaatcccaagaaggtttcaaacggaatgttgtgtccatccccaatcagctttgtcccatcaattggactcaacttttcaggcaaatcatagcccgactcatactcacgtggatcaacgaattccacatagtcaccagcgacactacgatagtgcggtggcaaggcattcacttcagtaatcccgattaacagggcaattagtgaagagcccaccgaaccacgagatccaaccaaataaccatctttatttgacttagccaccaaacgttgcgcaaccaggtaaataaccgagaatccgttagaaataattgaacgtaattcttgctcaatacgggcttcgacgatttcaggtaacggatttccgtacaaacggtaggcggtgtcatatgacttctgccgcacttcatcatctgcgccaggcatgttaggtggataatttccacccttaatcgcctcaacatcgtcaatcatgtcagccacaacgtgtgtattatcaatgaccaactttttagctagctcctcgcccatccaagcaaagtcatccaacaactcctgggtcgttcggaagtgcatatctggcaatgaataacgattcaagggattagccccaccttgtgagctaatcaaaatcttacggtaaatggcatcctcgggattgagatagtgtacatcccctgtcacaaccaccggcttacccaattcatcaccgatttgtactgcttgcatcattagctcacgcaggcgggcttcatcttgaataagttcagcttccaaagccggtacatagttagctgatggttgaatttcaatgtaatcgtaatacgtcgccttttccttggctgccgcataccccttctgcatcaaggcttcccagaattcaccagtgttatccccagtacccagcaacaaaccttcccggtatttattcaatagtgaacgtggcacacgtgggacacgctgcagatacttggtatttgattctgaaatcatcttataaaggttcttcaccccagtttgcgtctgaactaacacaatcgcatgatttggtcgaccgtgacgccaagcatcattgtccatcatgtggtcattcaattgatccgcatactcaatgccatactcctcacgcgcttgctccaagaaaacgcggttcaaatgacccgttgtttccgagtcaaagatggcacgatggtgttgttccaaaacaatgccaaagtgcttagccaacgtattcaaacgatatgaccgcatgtttgggtacaagaatcgcgccaaaatcaacgtatcaatgactgggtttgtaattggtgctaattgatgacgggcatacccttcttgcatgaagcccatatcaaatgtcacattgtgtccaaccaaaactgcgtcgccgtagaattcacggaattcttcaaagacttgcttttcgggttttgaaccgcgcaccatgtcatctgtaatcgacgtcaaatctactgttgtttgactcaatgggaacccagggtcgataaactcagaaaactctgcaatcacattccctttaaccattttgacggctgataattcaatcaccttgtcataagctgctgacaaaccagtcgtctccacgtcaaagaccacaaattcagcttcatcaagtttcgtgtgatcagggttaaagatgattggttcaccatcttcaaccaaattcacctcaactccataaatcattttgatgtcgttcttagcagctgaagacgccgcttctgggaagccttgcgcaccagccgtatcagtaacagcgattgcatccatgccccacttagctgcttgcttcacgtaatcgccaatcccatttgtggcatccatcgtcgacatcacagaatgcgtatgcaattcaattcgcttttgttcaccttcatacggatcgagacgtggcgcatgcttgataatttccatatcatacgccgtcatcgtcaaatcacgcacaaagtcatcttgttgaattggaccacgggcacgaatccatgtgccaggcttcatatcagcaaagaacgcttcatcattttcatcgcgtgagaacttcttcaagataaacgaactcgtgtagtcggtcaccttcatcgttagcaattgacgctcagacttcaacacgcggacttccacatcaaaaacatatccttcgacaattacagaacgttcttcagtctcaatatcgcccatcttggtgatttctgcatctgcggcaattttacgacccaatgcacctggattattaccaccaccgccaccattacgtggggctgattggcgttgctttgccgcctgctcaatttgaaccttcgccatctcggctagctgttgatcttgcgcagcgcgttgtgccataacctgagcatgtgattcggccgccaactgttcatcaaccaaaatgttgaacggaagttgataaccaacccccaactttttataggttccttcaataattggtaaccctgtttgccgcgcatagttggcccaaacagcggtatcgaacgttaagtctaattggttaccagcgatttgtggcaacacatgtgcaaacgcctgccggaaagcacccggttcgttttgatgctgttgcagtacccatgtccaataatccacaatttgttgtgccgttggttgttcagttaaatgcagctgataagttgtttgcgcaatattggcaaacgccgtctgcatccgggcaaccaaagcagccatctcctgcactggaggtaactgaggcatctcaaaatggaattgccagattttcgattgcttgtgcacagcaagcttggttagcgcagtttcctgcaaacttgctgggacttcctcatattgcaattgctgcaacaatgtttggaattgttcttgtgcggtcaacgccatggataggtactcccttctctcattttcacagtctgcaactattataccctcttctgattacaggacgataactaaaacaaaaagaccgctagtgaacaacactaacggtcttttcggatcgcggtaaatgggcttttaccgcgttctattctgatgacatgtctcgcacatcatcgatttttaaggagtaggttgcaggttggttaaacctgcgggttatgagtagtttttatgggctgttgactggatatctctgtatcccttatcaacagtcataatcataacgacccaaacttaaaataagaataaagtcgccttcagtttaaaaatgggtaaacgctaaaacagtcaagacggcaatgatgccccataagaacttacgcatcgtcatctcccctttcacttatcattcatacaataagtatcccagaaaaatgtgcccattttatgaaagcgatttcgcgctaactttttcttaataaaaaagccgaggtaattccccgactttcacgacagctaagattaagcttgtgcatccacttcaggttgcaacaagatttgtagcgttgacaccaattcttcagtgcggacttcaatcgcctcatcagccttacgcaacttcacttcaacgatcccttcgccggccttcttaccaatcgtgacacgaactggcaagccaatcaaatctgaatcattaaacttaacaccagcacgttcgttacggtcatcaaccaatacttcgtaaccagcttcaaccagcttatcgttcaactcatccgtcaaagcacgttgtgtttcatctgaatacttcattggtaccaagtgcacgtcccatggtgcaacagacgttggccaagccaaaccgttttcatccgcattttgctcagcaattgcagccaacaaacgtgacacaccgataccatatgatcccataatgacatctgcttggcgaccattagcatccaaaacttgggcacccattgattttgagtaacgtgtgcccaacttaaagatgtggccaatttcaataccctttgtaaacttcaagtgacccttaccgtcaatagccaaatcaccttcacgggccgtacgtacatctgccacttcatcaatgcggaaatcacggtcaacatttgcgttcaagtagtggaagcctgattcgtttccaccgaccgtcacgttaaccatgtcagttacccattcgtcagcgatgatcttgacatcctcaccaacaccgactggtcctaatgaaccgaatggtgcacccaaaattgattgggcttcttcttccgttgccatgcgcaattcatcagcgtgcaagtagttttggactttaacttcgttcacttcgaagtcaccacgaaccaaaatcatcactggttcaccatcagcgtacataaacaacgtcttgaccaattgatcaggcgtcgtttgcaaatagtcagccaactcatcgattgtcttgacttcaggcgttgcaatcttttccaaatcagccatttgcgcgtgcgacttgtttggcgtatacaaatccttcgccatttccaagttagctgcgtaatctgattcatctgaataagcaatgatatcttcaccggcttcggcaggcgctgagaattcctttgagtcagaaccacccattgcaccagcatcacccacgataacacggtaatccaagccaattcggtcaaagatattgatgtatgctgattccatgttcttgtatgactcgtccaaaccatcttgatccacagagaatgagtatgcatccttcatgataaactcacgaccacgcaagacaccaaaacgtggtcggttttcatcacggaacttagtttggatttggtaaaccgtcaacggcaaacgcttgtatgacttgatgtcatcacggatcaacgttgtcatcgtttcttcgtgtgtcggtcccaaaatcatgtcgcggtcatgacgattcttcaacttaaacaagtttggaccgtatgtctcataacgacctgattcttgccacatttcagctggcaaaagcattggtgctgacatttcaatcgcatcaatcttttccatttcttcacgaataatggcgttgatcttgttcaacacacgttgtgccaatggcaagtatgcgtagacaccagcagaaactggacgcatgtaaccagcacgcaacatcatttggtgcgagataacttctgcgtcagcaggcgtttcgcgcaacgttggaataaatacctttgactgtttcattggataataacctcatccctattcttagcgcacaaagcgcactttaaaaattcttatattatagtaacacatatcatcgggcccgcggtttacaattcggggtcatttcagaggacaaataaataggaccagccaatttggccgatcctattaattcattagtgttcacttgaagaaatatcgaataatgtcgtttccggtaacggcaatcatcaatacaaacaagaacgcaacacccgctaacgtaacagccgtttcaactcgttccggtagcggacgtcgcacaaccgcttcgaccgcattcaggagcaacttaccaccgtccaatcctggaattggtagtagattcatcatgcccaaattaactgagagtaatgctgtgaatgacacaattgctaagaagccatacgagcttacttgctcagtattcttataaatagcaactggaccacctaacttattcagcgaaaaaccttgaatcaagttctgaatcgcccggaatatctgtgtcatggcttgaccagtcgcacggaaggcatattggacacgcggtacaaaggccttagtcgttgtcggcgtcaccccaatctggccgaccagcatgccaccgttttttacagctttcggcgtcagcgttgtcgtctttgattggccgtttcgctcatatgtgaccgtagtcttctcttttggcaaagcttgaatcgtcgtttgcattttctgccatgacgacattttcacgccattgattttttcaatcgtatcgccctttttcaaaccagccgtcgctgccggtgagttctgcgcaacatcttgcaacgttgtcgttgtcactcccggcatagcgaaagccaagcccatgaacaagatgaccgttagaataaagttattcatcggtccggcaaagttaattagggcgcgttgccaaagtttggctgattcaaagtgcgtatcacgtggggcaaccaacacttccgtaccatccgcttcgatgaccgacgcttcatgatcaaccggcagtttaaccaacgtttgatcatcgtccgcccagtaaccctccacaaacatatcgtcaaccaaatcaacccggttaacggttaacgcacggccaccaaccaattcagtctgatcagacaagtttaagcgagttaccaccccatcttgctgcacgaccacaattgtcatccccggccgaatggtttcttcttcagcctcagcacgaccagccatccgcacataacccccgactggcaacacacgaatcgtgtacgtcgtcccgttacgccgggtttgaaacagcttagggcccatgccgattgcaaattcacggacacggacacctgcctttttggcaaaatagaaatgtccaaattcatgcacaatcactaaaataccaaagacaataataaaagtaataatcgttgtcataatttctccagcgttcccttttcaataggccctagtatacaacaaaaccctggccgatacgttaaaatcgcccagggttttactattttctattagtttagcaagccaaacaagaacatcaatggcaaaacaatcaacattgaatcaaagcgatccaaaataccaccgtggcctggcaataccgtaccagaatccttcaccttgtagaaacgcttcaagccagactcaatcaaatcaccaaattgacctgcaactgacaaaatgatggcaataacgaccatcactggccagctatatgcttgtgggaagaagactaggtaaacggttgctgcaatgacagctacaactgtcccgccgattgaaccttcccacgtcttattaggtgagatggtggtcagcttgtgcttaccaagcttgcgaccaatcatgtaagcacctgaatccgtaatccaaacaattaggaaggcgaacatcaaggtgtccaacccggcattgcgggcagcgaccatcatgctgaagcccatgccgacatacatcatcgtcaaagtaaagacgccggcatcctcaaagctgaacttattcttggcaatcaccgtgtgtaacaacattaacaaaataaagatgtacaacaacgatgtccggtgcaaggcgattggtgcatggatattatcccatagcgtcgctggtagcgtcattactaatgcacccagcatcgtcaatattgcaccaaagtcaaccaacaacgtcttacgcatcaagacgacttcactcgctgcaatcactgccaacaatgaggccgcagcttgaatccacaagcccccggcaatcaaaatcggcacaaagataatcagagccacaacggctgtgataacacgtgtcttcattattccactcctacttcttatcgctttgattttcagcaatgccaccaaaccgtcgatcacgagcttgatacattgctaatgccttttcaaagaccgctggggttacctcaggccaatgttcgtcaatgaagacaaattcggcatatgccagttgccaaagcaaaaagttcgacaaccgcatttcaccactcgttcgaatcaagacatccgggtcagcgaattcacccaatggcgccgtcatcagcgcagcatcaatcgttgcatcgttaatttcttccggttgtaattcgcccgcagcgacctgtgcagcaatctgttgcacgccagtcacgatttcggcacgaccaccatagtttaaagcaaaatttagcaccatgccggtgttatttgccgtctgggcaatggcgtcattaaccgcacgttgcgtgtccactggtaattggtcaatgtatcccattacgttcacacgcacatttttttcgataagttctgggacaaacgtgtcaaaaaacttaccgggtagcttcatcaaaaagccaacttccgtctcaggtcgcttccaattctctgttgaaaaagcgtagagcgtcaataccttaacacccaaatcactggctgccttggtaatatctttcactacttccatcccgcgttggtgaccagccacacgtggtaaattctgtcgcttggcccagcgaccattaccgtccataataactgcaacgtggtttgggattcgcgtcttatctaattgtggcaattgatccgttacgaccgttttttgctttttgaaaaacacgatgcttcctccgcctctataaatgtaaaatacgtgactggcttaaagtcacgtatgtcaatccgtcttattatagcagtttgtcacatagcgtgtacggtaaaatcccctgctttaactattacttatcaaaaacagtctcatcatcgtaagcacccgctagtaacgcttcgatagtgtctaacacaccattatgattgttatcgttaacggcaagattttgcacgcggaccttcatgaagtcttccgcattcggcatcacaaatggatacttcacataacgcaacatctccaaatcgttaccgttatcaccaaaagcagccatctcttcaggcttaatatcccacttagcggccaattgttccaaaccagttcgcttatttacgccaggcgccaaaatatcaaccgagccgaaaccagatccggttgtgtgaagctcttcgccaaagacctcgcgcaattgttgcacgtgctcatgaacatcaaccgaaggatcccacactaatgagaaacggaagatattgtcgtcaacatccataaacttttcaacttggtggacagttgggtagaacgtcttgaccgccgcaatcatttctggcgtcgcgtggtttgacacataggcgccatcattacctgacaggataatcaaattatccatattagcatgtgtctcactattccattgcattacgcgtgcaatctggtcgcgagacaatgacgattcggccaaaacctcattattgtgcgtaatcaaagccccgttatccgaaacatacgtaatgcggtcggggttgaccggctcaaagtatgatcgtaattgcttgtattgattcccactcgctgcaacaaatcggatgcccttctcatctaattgatcaagcaaatcttccatccgggcatagtcgaatgtgcggtcatcccgcaacaatgtcccatccatatctgttgcaattaacttaattgtcatcgttcccatttctcctttgctttgaaaataatgagcttactcaatacgtaattagagaccaccacgaatacgttttgaataatattccataacatatcgttttggtggagcagactcgttccgaaccacaaaatcgccataccgattaatccagttgcgattcgcgcaacataaaacttaacggcctcatttagcaattcacggaaaccgtgtgcctgactatcaaagacccacacacgatttgttaaataggcaaacagcaccgtgaagaaccaggcaatgacgtatgccaccataattggcatctgggttaagcgcaacccaccatacaaaatgatattaaataccgtggttaagccaccgaaaaacaagtataaaatttgggcgcgatacttagtaaaaattgtcatgactgacttcatcagtaaactctcaactctctaggacataatttcgtcacatttttatctttaaagcattataacaaactgccccgtaatccggttagtttgctacaattatgtagttagattttacaaattgccttaactcagcttgagttggcagaataaatatcagtgaaaggagttctcatggcgaacgattatcaaaatagtcttgcccgtcttaatcaattggcagacaatcccacgtcagcgtcattcaccagcttggataatgttcatccccaaacccgaacaacccagcgtcgacaagacaaccgcccgcaatggcagcaaattcaatggatctcaattttgattgcagtcctatcgcaacttgcaatttggtggatttacccagcaatctactcaaaaaatttagcaggtggccaatggcaacacaatcccctactgatgacctatagtgtcatcttggccctggccatctttttaacttttaaccgtgggttctcacgttggttaaactttggcgttattttaattccaatggtgttcctgtactttctctatcagcaggtcactatgcagcagattattttgttagcgctgctgccacttgcattgctcctcattaatctcaaatggttaaatctacaaaacatcttaggcttggtgctatactctggcatcgccacccttgccttgccggttgtgattttctatcagcaaaacaccttcctgacagcgcctttcatttggagcttgttaccattgttatttagctatttgttctacatgagcagtatttttgtgaccactggacgcgacaaacgggcgacttcattagcctttggcatcattttattgttagatgtgttgaccttgcctttgaatccgtggacgttgttagccattatgatcatcgtctttacctggatggtgttaatcaatcttaatctcaaggctaagtaccggatgggcgtcttttcattgctccaagcaattaccgtcctggttatcttcttgcagcagaaataacgcttaatactattaaaagccgcaaatcacccgattcaatcgaggatttgcggcttttaaaatatgtactgaatggttgcatgtttcatataatgccattcatctcatacgccgttagtctgcatcttcctgttcactcattgcaaaaagtggcttttttagccggtagacaaccactgccaacaaatttccggccaacaacatcccaaacaagaattggtacggatggtctttaacaaaattgactggcatcatcgcagttgcctcagtacgcccggcgttcacatcccgggcccaacgacgctcgcttaactctggtgtttccaccgccccgacaatcacgggctcatcatgttcattttctgatactgacacatccgtcacctgggtaggctttgtttgcccgtccggaactgacacaattggttcggcatggtccgtttccgtcccagccaaattcgacaacgtctctttgatagattgtataacatttgtaacaatgccctgattatcatcagtagtcacatcccgagccaccaccagcgtactggtcatcaacgatttctgcgataaaatcgtgctggcctgaatggtcccgccgttgactgctacccctatatacaccgtcatcaataacgttgcgatcagagatgccgtccttatttttttcatcacttcatactctcctctgtaacaacgaacaatgtccagtcgtaatcattgcctcccagttactgcagaaagttacatgttttacgctgttcattcacgataaaaatattgtaccgatgattttcttctaatttagggcatttgtttgcgttttgtatgtccaaactatcggatttttcgctttttccatctgttttccatgcctatttcgtgaatgtccgacgggtgggattttttcacaagcgagcgccagtattttgtacaatcaatatgcatattacatatataaaaacgcatgcccacgctaatcgtaggcatgcgttttacttatgctttgtaattcaatttctcattcgccacagcgtaccacgctgcaactcgatcggtgaccttgccgtctgggaagtaagttggataccaatagttaatcatatccatatcatccacatgcgactcttcatcattcatccagctatcacggaatgtcacgacaccagtttcgcgattaatcttgaaccgtgtcaccaattgttgaccattaaagtgcaaatacaattgtcgcataccggcctcgcctgggaatggctctgaagccagttcggcagtggtttcagatagtacttgcgtggctcgctcacccaaatatccatgatcggccattgcccgcaaaacaacggcaacagtaatctcacggtcagaccgttctgctagaaatgctttgtaatcaaacatgacgtaaatcccctcttatctcatgaagtcttttcttcacggataataatagcacttgtcagcagcgataggaaaaattaggcccccaaattgtacttgtgccaaccggtttataccaaaatatatcatctagattcccaccccaaaacaaaaagcaccagccatcatggtcagtgctttaaacgttattttagtatgttagcgcaagaaaacgtactttgtccaaaattaataacatcgccgtttgcgttgcttcatagtgcttcatttggtcttccgaaccatattgttcgttaaaaccagccaagcccccttttatgaacgccaattcatattctgaaatctcttcgaacgtcttcgtgaattcgtcccataaatcagtttgatcttcttggtcttccaaaaagaattggataaaacgggcatccgtatagcccatgctgaattgcaccccaatttgaggcgcaatttcatgctggttcttgatgtgcaagaaatggtgctccgtgttccagcgaatccgctcaattgccttcaaaattgtcttgttcattgccatcaccctcatttaagctgttattactttgctagcaacggcaagacccaggtcgtccacgcccaactaattggcataataaacagcatcgctggaatcatgtcagccgtcgggaacatgcgcaccttaatcattcggaaccccgttgctaacataagggtaccaccaaccgccttaaagtcaattatcatggctggcgtcgtgagcgggtagattactccggccaacaaaaacagaatcatcaacacaacgaactgcggtacggcaatcaatgacacaacaaagcctaagttggctgcaaaaatagcaccggtgaagaaatccaaaatcgactttgtaatcaaaatggtggcatccccagtcatcccgttcaccaacgctccataaataccggtgccagatgaaacaaacaacacaataacggttaacaaggatgccgaaaactcttcttctgaaagcgtcttgtttgctgggacaaaccgggcaatgatgcgttgcatttggaacgctccccggttaatccacgcactcacatgcaggagcaacccaaccgcggttccaataatcaaagcaaaaatgaccgcggccatatttttggtcggtgcaatcgcgatgatccccatcgtcatcgacgccagaccaaaaatcatattaatctcagttttaaacttttctgataagtatttaccaccaacaccaccaacaataccgccaattaatacggctagtgcattaacaataactcctgtgggcatataacgctctcctctcaaaaatcacaatatatccaatatatacccattttgatagaattagcaaaaaaagcggtacagctagctttcactacctgtaccgctattgattaatcttacttttcaaaatcgtctgacgtcattgatgcgttgtacaaagccaccacatcagctggtgtcattggcacataaccattgtccaaaccgaacgttaccgctgattcagccatttcttggaagtgttcatcgttagtgatttcaacacctggcaagtttgttggtacctccaatgacttaacccagtcatacgttgcttgaatagccttttcagccacaacttggtcgtcatcatcttgaattgaccagacattccgaccgaagcgggcaaactttgccactgtcttatcagacaagacaaacttcatccaacgtggtgtcaaaatacccaaaccgacaccgtgggtaatgtcatagaatgctgacaattcgtgctcaattgggtgcaccgtccaagcattttgcttacctgatccaaccaaaccattcaatgccatcgttgatgcccacatcaagtttgcacgtgcttcatagttatctggcgttgccaatgcaattggcgcccacttaataaccgcacggtataggccttcgatttgaccatcttgaatatccgtatcgttcgcttgatcgaaatattgttccgtcaagtgtgagaagatgtcgattgatccagctgccgtttgccactttgatactgaatacgtcaattgtggatccaagaatgaaacagctggcgtatttggaccaaacgtcccaatcttttggttcgtctcagggtttgaaatcactgatgcccagttcatctcagttccagtggctgacaacgtcaaaatatcaaccaatggcaattgatcgatggcgtaacgcttatccgcatccagcaccaagtcccaaggatcaccctcgtagaacttagcagaagcaatcacctttgacgcatcgataacagaaccaccaccaacggccaacacaacgtcaacatcatgttccttaacaaggcgttgcccttcacgaactgagtcaatctttgggttaggttcgatacctgacaactcaataacattcaagcctgacaaagccttcatcacacgttcatacaaacctgaacgcttgattgaaccaccaccgtatgccaacaagacattttgtccgaattgcgcaaccgcatcatgcagctccgtatcaatgtgattcttaccaaaacgaatgtctgtcttattcacaaaacgaaaatcttccatggatagcatcctccaaataagttgttatttttctcatttatacctaatactatacacccttaaccgattaattgttaccgttttcacgaaaaaatctagttacagcggtctttttcatttgcactagttttcctggcagtgataaggtagataagttgtttttcacgttacgccttttacacgcaacgttcagttagatagaagtgaaaggaagttccaccctatgtccacacagaccgagcggttatttaatcgcccatttgcgcaattgtttttgattcagttacttagcatggtgaccttttatagtttgtttgttgccatcagcccctatgccgtggcaacctaccacgtcagtaccgcgacggctggtttagttgccggcatgacgattattgggacaatgattgctcgtattttttctggtctcatcacccaccatctcaccgctaagcaaatgaccattcttagcatggcaatcctcttaccttcattgttagcctaccaactcgaattaggcattggttatctcctatttgttcgtttctggcaaggaattgcggttggttttactgggaccgtcacgaacaccgccgttgtccgcgttattccagaagcgcgccgcagtgaaggcattgcctacttctcgttagcgacaattttaggaaccgcatttggcccatttttggcgctattgatcacgcagtacgtgtcttaccacatcctcttctggttggaagctgtgattgctttaattgctttgtttttctcgtttatgctcgacggcgataaaatcgcgattgaccgcggtcatgtagatgccaagacgtccattttcagtcagctattagagccccgtgttttcccaattgccttaacgatggcctttgtggcgctgggatacgctgccttgcaaggtgacttggccttctttgccagttcgttacacttggtgacgtttgcttcatatttcttcttggtctacgcttttgtgattttgctctctcgtccgttcatgggccggttaatggaccaacataacgagaacttcgtcatttatccaaccctactcgcgactgctttaggtctgttcgcaattgcccgaatgcactctggttggggcatgttgctcggtgccgtactagtcggcctgggcttcggtaacttccaatcagccattcaggcgaccgttaccaaagtggtggcttccgaccgcttagcgcaagccacttcaacctacttcattttctttgatatggccctcggttttggcccatacctactcggcttggtagtgccaaccctcggttaccgtggtttatttacgatggttgccctattcgccatcatcggcctgccactatactacctggtgcacggacgccacattcaaaaataagcaatacaaaaacccgccattcaattcgaatagcgggttttcatactgcctattatttaatcagaccgtgcttcacaagataagttcgggcgacttgggccgccttcttgtgttgcaccgtaacttgataattcatttcaatcatatcttggttggtaatcttaccagatagcttattcaaactcttcgcaatccctggatacttttgtaacgttttatcgttgaccaacggtgcgccctgataaggtgggaagaagtgcttatcatctgccaacgttactaagtgatcttgtttcaactgtgggtccgtcgtgtaagcgtccgtcacatcgatttgcttattagctaacgcttcataccgcaaactcgactccatttgcacgatgttcttgaagttcaacccatacgcttgctttagtccaggatagccatctgacaacttgtagaaatccgggtcaaacccagctgtcatctgcgcgctttgacgtaacaagtctgaagttgtctgcaagtgatagcgcttggcatcaacttgacgaaccgccaaaccatacgtattctcgtacttcattggttccaataagtccaagttgtgttgctgcttaatcaacgtcttcgcttgcttgtacgctgtctgcttatcgtgtgaaattgaccccttaaccttaactaacgactgtaagaccgtccccgtaaattctgggtacacatccacttggccaccttggagcgccttaaaaataaaggtcgtccccccaaagtttggcttcaattggacatccattttggggttatcggcttgaatcaggtctttatacatattaatcaaaatttctggttcgccacctagcttaccagcgattgtaatcgttcctgctggttggttaattgcccggtaacccgcaaaaccaccgataatgacgattgcactgactaacagcaccccaattcggcggactgatagcttactcaacaagcgaatgccccatgaaaaagccaatgccaaaacagccgataaaatagccccaatcaacaattcagcattattattcgtctgaattcccagcatgataaaggtacccaaaccaccaccgccaattagggcagccaacgtggccgttccaataatcataaccatcgcgattcgcaacccagacataatcatcggtaacgccaatggtaattggacccggaataatttgaagcgctttgacaacccgaaggcatccgcagcttctaacaaaattggatcaatccctgtcaatcccgcataagcgttttgaaaaatcggcataatggcatataacaccaacgaaattacagctggtaccgtcccgataccaaccaacggaatcagcgcccctaaaatggcaagacttggaatggtttgaataacacccgctacctgcaagacccactcgccagcgcgacgatgattcatcaacgcaatggccagtggcaacgcaatcaccgtcgcgatgacaattgccatcaatgacaagaggatgtgttcccgcaaagccgtcaaaatatcaccagactgggtcgttaaaatgtgcatcatatcattaaacattcgtcactacccccttgcgacaaagcgcaataaatcagccgttgtcagactgacatccgccactgtcacagtatcatgcgtcaacaacgcctctgacagtgttgcaacagaatcagttggcatcaatgtcatcgtggctggcgtcgttattgcttgtccgaaaccagcatccaagacgtcttgaataagtgcaatgcgtcgttcactaaacaacgtttccaccaattcgtttgcgggatgtgtcgtaatttcttgtggtgagccgacttgttgcaacacaccatcatacatgacaccaatgcgatttcccaaacgtagcgcctcacccatgtcgtgggtcacaaacaaaatcgtcgtccctaaatctgcgtgcaattctagcaccaaatcttgcaaagagcgtcgtgacaaagggtctaatgcactgaacggttcatccattaaaataatatctggttcggccgctaacgcccggacaatgccaacccgttgctgctcaccaccagataattcatttggcatgcgttgcgcataatttgtatggtctaatccgacgcggtccaacagctcattcacccgcgtttgccggtcagccaatgtgaccccgctagcttcaagctgaatcccagcattttgaaaaatcgtcatgttcggaaacaacgccgaattctgtagcacgtacccaatgccaccacggagatcttctaatttatagtcaattgcccgcgtaccacgtacataggtgtcgccatctgttggctccaccaaacgattaatcaactttaaggccgtcgttttcccactaccacttggcccaactaagacgaatagttcacctgcatcaatcgtcaaattcaaatcatttaccgccgcttggccttggtaaatcttcgaaatatgtcgaaactcaatcatctcatccacacccactttccgttaatcagtactctgatagtaccgctaactcaattttcttacaaatgattagagagattctcattagtcagttgtcatttcttcatattacaagacttgcatcctaccagcaaaccagtagaattggcaccaaaggagcgtgaacattatgtctaaatatgatcaagatgaactacgaaatcgtttgacccccgaacaatatgctgtaacgcaggaagcggcgaccgaggcaccctttaacaaccaatatgacgcttggtttgatgacgggatttacgttgatgtcgttagcggtgaacccttgtttagctcaactgacaagtacgacgctggttgtggttggccttcttttaccaaacccattgaaaaaaagcgggtgaagcgccacctcgacacctcgcacggtatgttccggaccgaagtgaaatctgctgatgccgactcgcacctcggccacgtcttcactgatggcccaatggctgccggcggtctgcgctactgcatcaattcagctgcgatgcgttttgtacccgtcgccgaccttgaaaaggccggttacggtgagtacaaatcattattcgagtaagtaaaagaggttgagacgtcattatccgtctcaacctcttttttttaattttctacttattgaagaacacggtcgaaataatatacaacactgccaagtgacttggatagaaaatgtagaagaaccacttatccttgcgtccttgcttaccgttatacaacgccagtagtggcaccgcaaagatcatcatccactggatatctgagaaaccatgttgtgcactttggaaaagcatccacaaactaaaggcagtatacaacaataaggccacagctcgcttttcccggaagatgtggaaaatcaatgccaacagcaagaatacgacgccaccctcaatattcatcaaattcggtaccgccaccatataaatccgcattggcaagacgtttcctgttgctgcaaagctcagcatcacagccattaaagccgttgacccaattaaataaataatccccaacatgctccaggcaaaggccttcttattcgcaatcgggtgcttcaagccatcccaaatccacatcaccatcacgcccaaaaacagcgtgccgaaaattgcattcatcaatacaacgtgttcatttggcaattgcgtttgcaagataacttccatcacgctggtaatccaaaacccaatcaagaggttgcgcatatagccaatccgactgtgtgtgtaatggaacccttccgctgccaaaaacaggaaaataggcgcgaccacgcggccaagcattgtcatccattccggtgcaccaacgtatgcaaacatctggtgaatgtggtccgagaccatcaaaataataccgatcacttttagcgtaaaacttgttagaccataacgttcttgtaatttagcaagcattgtacatcccctcaaaaataactcttattaaccaacacacaatactatacgttatctaatatcgtttggcaacacaaaagagtcatttcagaaaaaggtacgtgcactagatagcatcaacaactgccaataactcgagtaatgccaacgcaacttcgctacccttgttaccggccttacccccagcgcgatgttgtgcttgctcaagtgtatcagcagttaacaccccaaataccgttggtacaccagtcttcaagccaacttgggcaattccagtcattgccccattaatcaccaaatcgtaatgatcagtctcaccacgaataacggcgcccagcgtgacaatgccatcatatttagcggtgttcgccactttctcggctactagtggaatttcaaatgcgcctggcacgatgtaaacatcgatatttgccatctccaccccatgcatcgtcaatgcctcttttgcccccgctagcagtgggtcagtgattagcgtattaaatcgactcatcacaatggcaatatgacgtccttcgtgcttcgttagcgttcctgtaactgttgtcatctgaatttactccttttaaatcatgtgtgaaaacttatcgcgcttcgtggccatgtatccggcattgacttcattaacgccgacaatcaatggtacgcgttcaactacttcaataccgtgcttggctaaatcatcaattttagctggattattcgtcaataaacgtactttttgataaccagcatctttgaagatttgggcagcctgggcataatcgcgttcatcaggttgatggccgaggtgttcgttcgcttggaacgtatcatagccattttcttgcaacacataggtacgcaacttttcagcgagtccaataccacgcccttcttgacgcaggtaaacaacggcgccaccctgctgatcaatctggtggagcgcttcgtgtagttgtggcccacattcgcatcggtatgaccccaacacctcaccggttagacactcggagtgcaatctaactaatggcacttcatctgtcgtcacagtactttgaattaacaaatccggttcacggccagccactgtataatccgttacacgaaattcgccgtacgcgcttggcagcttaatcgttggccccatccgatttggtcgttccactaacgcttggcggtacgcaatcagttccgcaatcgtcaacgtcactaatttttccgatgatgccacatcagccaacgccgtttcacgtgccatccgaccatctgcgtctagaatttctataataaaggcgactggtggtacccctgccaacttagccaaatcaacggcggcttccgtgtgaccagctcgtgctaacacgccatcgggaacggcaactaacggaaaaatgtggcctgggcgttcaaaatctgttgattgcgctgacagatttgctaattcccgcaatgtctgcgcccgatcgaccgcagatacacccgttgtcgtccctttatggtcaacgctcaccgtgaactgcgtcccaaatttttccgtattagttgcgaccatttgagggagttgtaattgtgccgctcgttcggcagacatcggtgcgcacaacacgccacgcccaacgcgtaaagcctggttaacgttttcagttgttgcaaatgaggctaaccccactaaatcgccctcatgctcacgctgggcatcgtccgttaaaataatcaattggccttgtttaagcgccgtaattgcgcgctcgacacgctggcggatttcttgattcattttgtttactccttcgtcaaatacttcgctaatacatcagtttccaaattaactacgtcaccggtttgaacagtacgcaacatcgtatgcgttaaggtatgcggaattaacgcaatcacaaacgccgtcgcactagccgtcacgaccgtcaagctcacaccattgactgcaattgaccctttcgtaacaatttggtgcatcagcccctggtctgccggagtaatcgttaaatagactgtttcgtcagtttgtgacattgttgtaatcgttccagtcccatcaacatgccctaacacaaaatgaccatcaaaccgatcacctgcccgtatggcttgctctaagttaacgacttcaccaacctgatagtcttgcatccgggtgacagccattgttggcaccatgacatcaaaagtggcctcgtgatcgttatatgtcgtaatcgtcaaacaaacgccgtccaccatgatactgtcgcctagttttgcgtctgcaaaataagcagatgctgttttaatcgctaaacggcgttctttttcatttcgcttagtcaaggcgaccacttgcccaacttcagatacaattcctgtaaacattacttcgcctccctgtaaatgacttgatgtagcgcattaccaacacgtgtctgtgttgcaacggggccctgattgcccaccacgcctttaatgccagttcctaacacagcgtccgtttggtaaatatcaaaacgttgccagagattagtcgctagaaaggcacgcactagcgctccgccgccttcaaccagcaacgactggatgccacgttgtcccaaatcatccaacaacgaccctagttcaccgtcaaaaaacactgcttgcggcacctgctgggcaaacgtggtgtttgtcgtataaatcaacgtccgatcatcaaaaaaggccggatgatgttgcaagcgcccccgccgatcgacaatcacgcgccacggttgttggtgtgtgattgggacatggcgcacggtcagttgtggtgcatcagttaaggccgtctcgctaccaaccataatggcactcatttgggcacgttgctgatgaaccgccacattcgcttggtcatcagttaatttagtggcttgtccccgtttggcagcaataaacccatcgatgctttgtgctaacttcagcgtgacatagggccgttgcgtttcaaaaaaatgatgaaaggctgggtttagtgccgtactaccttgctggttaagcagtgtgactgcgataccagcctgctgtaatttggcaacaccacggccactgacgtgcggattaggatcgccttgcccaattacaacccgccccaacttcgccgccacgagtgcatctgcacaagcaccgaccttaccgacgtgcgcacacggttctaacgtgacatacatcgtggccccaaccagattcgccggatgttccacctgattcatcgccgcgacctccgcatgctgatgaccaaattggtgatggtaccctgtcgcgataacggcgccatccttcactataaccgccccaacccgcgggttttcccacgttgcggccggatcagcttgttgcgcggcttgatacgccaactgcatcattgttaaatcatccatgtttcccctaactactccgggtagtaaaaaagccccaagtctgctatatcagcaaacttggggctgttgccaggaccgatcaggctttgatcggtctgacacctcgttttgggtatcgaaaaaactgcgtaaaggggccaaaaaaataagccactaacgcgataaattttgatatcttctcccatccagactttactgtcggttgcagattcacactgcatcaaccggattgcttaatcacaacccaggtcacggactgaggcatacgccatcaccgtcggtcgggaatttcaccctgccccgaagatttattgattatttatttaacacagccatcatacagttctcatgaataatttgtaaacccttattttttgacgcacctaacaaaaagtgccggcacgacccctaaaaagcagtcataccggcacttcaacgttattcgttattttttaaattagttaaccgcgacccgtcgttaacttcaagccaacagctccgataataatcatactaataaacaaaatgcgcttccaatcacgggactcgttgtacagcaacatgccggcaattgtcccaccggcggccccaattccggtccagattgcatatccggtacccatcgaaatatcacgcaaggccagcgtgagtaagccaatgctaagtgccccgcctaccgccataccagtagcggcccaccaggcgcgtcgtttctgccactcattaatcatgatgacacctgacacttccatcaagcctgctaagactaaaaatacccatgccattacgccttttcctccgccaataatttcagaccaataatgccgcctaataaaatgaccaagaaaactaattccgcgattgtcataccatcaccaaatgcgacccagccggtcaccaccgttgccacggtaccaaggccgacaaatactgcgtaggcggtgccaaccgggagttgttcgctagctgttaaaaacagtaacattgacaatcctaatgcaattagtgttgcgacccacatcaatggggtgtgcgcatgtttaatacccacaacccaaccatcttcaaaaccaattgccaagataatcttgagccacggattctttaacatgcttttgctcctaatcacttacttaatgtgattattatactagtttctgtgccatttcggctaattttggcctgaataacagaacagtgctggtcagcttagtaaactttgcgctcaacaacgctcatacggtgcacattatttgaatgcgcccgcgcaaacatttcagcattactaatggtattcgtttcgtaaaaatgcgtgcctaattgatcacgaaccacgtatgttgtcattccctgtttcatcatatccccctacttaccgaaccgttccgccaaagcttgctcatctggatgaaaatagtgatagcgcgaaactggtaaataagcctcatcgcccccaatttcgatttgctccccttcatacactggcttaccatcgtgaatacgtaaattcatcgtcgctttcttagtgccaaacgaatccaacgtcttcatttcttgtaacttatcagcaaaaatcagcaatgcttcagaccctggaaagagccgatttgaaaaatcatttttcaagccaaacgccatgacaggaatgtccaaatcatcgaccacatttgccaactgaatgacctgttggcgcgtcatgaattgtgcttcatcaaccaggacgatatctggcaacttatcagccgacgtgactaacgccattaaatcatccgtatcatgaatgatgccagctgtctcacgcaacccgatacgcgaggatacttcgccaatctttgtgcgatcatccagtgccgacgtcaataacaatgggtgacggccttggattttatagttgtgtgccactttcaagatttcgatggactttcccgaagccatcgtgccatatacaaacgttaattgcgacatccaactcacctcaaaaactatttttaactcgatttagtttacgcgcttttgccgattttgcaagcgccgttaccaaacgataaaccggacaattttcacgaatgttcgctttcgaatttcaaaaaccgcttgacatggttggcttatcgccaggctcccgcttaaataacgaacataactttccgttaggttgatgaacatgaaacacttccgaacaaaaaaggccgccagatataccagcagtcttttagcgtttatttaaatttcagctagcgtagcggagtggcgttcgccatcaaagtaacgatccaaaccagtcgcaaatggtgtcttatcagtggccactgcttcaaacagagtccaagctgcttgcaacttgcgggcatccacatccccaaacactgcttcgatatcagtcgttgtcagacccaacacaatattggtcaccttgagcaaacgctcttgcagcgtatcgtttgccaagtaagcccgtgcttcatcagcatcagccagcccatagtaaaccgcgcgttcgctggttcccaaggcccgtaattgtgggaacacccaccacatccagtgtgagtcctttttacccgccgttaattcatctactgccgtttgaaaactattggcctcgtcttgtgctaaaataaatcgcttgatatcgtttgctaatgcttcatccatcacatgtcacctcatccgtattttgaccctattctagcacataattagccctgtcttattggcgagtgtccgacaactgttgatagtcggtaatgtgttgcaattgtttatgcgtcacctcatccgcctgcggagacagaatcgcgctcataatattatgaccgttcatgctgtgacccaggccaagtgcatgccctaattcatgcgccagtgttttagttaatgtattctgattggacagcgtcaagatatcacctgacacgcgcaactcaccagactgtgaattcatccatgccagtgcatgggttcctgaatccgtcccttcgtcccccatctcaccggcacgaacaatcacatccgcattctgcgtcacggggactaatttaatatgaatttgctgatcagattgttggcgccaaaacttaattgcaccgtgcaacgccttttcaacatttggggtcgtcgtttgaaaatcactggtcataatcgcgacggttagctcatcattgtggccaacatacatgccataactatcacttgttggtccaaatttaccggcctgtcgtaattgttgattttcccggtcggcctgcgcaatggtcacgtcatttaactgacggcgacgcgactgataattaattgcgttcatgataggctcgatactactaccaagcgacccaaacaccagcaacaaaataatggccgtataaacaattttgcgccatccccgccgtttccgtggctcaggttgcggggcagcctgttcattaatgccatacagttcataaattttgcggtctaattcatcatctggcacgtgtcacaccccctccgagacactaatcataggtcgtttgctgccatcacggcgttaaaaaggtcccccgtgcatgggctgcttgatatcctacccttaattctactgccggatcgcacccgttttggttattttaggcaacctttttgaatattctccccagcaatacgcgcaaaaaaagagaactgattataaccagttctcctcgtttgttattatgcgtaattttttagatatgaaattcccatcgcacctggaccagcatgggttgattcgattggcgtcgtttctgcaatatcaacaatcgcctctgggaattcatcacgtgcccgggcagctaattgctcggcctcttcagctgcatcagcgtgtgaaataccaattactgcaataccgtttggctcggcgtgcatccgctcgaaaatcaaatcttggtaccctttaattgttttcttaccgcggcccttgacttccatcgtaattttccccaatggtacgtgagcgcccagcttaatatccagcaatgtgccaattagcccagacgccttcgacaagcgccctccagcgactaaattcttcagtgtcgtcaccgtcaaatacaattcagtattatcctcaacacgttgtaattcggccaaaatctcatcacgcgatgccccagcctgggccatccggccggctaccaaaacttgcgcggccaaagcccggtcgatgtagttagaatcacggactacaatgtcatggggcaccaaacgtgctgcttgttcagccgcctgaactgtcccagacaaatggtgcgtcaaatgcagtgaaaggacttcgacgtcttctggtactgttttgtaaacttccgtaaacgcccccaacgaaggttgcgatgtcgttggcaaacttttagatgcggccatcttctcaataaattcacttggcgtgattgacaccccatcgtgataaacagtgccgtcgatcatcacggtaagcggcacaactgaaatatcgtactgcgcgacttcttcaggcgtcaagcgtgctgttgaatcggtaataatttttactttagtcatctcgtttcccctcgttactaaatatttgtaagttaattcgttttcaaaacttattcatctagtatctaaaactatatcacataaagtccgatttttacaacgttttttgtaagcaaaacctagcaacccacttttaaaaaatacgtcagcacaaaaaaacacctgattcgcgcacgcgcctaaccaggtgttttttaaattgtcattattagtacggcatctcaatagcgtcgagcacggccatatctgcagctgtaatctcaaaatcaacatccgcattttgcgccacatactcagggtggttagcctttggtagtggcaacgtccccttggccaacgcataccgaatcgccaactgcgcgacagaacgatcatagtgcgccgcaatttcctgaagttcaggcatgcggagcaaacgacccgttccaattgggctgtacgcttgcactagcaacccattggcttccgtaaacggttggttcacgtcttgcgtcatgccaatgtggtaaataatttggttaacgaccggcttaatttcggccgcatccagaatgttcttcaagtcctcgttattaaagttggacaccccaatactcttgaccttgccagccttaactgcgtcttccatcgcacgccaaaccgccaagttttcctcgtagtaattattgccggctactgggcgcacgtttggcacagccatttgattccatggtcgtggggcgtgaatcaacagcaaatcaatataatcagttcccaacgctgctaacgactcatcaattgagcgggccgcatcttgatagttcttaatgctggcatcaattttcgttgaaatcgtcaatgttgcgcgatcaatgcctgattcagcaattgctgcgccaaccgcatcctcattttgatacatttgggcggtatcaacgtaaagatacccggcctttagggcagcagccactgaatcgtgggcttgttgcttggtttgttgccacgttcctaagccgaccttaggaatctgaatcccgttatttaacgtgtatgtttcatgcaaaaatgacatttccttacacctcgttaccttcattattcattgactgctttaactacaagcatcatgatacgccgtcaggtaaaggtgggctgaaaaaagtcaggcttgctgatattttgccaaatacgcctgcaaatagtgaccggtcacactctcaggactgactgctaaatcagttggcgtgccactgcccacaatctggccaccatgtgtgccaccgccaggccccaaatcaacaatccaatctgagttagcgatgacctccaagtcatgttcaatcgtaataatcgtcgccccgcgctttaacagcaagtcgaacacgtgcaacaaattttcaatatcaaggggatgcaaccccactgatggctcatcaaaaataaacagactggtttcctgcttctgatgaatctgcgtgaccaacttcaaacgttgggcctcgccaccagatagttcaggcgtactttcacccaacgtcaaatagtccaagcccaattctgataaggcagtcaacgtcttcaaaattttcggttcatcttggaaaactgttagggcttccgttacggataaggccaacaagtcagcaatcgtgtagtcatgccacttaacatcaagcacgtctgatcgataacgggtacctaaacaagttgggcacacttcagtcacgtcaggtaaatactgcacgtccatcgtgatttggccgactccgccacacgttggacaagccccggccacgttatacgaaaaatcacttgccgtgaattgccgttccttagccgccggtaaggccgcatacattttacgcaagttatccaaaatatttgtgtacgtcgcaactgttgaacgggcattcttgccgactggcacagaatcaaccatcacaactgtctgcacgccactgttatctaaggactgagtaccatctggtaacgcgcgtccctcattttgagccacaataccaggggccagcaaatccaggattaacgtcgtcttgccggcgccactcatccccgtcacactggttaaacgatttttggggaagcgggccgtcacgtcatgtaaattatttttctgcgtgacggcaatctcgatgctaccttcatcaaatagtgtctcacttggtgctagtgtacgcgtctgcgcttgcgcctgaccattcaaatatggcgccaccaaggtcgccgattgtttagcagtggccacatcgccagcgaaaataacttcaccgccatgttcaccagatcctggtccaatctcgatgacataatcgctcgcgccaatcacttccatatcgtgatcaaccaccaccagtgtattgccttgttcaagcagtgtcttaaatacccgaagtagacccgtcacgttttctgggtgcagcccaacagtcggttcatcaagtacgtacagaacgcccgtcgtttcattgcgaatcgtccggcctaattgaatacgctgcagttcaccagttgataaggtgttaccggcccgtgaaagtgtcagataatctaagcccagttgcgttggggcatccagtaattccaataattcatcgaccaacttttgccccattttttgcatgtcagtcggcaatgtggcggttaactcacgggcaaaagttaccaaatcttcaatcgtataatccgataattccgcaatatttttatcgcgcaagtgttggctcagcaacgccgggttaaaccgatttccatggcaagttgggcacgtttgaaaggtataaaactgattcaaccgtttaatcgtgcgctcgttggtactgctcttcatactatctgcaatcgcattataggcattctcaaagactgcgtggtccatgtgaaacaccttgccactcttacttggaatgttaatttcatattcctgtcgctcaccgtggaggacctgatcttgttgtgctttgggtaaatctttgtaaggcacatcaatattgatacccgctgcttccgctaccaggggcatgaatgtacggcctggtgtccgccaagcgttcacggcgccatcgcgaatcgtcaattcctcattaatcaacaacgcgggattgatttcttgcacttcccccgttccttggcaagttgggcaggcaccagctgagttaaacgcaaaatcttccgccccatatggcatgaaatgtacgccacagactggacagtccatccctgtcatatcagcatccatcgctaccgctagcgtcggaccaatgcggtgaccattcggacagaccattgaaccaagtcgtgaaaacatcaagcgcaacacatttaacgcctctgtcatggtcccgactgttgaccgaatatccggtacttgcggccgttggcgtaacgctaaggcggatggcaaatgtcggattgacgtcacatcagcctgatttgcttgactaatacggcgtcgtgtatacgttgatagcgcattaagataccggcgcatcccctcgccgtataacgtccccatcgcaagtgaacttttaccagaaccactccgcccggtaatccccgtcattttccccaatggaatatcaacatcaatattttttaggttattcgttttcgccccacgtacttcaatcgaaaatgccatgttcatccccccacatgattaattacttattttttatatgctcattgtatcacgtggtccagaatctactgagccgaaactatgcaaaaagaggctgggacagaagtctctgtctcagcctcaaaagcgcctttcgtctcactctcttttcatgattagtttttagataagcgattagttaagaacaccgccggaatgataatcaacaatgacaggccggccgtccaggcgaatcccgtttggtaaccggcagcaatactggtgtgcgtcgtcatataaccagcgacaattgttgcaatcacagctgaaccaaatgcacctccaatattttggaacgtgcgtgacgcgacagaaatcgcacccgaatcgcgcttatcgccaccgacaaaggcatctgtcatcaaaggtgataagatgccccccgcaccaataccgcgtacaaataagataaccgcaaccaaccaataggccgtcttaccatcaaagtaagcgaacggtatcgtgccgaccagcgtaattgccaaacttacaatcgtcacgtaacgggcgccgatgcgatcaatcaacttaccaacaattggtcgcgcaacaagcataccaacgccctgtggaatcaatgaaagaccatcgacaatcactgaatcaccacgtaagttctggaagaacaatggcaatagcaacatcgccccgttggttgcaaccccaccaaccaccatgccgaccatagcggcagtaaagttcttacgcgtgaagagacgaattggcaagatcgcatgctcacccttgaagtgcgcatacacgccgtagaccaccattaaaacaactccgaccagcacatacgcaactgtggtggtattcgtaaagtctccctttgtactagcttgcacgataccataaataatggttgatgaaattgcagcaagcaacgtcaccccgacaacatcaaagcgagcctgacgattctttgcttcaaatgttggtaatttccaagcaatcaaaattgttgccaaaatgacaattggcacattgatgtagaaaatccagcgccatgacgcatactccaagacgataccgccgataactggccccaaaatcggtcctaacataattggcaacccaaccaccgccatcaaccggcccatcgctgcactaccagccaggtccactaacagcgtcgtcaacaatggcgtcagcataccagcggccgcgccttggaacaagcggaacacaattaaactatcgatgttccaagccaaggcagaagccaacgagaatacaccaaacgcaatttcggctgctaaaaatacccacttgccactaaaccggttgaccaaccaaccggcaaacggtaccgcaaccgctgtcgctaggacataccccgtaatcacccactggattgttgagagactggctccaaaatcacgcgccaagtcattcaccgcgatgttcaccatcgttgcatcaagcatcggcgcaaacgcaccgagcactaatacccacgccatgttcacgacatgctttggcaatgctgtcgttttcttctcgtccatctcatttaccttcttttacactttgtttctttttaaggtacaccgtgtacctatcggacaaaaagtattataaacgtgcgattttaaaaacgcaagcattttagatacaacatgtatcttattgattgatagtcgtgtaaaataaaggcatacaagcgctttggaaggatggtaatttgctatggcaacacgtaaaactggggatgacctcaccaacgttatttttactgtgacccgcgacattatggcggctgaaggttatcaagccgtcactttcgcccggattgcacgtgaatctgggacttctcggactgtgctctaccggcgctggtcttcaccgttcgccctaatgaccgaggcaattcaagccaaggcgcacgaagtccaagggactttggttgacgctgattttaataccggctcactacggggggacttaattgcgatgttaacacgctacaagcactcggccgatattatggggcgcacctacaatcgcgctattttgggagaagtcagcaaagaagacaatcaggatgtcaccacttttctggcccaactgaaacaatcaaacctcttcatcatggagcgcatcttatcaaaggcgcaactgaacggcgaaatcaataacaccaccacggacttggtgaagttaatgccatttgagctacttcgctatcgctttttaattagtgacgagccgattaccgatgattttatcgctgaagtcgttgatgaaatcgtcttgcccgcaattatgcaacagcaaccacatgcctaattaaaaatcccgtgttagccaaaaacaagctaacacgggatttttgccattacaacggctttgtcaattcaattcgatctataatgtggctcaaatatgacgccacatgctggtcttaggcgactttgatcaggtcaaccagttcgtcaaagcggtctttcgtcagttcacccagtgcccgagcattatctaagtaggcaattaataattgcaaggcaaagtacgcttgacgcattgtgtagcgaccaaataattcactttcaatcaacattacgaaattatcatcagccagcgccgtgatggcttgctgccactgaccaccggcggtttccatcaagtcgcccaacatcgtttcagtccagcgtaactgatccgttgccagtaggtcaccgagttgcatttgcagcttctcgataaaaatcgtgacttgcgcatgattcatctcacgcaaatcagctgacggcgtactcatcaaaaccggcaactttttaagttctggtaccggcgcctgatcacgcacaatttgttgcaaacgcaattgatcagcgaaagttacgtgcccctgctcatcaacctgcaggactggacctaatacatcgttcacctgttgcacccaaacttgtacatgacgttgggcctcacgatcgggttcatacacaaatgatgttgcgatgttcttaaccatctgagccttcgtttgcccatacaacgcatctaacacagctaactgtgggttgtgtgccaatgtcgcttgccagtgactaaaatcatagtcggcttgccaatctggatccaaactctccaaaaagaatggctccatatattggtaaaacaagcgtgcatcttgatcctttaacttcagttgctggaagaagcgctcattttccaagtaatcccacaagccgccaaaaccacggccaaccgagacaaacttttcttgacctgccttgctgtcccagtattcatctgcaaagacatccaaggcatctttatcattcaaattaataccaaccgccattgcagcagttgcaacacgcttatccgccgaaaagtacccgggataggtcgcttcatgctcgaactgccaagctaattgttggacagtactggcaaaatcagttgcatcaacagccacaactggcgtcgacgcaatcaatgccgttaacgcatctggtaaggcacttatctgatcgggtgttaacacaacggttggcacaaaatagttaaacaaaatccgcttcaagccaatcgtcgtccacttgccaactggttcatgggcaattttctgcatcataccaatgaacaacggcaacaaggtatctgtcatatcgcgttggacgtcggcagacaatgcttgaaaggttgcattggtggctacattcgccatcaatggtgcgatggcgcgattaggtcgtacctcatcagaatcatctgtccccaccatctggttcgccaactcttttcgataggccactaattcatcgcgaacccaaccgtcagtcacggctgcgggtaaatctggttgcaccataccactgtacattaaggattcgagcaaatctgctgtcatgccaatgatggttgcatcatctagtccttggaattgctcgtgtgaaccgatggtaaacgtcagtccaagcaagacatcatcaatgccccacgcaatcgttggcttattcgtcaccaaataaatatcatccaaaatggccgcactcatcttttgcgcatccgcccactcggtctgcttggcaaacgccgctgacaattcccggaattgttggcgattacgcttcagcgtgcgctgattaactggcccaaccgcattaccggccgtggacaatccagcgcgcacctcatccacaagtgattcgtcaataaaaccatcttgatctagtttgagttgcatgatgttactgatctccttatgacttgttctttattggtttgaattatacaccagtgaccaatcaaacaggcgaaatcagttgacggcttgccccttacgataaaccgccttttgcccagttaacacagtgatgtcggttaatggattagccgttacgataataaagtcagcttgcttgccaacggtaatgctgccaaccttgtcggcaacccgcaataattcagcagcattttgtgtggccgacagtaacgcttcagctggcgtctgaccggcagcgaccatataaacgagttcctgtgttgatccgtggcgaaaatcattaaacggggtgcccgcatccgttcccataaccagtcgaacccccgccgaaattgcccgcgcaatgctctgctgatgactcgcaatcacagccttattcttctgatacatccaagctggcaccgcttctggatgttgatcgatcgcgtgtggggcgccaaatgtcggcaccaccgcaacgtcagcgaccaataattgttcaatcgcttcgtcatcaagaaaaatcgcatgttcgattgaatcaacaccagctaagatggcgtttttgataccttgattgccctgggcatgggctgcaactgggacatttcgatgatgcgcttctgctacggcagcagccatttctgccacgcttagttgcacctggtctggttgctcgccatcacgactggtcacaccaccagtggccatcaccttaattgcggttacaccagctttaagtaactgacgagtcgtacggcgcacatcgtccggaccatccacttcgcgggcaattcccgctgacccatggccaccagtcatcgtcaacgcgggaccactgccaacaatcaacggggcagtaatcacccctagttgttcaagtcgcgctaacgacaaatcgatgttggcaaagctaccaacatttcgaatcgtggtgaccccatctcgcagtaggtctcgtagattcttttgggcaaagacagttacttccgcctccgtcatgttcgtcagcgcaggtgattggtctgcagcgaccaaatccgtcacgtgcgtgtgcgcattaattaaccccggtaccacgtactgaccggccaaagatactgtttcatcggccggtgtgtctggcgtcacaaacacgccctgtgtcgtatccaccgtaaatgattgggtaacaaactgccccgcttgaaaaatagcaccgtctgtatatgtgataattgccatttcctgatctcctatttcttgtaaaccgactttaagtcaagcgtgccaactggattttgaatcaccccactaaccgtcgtccgttgtaaggttggcaatgatttatagcccaacacaatgaccggcgcatcacgctgtaaatacccatccgcttttttcaaatccgtataacgttgctcaggttggtctgcatgttggttgtcagcagttgccaataatttgtcataagccgcattttggtatttcacaatatttagccctgaggttgtggtaaataaattcaaaaagctcattggatcaccataatcgccaccccatgacgtcaacaccatatcgtagttttgtgataactgcgcttttacacgggctgccttgggctcagactttatcgtcacttttaatgctggtaactgggttgttaattgtgattggatatattgcgcttccttcttcgactgatcatcgtcgtcggaaagcaaggtcaacttaagctgttgaccggccaattctttttgcgccgttctaaagaacttttgcgcttgtttcgctgaaaacgtattttgtgacagtgacgcgtccttggcaaaatcacgcgccgttttaggactgcgggcaacgccatccggggtaaacgtctggccttgtcgctccgaaccagtcaaaacgcgtttacttaattcagtgcgattaatgcttagttgtaacgccttgcgtaaggcccggttttgtagcaacttattctgctgattcaagccaatgaaatccgtgcggcctgttttgataacctgaaaatctgctttgtgttgactggctcgcacctgatcagcccccaagacagcgtaatcaatatccccagcttgatataagttatagccggttgttgtatccgttatcgtgcgaatggtaattttctgagtacgaacttgtttttggtcaacatagtgatcatttttcgttagggcgtaggtcgtgttcgacccattccattgctgcaggacaaatggcccattagagatcgaattggcggctgacgtgccatatttagcccccaccctatcttcaaaggctttgttttgtggaaaaaaagcggtacttgtcagaatactgggcaatgctggcattggatgatcgagttgtaactgtagcgtgtcctcgttcaacgccttaacacccaacgatgcaaaatcttgacttgcgccagtaactaatgcattcgcgccatgaatattttttgcaattgcggcactatttgaagcgttacggggattaacggtttgctgaaacccatatacataatccgccgccgttaacttagcaccattcgaccaacgtaaccccgctttcaatttaaacgtgactgttcggccatccgccgatgtcaccactgacttagcatccgccaaaactggtttccctgccttatcgtaacgatataaaccctgcccaatttgcgtcacaatgtccgctgcggtcgcatcgttggcagccgacggattagtcgtcgttaacggcgcgctcaccgtccagttaactggttgaccaactttcgtagccattgcttcacgcgccgttgcgccaattaaaagtactggcgttaataccaacagtcctacgttatgtcttagtttcatcatgtcttcaccctctgtgattgcaaataaaaaaacggcctaacgatgttcatcaacatcgttaaagccgttcaacacatttctcgtattatcccggctagctatcaatcgatcaattcgatagccagccgcacaaaaagccaactatcgccggcgccaccacgcgatagttgagaaagcagtgaatgaaattgtcatgtttgcagttgtcatgttcactacctcctttttgtgtatgtgtcatactttaaatcactgagattaaaaaatcaatagtttgattagaattatctaattttaaaatctaatctgtgaacacaagcttaccgtgtaatccaccagacacgatacctatgcaagctggttctttgcatttatagtttcacatgccttttctccaagatagacctggtcagttactttttactagtttaattccacgcaatataatagtgtctttcgtcaaacgagtaaatcccacttggccgccaaaaatatactcacctaataaccgcctgacaaattgagaagcgataatttcatccgtcatatctgtattcgtatctgtcatattctcaataaacgatacttgttctggttggttactgtcatgcgcatcaggaacatatgtcaatactaacttaagatcagacctaaagagtgactgattgttgccatcagtcgtagatgacgatactggtactttgacaatttgaagtgcaacgctctgtatatttggatactgaacatccgcataggttattttaggtaataacttttcaaaactactataccaatccgtattttggtgtgcgtctaatacatccgatttcacctgttgccgtgtctcctcatttgacttcaacattttcttatcccccatatcgtatttatacatccccaaatgttaagctgtattttagcaaattcagcttaaccctttagtacaaaaattcattgaataggctttttactcgtagccctatctacattttttcaatcatccgatatctaaatcacttctcacaattgaccaaattaccaaatcaacctgccgattatggaaataatacgagtttctcaacgtgccttctactttcatgccaatgcgggccattaggttcattgacttaatgttatcaagcgtgtgtcttgcgtataaacgttcaccacctaactcgaaaaagaagacatcacgtaacttcatcgctgcttcggtggcatagccatttccttcgaattttttattcagcacatagctcaattccgcggtcttgttttggtcatccaaattcagcaagtatatcgtgccgattaatttatcgcctaaaaaaatgccgtacctgccaagaccattatcaataaagattcgctcaataatggctttagtttcggctagtgtctcattggttttgaaaacatagtaggcattgtctggaacactggcatactcgtacatatccggcgcgtcatcgattgtcacgggtgccaatgtcagccgatcagttttatacgtctgtaataatttgtccttcatccagcttctcctcgctacaatctaactggcaagtttcagatcttttacatcacctgcttatgaaaatttgccatagaaatcccaacaacattaaagatattatcaatctcaccaggtgatgtttcaaatggaaattaccggcatcaatgcccgcataaatcgccaatagttgaaatcccactactcccactgcgcctacaacggcaaaagtaataactgaattaaaaatagacgcccacgctgttacaagactaaatatcaaaactaaggctatataaacgcggttcacatcttgttcgtgtctcatttctacagtgattgcaataaacatcagcgtcgcgtataacaacaataaaaatcgactgacaatttccatctctgttttcctcgactcaataccttgtatcctgaataagcgaaatcataccggcatcatttactgagcgaaatcccaaacttttatagaacgaaacagtcgtctcttcgtcatccgttaacacttctatttgcaactgaccgtaacttttaatttctgctaatgctcgctgcatcaacttttttcccaggccttttcgttgatagtcagggtgaactaataagtcctgaataagcaccaccgtcgcttggtcagtcacccagcgaattaacgcgacaatttcaccctgattatttttctcagtcatatattgtgaatttgcgaaagcttgccacagacgatccggattctttgtataagcaatccatcccacactttcatacaaatcataaatttccacttgatctttttcgtccataattgccccctgcataccggataatcaaaaaactgtttactgcacaaaattaatcgaacttatcctttgaccaaatccacgttgatacgagcgccggattcgcaggattaattaacctgaaaatttcggttgcatctgcgattgtatttttttcagtcgctgtatattgtgctaaaaaacgattgacatgtgcatcaagtaacgccgaacttctgtcttgtgccacgattttttgaccgaaatcaatggattgaatcaaaatacccaagccggcctttttgacactaacgccattaaaccccattaattcattctgcaaatcactatacattttgttagtaaagttcccccgcaatggcaactctaacgcaacaaatctattcgccaccgcaataaaataggctgccattcgacccggaaaacgatgcaaagctggcttttccctaataatttctgccaagtcagatgcatgttgcaaaacaagttctggcgttagctgcgcttgatccaatctctccgctaaataaagcggcaatgcccatgctctttcagaagagatagactgatctgaaatgaggccaattacaaatgcaaaatcattgcttttaagatattgaaacgcctgtgctgataacaaattactgattacctgtcgtggcttacgtctatcgaaatccctttttcattcatcgattacactttgctttatcatccctataattagctttcggttaatttataattaattctactctcattttcaaaacattaaacaggcaacatctgattagacaaaaaattacatataccactttgaaaacaatatattgcatcccaacacaactcatccaaaatgttgcacagtccaccatcaaaagcagtacaataataattattacctcgccaaaggagtcggttaatggatattcgcttacatcccgcgtatgaagcggccatcacaagaattgaagatttaaaattaaccttagcaactgccgattctcgattatctgatttgcaaacgacccaagtccccttcactgaggcacgttatatggcaaccattggccgttacgaattaacggcttatgaactatacatgacggttcagtttttgaagaaacgacgccaattaatgttacaagcaattaatcaaggtgagacacctgatttggaagccattgaaattgaaattaatttattaaacggtcagcttgatgtcaaacggcaagaattggccgaccgattacgccgagcacaacacatttgggatgccaagctactttccgtcgaagataccaaaagcttaaaaatgatttatcgagaactcgtccgtctgttgcacccagatctcaatcccgaccaaacagcagttgaaagagaatggtttcaagctgccgtcacggcctataaagctagccagttacaagaactggcgcttctcttagaaatcgtgcaactgaataaccaagcgacacaacagcctgaagttgtcatgcccatcgaggatttacaagcgcaaggcgaccaactcgctagtaaaattgatactttacaagccgaaattgattgcatcatgaccagttttccaatgtatttagccgacgccttgcaggacgataactacatcacagaacaggtcttacgtattcagcaacaaaccacgcgactaatggcgaaacgtagtcaattactgacagatttagcgcaaatgggatgggtaccgcatgactgaaaaatttgaattaaatccgttaaacagcggttcagccttaccaattgaattgaaaacgaatccaactgccctcacagacttagttgatgacctatttggtgaacgtatttacttaactcatgtgcaagtacgtggctattattatctctcagaggaaaaccaggcctaccatcgcgctgctgggttaccaggaaccgcactgattttacgtcgtgataaggccaaccaatttgacgactacgccatcaaggtccttgattcagctgaacatcacatcggttgggtgccacgaaatcaaaaccatattgtggctcgtttgatggacgccggtaaaaagatcgatgctgaagcccgtgctggtaataattcactggccggcgagctttcaattgatatctatcttgaagattagcaattaaaaaatccccctaaccaatttgctggttagggggattttgcattaataatttgtttacttaaccaacgttgtttccacaaaacttgccaagtgatcaagactgctcaattgtgcgttgcaaagtgaactgtcacggcaaattagattaccacgctttgtataattaccatctgcgccgcgtgatttcacctttgacaagaacattgagacggtccctaattggtggcaaattgcacacaatccgtttaatggcttcgggtcaaaatcaccgtagataccaaccaatttaccatcgcgtggtgctacgatgtacttcttttggctaccgttatcattccagcccagataggtcatttcatgacggtctaagttctcccactttggctcaggcagttttttcacctttttgaacagcttaccaagttgatttgcacttaactctgggaaaggcgtcaccaattccaccagttgcttaaatgcacgttcggcccgctgcctagaggttgcaatttcaggtaattgattcaggaaatcagtggcaatttcagtgtctggcaaaatacttttaactgtttcaacaacatctgcctgaacaacagcttttacattcttatcattaactgaattgaacgctttattcaggatgatgacttgttctttaattgcgacgaattcgtggggttgtagttgtttgtccatgtttatgctccaactttagagtacacatcgcacggacgctagccggcgatgttatgactgagaattaactttcgtccggcgtacagataatgatccaaattctggcatctttatcatctccattcgtgtttgatagtttaattagtatatagaaaatattgtaagtaagcaaatttcacgattgcatgacttaacaccggaaaaacgtgccatcaccaccactgcaatcatttagacctcaggtgtgacgtcaatcacgcgtttttcagaaaaaaaaagttgcaacccaatgctgttcatcggcttgcaactttccttattcaataacttgtttgcggtcaaattccttaattaggtcaaacgtttacttttcttcccgctttgaccgctttaacaagaagaatccgatgataaacaagaatgatagcaatccaaccagggtttgaacaaatgaagccttttgatcaacacctgtgttcggcaattctaaattaccagaccgcttgtttgtacccaaaattacaccaccgacagcagtgattgtttcccaaaccgcctgcttagcaaccggcgcgttttgaactgtctgtgtttcaacagcatttacccttgacgccatgtctgatcgactttcaccaccaacggttacaataaccacttcagatgacttaccagtcttagggttattttgcgtagctgttagtttcactaaatgctcaattgccaaccaattgtaacaggcgcagccggcattgtgaattgcagtgtcgtttcatttaaacgtacgattgggtaaacaatagcctcatcatccgtgttagttgctgaaaatgtcatacttgataaagttccagcatttggatatacagaagcatcagccgctggcattttacttgggtcaattgtcaccgtcacagtatctccaggctttgcatccggcttatcaatactgtaataatctaattgcatggccatacgagcattgtacgtttccttttgttcgttaaacgttggtgttactgctaatccgatatgttctgggatttgcccactagttactaaattattaaatcgattttcatcaaagtttgggaacgtcaccctatattccgtatctgtaatccattcgatttttggctgtaccatactatcctgtggatgccatccaaatactcgcatctcattctcagtaagtactgatccatcagcttttgttggtgtaaagttcaacttttctagatgttgaccactatttggattaacgtgtacatacagcgtatcagtaaacgagaattgtgtttgactcatactgatggccccgccagacgctgacttaatatgaatagggttgccggttgtcttttcccagattgcataataggtcacgttatcagtaatcgcatgttgcgtaacatctgtcttatcgaaattattaccattatccttcgttgaccacccaacgaaggtataaccttcacgggttggtgcaaccggcaaactctcggtagccaatgtttcattcttaagcgcttcgaccgttgcggttgacacaccatccgcgaaggagccagcaccggcgttaaatgtaactgtcgacgtttgctggattggaatgaaaagcttaatgtttagcgtgccacgtagatggttaaagccatagaaggcagatttaatttggacgttagccgtataaccggtcactttcttaccattttcaagcaatgtcactttcggtgctttctttagttgatccatgttgagagccggtccgtgtggatgcaaagtttgtggtttacctagtccggtaatggtatatgcaccaacacccttcaacttatacgaactaagtaattgcgtcatcgtatcgaaagtaattggctttgatgaatctgccactaaatacttaggcaccttaatactgatgtgcttattagtaatcgtcttaaatgattgcttgtggcaaagtcgcaacattggatagtgcatatgcgcactggctgtcggtgcttcaattgcaccatatgcggttccgcccaaggcaccaaggcaaagcaacgtgatggcagtcttcttaatcgtcatgataaattcctttctaaaatcgttcaaaaaatagctgtagttcgttaatacaaggacagtgtaaatccaggaaagttcataaacaaaaataagagaccaaattcacgaaacgtttacaaacactacgaacatagacataaaatagccacatttcccattaatccattaattattgctggctaatgcaaaataaccctaaccagccgatctgaccagttagggttatcccttgaaaccgcatgataccgcggtttctttcacttaatttacttctctaaaatcttagtcgcttaatttttgacttcaagcaccgcaacgtaaggtagattacggtggtggttgttatagtccatcccatacccgacgaggaactcgttaggtaccttcgcgccaataaagtctggtgtcacaccaccagctgagacgtcttcacgcttatcaacagcgaccgcaatcaggacccgtgcagccccacgctcttcgaaatcatgtttcagatagcgcaatgttaatcctgaatcgatgacttcatcgagaataacgaccgtgcgaccagttaaatcgactttcaaatcacgctggatggtaatacgtcccgtcgatgcatccccatcataactcgacacatcaatgtagtccgtttcaacatcgcgaccaactgctcgtagcaaatcagccatccagatgtatgcacctttcatcacgcccacaaatacaggacgctcaacgtctgccgttgcggcgttgatttcagcggcgacgcgttccaccattgccgcaatttcttcagttcctaaaacagtccgttgtaacgtcattgttggcatgatttatccctcgttccagatatcaaatagaataatcgtttgttcgtttgatgggccaaccgcaaaagtataaagtggcacaccaatcaattcttccacgcgcttcaagtaagcttccgcatttgctggcaactcttcacgtgtcttaacttgtgtaatgtcttcatcccagccaggtagctcttcataaactggcgtcacgcgacggacatccgccaaactcgctggataatgttcaatgcgttgaccatctaattcgtacgcgacggcaatcttaagcgtcttcaggcctgacaaaacgtccaatgaattcaaagacaagtgcgtgaaaccaccaatgcgggccgcgtgacgtagtaccaccgtgtccaaccaaccaattcgacgtggtcgcttggtcacaacaccatactcatgaccaacttcacgaattgtggccccaacttcatcaaacagttccgttgggaatgggccatccccaacacgtgatgtgtaggccttggcaacccctacaacgcgatcaatcttagttggcccgataccggcaccaatcgttgcaccaccaccaactggtgatgatgatgttacatagggatacgtcccgtggtcaatgtccagcattgcgccttgcgccccttcaagaagcactcgcttatccgcatccaaatattcattcacgataaccgtcgtatctgtaatgtatggccgtaatgcgtcaccataacccgagaattcggcaaccaatccatccaaatctaatggggcatggttataaatcttctcaagaagttcattcttctcagccaagacggttgttaagcgttcgcggagcacgtcttcatcaagcaaatctacgacacgaattcctgtacgtgcagccttatccatgtaagttggcccaataccacgacccgttgtaccaattttaccgtcacccttcttagcatcagctagttgatcaatcaaaatgtggtatggaaaaatgacgtgcgcgcggtctgaaatgcgcaggttgtcagttgtaacacctttatcttgaatagcacgtaattcctccaagagcgccttggggttcacaactgaaccattaccaattaccgccaaacgagctgggttaaagattcctgatggaattgctgataattcaaatttttgtccattcacgtaaatcgtgtggccagcgttgtttccaccttggtaacgaacaaccatgtctgattcctgtgcgatgaagttcgtgatcttaccctttccttcatctccccattgactaccaactactacgattcctgccatgatggcctcccttttgcgttaaatgcacgaaaacacgaacattcaaaaacgttttatcacaaaaactattgtatcaactaacatttttgttttcaatgctttcacgacacaaagttcgacttttatttaaataagtcgtcactgaataatttttattcgtctttttaattaaccctgcttacttatttaaaataaaaagacgatataccgaagtatatcgcctgattgttattgtattttacgattgttcatcttaatcacttcccaaataatattcggaattatcgatagaataatcgtcaatagccattgaccaaccgtcaacggcataaagtggaagatgtcttgggtcacgggtaccgttacaactaagatagttaacaccaatgacagaagcgccatcatcaccaaactccggttagctgaaaacttcacgcggaacatcgaagcatcactgcgaatattaaagacgtgcaagattgatgaaattgacaagacgataaacgccatggtgtgccccgctgaattattgtctgtgtaaacgccgtatccctgcgctgctaatgtaatcaacgcaaacaaaatggcgttaaaagcaatgcgaagtcctaagccgtgggcaaagacgcttgcccgagggttaactggcttatcccgcatcacatcaccatggggtggttccttagcaagcgcaaagcctggtagtccatcggccaccaaattaatgaacaatagctgggcggccatcaatggactaccccaacccaaaatcatggcaaccacaatgacaataatttcggacatattggcactcatcaagaagttaattgtcttacggatattgccataaatgccgcgcccttcttcaaccgcatgtacaatggttgcgaaattatcatcagtcaagacgatatcagccgcttcacgggcaacatcagtcccggtttgtcccattgcaatcccgacgttagcggcattcaaggctggtgcatcattcacaccatcaccggtcatcgctacaatatcaccgcgtttctgccaagccttgacgatgcgaatcttgtcttcaggcgtcacacgggcgtagacggcatagtcttgcacagtatcatccaattcagcgtctgacatatcgtgcaattcagccccggtcagcgccttgtcggttggcaacaaaatgccaatttctttggcaattgcactcgctgtggcgacgtgatccccggtaatcatgaccgttttaatgcctgcttcgcgcgcctccgcgacggcctgagccgattcgggacgtggcggatcaataatgccgaccaagcctaatagttgcaagttttgctcaagttcttcagcagttggttctgctgatagtgtgggcaactttgcaatcgcaacagtgatcacacgtaacgcctgatctccaaacgtttgattaaccgcttttgcacgttcttgcaaatccagtggcaacttgggtagcagcacatcaaaagcccctttcgtaatcgccaaatagccatcagccacccgatgaacggttgtcatgcgcttacgcgttgagttaaatggaatctcatagaccttcggatattcggcttgcaaggcctcgtatactgaatagcccccgataccaccaaccaaggccatctcagttggcaatcccgctagtgtgccatcttgctcagtaacattcgttgacaatgccccgaatttcaaagcatccggcaaggcctcagcctcagcaactgccataattgtatcagtcgtggcatcccaaacctgacgggctgtcattttattctgagttaaagtccccgtcttatccgaggcaatcacactcgccgaacccagcgtttctactgctggtagtcggcgcacaattgcgtgtcgagccgccattcgttgcacacctaacgctaatgtaattgtgacaatcaccatcaaggtttctggtaccacggcgacggccagcgatacagccgtcatgaacagctccatcagtgggtcaccctgcataatccctaaaatcatcacaataattgccgcgataattgcgacgacagtcaattgacggcctaattgggccaaacgtttctgcattggcgtcatttcgcgctcttcacggcctagcaagctagcgattttacccatttcggtattcatccccgttgccacaaccaacgcttcaccgcggccattcacaatcgttgtgccccggtaaaccatgttccggcgatcacccaatggcacttgatcgccagtgataaagtcttcatccttctcaatcgggtgactttcaccagtcagtggtgattcttcaacccgtaaatctgcggtcgtcaacaagcgtgcgtccgccggaatcttcaccccattctcaagtaccaaaatatccccgaccacgatatccgtcatcggaataaattgtatgtcaccgtcacgtcggactttggcttcttcgcgctccaacccttttaatgaatcaagcgctttttcagcccggccctcttgcacaatcgataagacggagttaatcacaacaatcgcaataatcagaaaactttcaaaataatcgccatggccttgaatgaccgtcgtaattagtgaaatgatggcagcgataatcaaaataattgttgtaatatcgcttagactgcgtaacacccgttttatcaaaccttcttttggcggttcaacaaactggttatccccatttgcttggcgggattgtaccacctgttctttcgttaacccgtaatcgggttggctctgtaatttttcaattaccttcgttaacatttcttgatatatcatatgtcggctcccctctgtttgctgtcggcatatcgctacctagttaaagtttaacaattttcgtaaccgaagccaaaaaatctgcttacaatgactcaatgggaaaataacgttcgttttttacgtatgttaaaacttgcgaaacgtaatttgttcggtttttgggttgacgtttgaaacttaatcccctaaactatgaaacgttaggaagaacttattatttttttacatttaagggggcacagatgaattctgttgcaaaatacttccgctttgatgagctcgggactaatttccgaactgaaatcattgccggtttaacaactttcgtttcaatggcctacattttgtttgttaacccaaccgttttgggtgcagcaggtatggacaaaggggctgtcttcaccgctactggtgttgccacagccatcgccacaattttcatgggcctagtcgcgcgctatccaattgctatcgcgcccggcttaggggttaatgcatttttcgcatattctgttgtcatcgggatgaaggttccttggcaaacagcaatggctggggttttggtcgctgccattatcttcttgttgctcacgttctttaaaatccgtgaaactatcattaacatgattccacaagatttaaaggtcgccatcgccgctggaatcggcttgttcattgcctttatcgggttagctaacgctggtttgattgtagccaatgactcaacaatggtctcattagggcatctaacatcgggtacctcattgctctcaatctttgggattatcgtgacctttatcttaattgccacgcgcgtaccggctgcgatttttattgggatggttattacggcaattgtcggaattatttctggcttaattgatctgccatcacacttgatttcatcagccccatcattggccccaacctttggtgagtcaattaaccacattacagatatcaatacatttcaattgtttaccgttgtcttaacgttcctgattgtgacattctttgacactgccggtacgatgattggcttggccacgcaagccgggtttatgaaggacggcaagatgcctcgtgccggtaaggccttgatggccgatgccattgggatgacagctggtgcggtattgggaacgtcgcctacatcagcttacgttgagtcttctgccggaatggcggttggtggccgttccggtttgacgtcagtgacgactggtattctgttcgtttttgccctactgttttcaccattattgtcggttgttacctcacaagtaaccgcaccggctttgattgtggtcggggtgttgatggccgaaaacttgcgtaatattaattgggatgattttgcaatcgctgcaccggctttcttgattgtgattggtatgccactaacatactcaatttcagatggtatttcccttggtttcatcttgtacccaatcatgatgattgccactaagcgagctggtaaggtacacccactgatgtacgcactggcagctatcttcttgattttcttatttattgtcgcccattaattattaatcaacacaaaagccgccaatctcccggattggcggcttttaaacgtcttacgtctcaatatctttttctactgattgcttttcaactcttgaacagcggcaaccaattctggcttcgcttcttccaaccaatttggatcgcgcaattcagtcagcgcaataaccgatgtcaccagcttcaatgattccgtcatccccgttgtttcatagctaaccaggcgttcgattgatgttgtatcaaaatgatcatccatcatcttagccaattcaagcaaaaatttatgtgtcatattttctttccccgtgaaatgtagatttcatatacatcatatcaaatatgattaatttgataccctatcttgttttcattatgccaacaaaaaaagaccaaactttgaacaaagcgtggtctaattttaaattcgtattatttgttagtgcaattcaccctggacagcattcgtgtgcttaccaggaatcgccaaaccatagcgggtgtttcctaatgcttggtcgaccgtcataccgccaaaggtatcattgaacgctttgactgtggcgtccaaatcctcagcattcacaaaggcatcaaccgcagcagccccgtgaactcccatacgcacaatatccttcaagcgggccactgtaataccacccatcgcaacaactggcaacgtgctgttttgaacaacagtcgtcaaaccagccaagtgttcaattggttgcgtctcatcaacgtgcgcgcttgggtaaaccggactaacactgtaaaaggccaaaccggctggcacatcttccaacaattctgtccggttgttaattgccacaccggtgtacaaacctgccgccaaagctgctgccgaaacttcagcaacttggtgacgatcacttacgtacacaccatctgcagcgaccgcttcagccaacttcacatcatcagcaatcaggaaggcaacttgcttggcacgcgtaatgtcacgaatgtattgcgctaagttttgcttttcaacgccttctaaacgagtttcattcaaaataatcatcgtcacaccggcattcactgccttatctgcaaatcctgcaacatctgcaacgtagtctgaaccgatgattaacgtacttgctaattgttctgccttaaattccatgatttctgcctccgaagccctgctttatttgttgccttaagtttagtcgtttacctatgcacttacaataaaaaaggaacttatcccaaattaaagacgccttgttaacaagcgtaacaaggcgtctcagattggacaatgtctttatttttgttcagaaaattcagcttgcaatgttgcctgctcttgacgataggcgttgataattcgtgccgttgtctcaggttcaacctgatccaaaacgctaccgagtgtcgtcattgcccgcacataatcataatctgtttcatagtagtaacgcgcttgttgcgtcgcttgcacaacttctgcgttatcccgatatgacaacgccttacggaccaaacgttccgtaactgacgccgcttcaactaaattatcggtattctcttgcaatgtatctaagtcagccgtgacaatgctcaattgacgcaaaacatcatcaacattgatacgtgacaaatcaagttgttgcttcaaacgaccaagctcatcgttcaccgcaaagaaaaagtccatgtaatccttaggcaagccaggtaaaccttgacgctcaaatgaccgttggatttggcgaattttatcggaaagcaacgtcacacgattacgtgattgttgcacagctactggcaattccttaaggtcttgccacatggcaacttgctcatgctcaacacgttccaattcttcacgcagtgccgtttgcttgtcagccaaagttgaaaagacaacttcatgctttgcaatcgattcctttagttcttccaaaccaaccgaaacatttgataattgcatctcccagctacgtacttgcccaacttcgtcctttgtaaagacaaaatcttgattcaatcgatctagttcgatatataaatcatgattttgacgcttattgtggaccacatatgctgtcaactgctcgttattttcccaaacttgctgcgcagccgtagcttcaccttcgaaagtttcgtacaacacttctgtacggctttccatttgcgcaattgactcactcacctttttcaaggttaattcagctaaatcatcaaccgttgcaacacgttgggcttcgatatccgctagttcagctgcaatatccgtttcaaactggaacccttctgcgtccatcttgtcgtaggcatcttgtaattctgccagttgaccagggattgtatcatccaatgattgatacaacgccggaatctgttcaatacgttgttctagttggttagtttccatccccaacgtctcataaatcccagctgctgttgcgtgatcacccgcttcagtcaaacgggcaaactctgcaaaatcatcttccagcgatcccagaatttcttctagtttgtcaattgctggtccaaaactgaagttctgtgacaagagcgtcttacgcaactcttggtacttaccttctagttccttaacagcggctttgtgcgcctcatccaacttttctaagtcagccaagccctgcttcacaacttcaatggtcgtttcagcatcacgaatttgttgttgcaactctttcagctcttgcgccgtcttcacaaagtttaagccttgtgattcaaacaaaaccgcattcgcttgctcttcaatatccttaaacccagtcgtttctaggtgtccatatttgccttccaacaattggaactgcttcaaagattggccagtcaaacttaattgacgtcccttcacaagtcgatcacgcattggaatttcagcgagtttttctttcttgcgaagtaatttggcaactttacgtgcagtcaatcgttgcgagacaaagataatcaggtaaatggccgctactacaacgataaggccaattacgatatgtccaatctgtgtcatgctttatcaccctggtgaatccactattcaccaaactccttactatcgggaattatctacctactagattatcacggtaacgagcattaactctaaaaacaagacaggctttagggtttacttggggttctttaaccttttttaatcgcatttagggtttattggcgtgacaacattaaccgcttacaaacgcgacctcatttatccaccaaaatgggctaaattgtgtatttaacttttccacatttccacaggcagacctttcataaatatctgcattgtggataacctgttaataactacattaaattatgagaaaataatgagtttatgaacacgcgttttccacaacttatccacaatcagtccacatacttatgaacaagttatccacagaacgaccgactgcatacgaacaaaaacttgcttcgcctttaatttctacgacaaaaataaagagattcacgttttgtaagctagttatccacaaaaaaacggttttgccaccaactcaagcgtcaaaaccgttagaaattaaaataattcaccatctgcaatctcagccagcttatctcgtgatggcacgaagaatagttgaccggactgaatagtcgagaatgttaataagtagtcagacatatccaccatctgttgtaacatcgctttggtaactgaccagtatcgtgaatagccaataaagtacgtccctgttttgccgctggctggatctgagaatggcacattcatccgcacaatcttttgttcctcaccatcaatttcaactttagcggcaacattgtgtgcgttatggaacttctcatcatcttcaagttccaaatcatcaaatttatgacgaccaacggccttttcctgttcctcagtcttcagcttgccccagaagtccatatcgtgtaaccacttttgcgcaaaagcatacgacccatccttatactccgggtcttcatccccgaccaaagcatagtctgccgcatcatattctcccggcgcttccgtcccatcaataaagccgataatggcacgcccttcaaagtaacggaagccttttgtttcatcaactaccgttgcaatcggctctaaaaagaccatcaattggcgaacaacttcataaaccgtcgcctcagaaccggcgcgtacgtgcaaaaagatatcaccttcagacgccggcatgttgtactttggtccctgcaatgtggtataagtttccaactgcttgggcaccggtacacttgggaataaataatcccatgccgtgcgactgaacccaattgacacctttaattggtcatcagccgcccgaatgtgcattgagcggataatcgcttgcgaacgatctgcaaattctgcaatggccgcctggtcacttgctaagttctctcgtcgcaactttaacacgacgaacgacacgtttttcccgacgtccttccaaacgtcctgtgctttgactggttctactgccataattttgtccccccgcaaaaaatctaattttagtatagacctaatatgcgaagatttttggatatcagaaaaaacggacacttcaaatcgaaatgtccgtttcaaagaaatcagttaatacggcgtaataagacaacgactaaaagagccaccccaccgattacggccccaactaatggcaacatctgcaaaccagcatagctcatcaccgcattgccgacaaacgatccaccagcaatgccaaaattcaacgctgacacgtttaatgcagatgcaacatcagtatgtgccggcgctaactcggtcgtcgtcataataatacgactttgtagcgaagcattccccatgaaagccactagcccaagtaacgcaattcccaccagataccaacctggccgtggtaaaagtagcagctgtagtaattgcacgacaatttgcgcaaccagaataccagcgacaactcctagcgcttggcgattcgctaaccgaccaccaatcacgtttccgacggtcacaaaagcaccatataggaccaagactccgacaacacctgcggtactaacacccgtcacctgttgcaaatacggccggatataggtgtatagcacaaatgatgatccaaagcctagtgtggccattaataatgttaacgaaattttcggatgacgaatcaccgtaataatccccgctaattgattatcggttactagcggtgcagctgttttaggcacttgtgttagtaccccaagccacccaaagacacccaacaaaccaacgacagaaaacgtggcacgccaaccaaccgcttcacccaaataggtcccaaacggcaccccgaagactgttgctaccgtcaaaccaccgaatagccaggaagccgcctcaccttttttatcgactggcgctagcttggtcaaatacaccgatgctgtagcaaaaaatacgccatgcacgacagccgttaaagcacgtgtccccagcaaaatgccataagttggtgcgattgctgataacaaattcaacactgcaaaggccatcatcagccaagcaaacaattgtcgtcgcgcaattcgcccgacaaagctagttgcaataggcgcgcctattgcctgggcaatcgcgtaacccgtgaccagtaaaccaatcattcccgttgatacatgcatgtcctgcgcaatatcagttagcatacccactggcacaaattcggttgtccctattgcaaaggtcgacaccgccaacgctatcgcaattttataataattactcatctcaacacctcacataaagtaaccactttaacgtatttcaacgttgtacgctagtttttccactatatgattctttacgactgcaccaaaaaagcacaagacataagtcctgtgcttctttgtgaacaacaagtccgaaataattaaaattatcccaacttgttgtagtattcaacgataaggttttcgttgtaatcgtggtccaattctgaacgctctggcaagcgaaccaatgaacccttcatctcgtccttgttgaactcaacgaatggcaacgttccagcttgcgcttccaatgaagcttggatgtaaacgttcttttgtgacttctcacgaactgagatctcttgacctacagtaacttcgtatgaaggaatgtcaacacgcttaccatcaaccaagatgtggccgtggttaaccaattgacgtgcttgttgacgcgttgaggccaagcccaaacggtaaacaatgttgtccaaacgacgctccaacaatacgatgaagttttcaccgtgagtacccttacggatcttaccagccttgttaaacaagttgtggaattggcgctcagtcaaaccgtacgtgaaacgtaccttttgcttttcagccaattgcataccgtaatcagagatctttgcacgacggccggcaccgtgatctccaggggcgtagttacgacgagcaatttccttaccagtacctgacaaagaaacacccaaacgacgtgaaacacggaacttaggtccagtataacgtgacatattaaatgtcctccagaattttattattgttgaattctagagaattgcctcacattcgtgcaattcacccaaactttcaccgctgcagcgcgggtactggtgtgttctccgccataattgaaacgggtcggtaaattgttgacgagcttgcggacaatccgctgcagttttcaacacttccaatagtttaacaaaaaggaaggacagttacaagctgttcttccttacttcatctctttaattttgctttgagagcgcgtcaaccaagacacggccaagaacaccaacgataaagatacccgcaagcatcgccccggcaatttgcaacggcatcgtgccaaacttctctgggccaccattcaagcttaagataacgattgaaatggcccaaccagttagccatgcagctgtgtcaacccagttacgaatccctggcattgatgaaatcaagactgccaggccaccaagtacgaacaacgttacgtacaacgtcaacttgggccagcccgtcaaacctgggaaggtgacagccatcatcccccacggaataccaagccacataccaaacaacaaacgccacttgttctttgggtcattaccagaggctacaaagaagcccccaacaatcaacgttgcggcgccaacagttacgccaataaagggtgcaacgaccgcccataatgatggaatcgctgcgacaaataatgccaatgcaatcgttggatttaacttatgcatctctcaattctccttacaaaaagtaaacttttataaaaccaaaatttattatacacctttcaactgcttgtgcaaattttagttctaactcaaaaaaacgcctatatataggcgttttccttgtgattatttttccaaaaagaactcaaatcttgacccaacatattgggtacgaacatattcaaacggcttacccgctgtatcgaatgtcaattggcgcatgaccaaaactgggtcaccacgcttgatagctaggtattcagcgacccgctccgtgacggcagcagccgtcacggtttgttgtgcatgcccaatccgtaagccccgttgttccgacaatgtgcggtacaaagaattggtcaaactttcacgagccaacccatcaaccagactagccggaattgaagcaacttcaaatgcaattggttcgtcattaccataacgcacacgttccatacgtaatacttgatcgtcgtcacctaattgcagttgttcttgttctgaattagatgctttcccaatgtggaaagaaatcgtacgtgacgtggcaaccttaccggccgccgccatcatttcggtaaatgacgtcacaccgttcaactgttcttgcactttacgttctgcgacataggttcctgatccgacacgtcgttccagaatgccttcgtcgactaacatcatgactgcttggcgcaaggtcatgcgtgagacaccgaattgttcagctaattcacgttcagccgggattttatctcctgggacccagcgcccagcttcaatagcttcatgaatttcgtcatgaatttgaatgtaaacaggtgctgccatacattatgcctccgcagtcggtgcgtccgcctttgagaaatgacgtcctagactataagttgcttccaacgctgacaaatcagcgctaaagacgttcaagtcagcgtctttgccaatccgcaacgttccctttgtatcaagcccaaactcgacagcttggttaactgaggccatttggatagcttcttcaatcgatgcacctgtgaacgccatgatgttgcggaaggcgtcatcaaactcaagcacagaaccagccaacgtgccgtcagccaaacgggcttgcttgtccttaacccaaaccttctgaccacccaattctgattcaccatccccaagtcccttggcacgcattgaatcagtaatcaaatcaatccggttagccgtcttaagcttgtaagcgacgttgaccatatctggatagacgtggaaaccatcgacaatcaactccgtgcgaatgttgtcttctaacatcgcgtggcctgtaactcctggttcacggtgtgacattggccgttgtgcattgtataggtgggtgatgtggctcgcctttgaattgtgctgtaagaaatcacgggttgcatttgagtgacccactgaaccaatgatgttgttatctgccaaataatcttcgaaggcccgaacgtccgctgcttgttcgggtgcatacgtaatcaaacgaacacggttacctgacaattcttgccagcgcttcaccaggtcaatacttggcgcaataatgtgttcttctggttgagcccccttaaagtgtgggttgatgaacggtccttccaagtgcacaccaacaattgctggttcttgttgggccgcctcattaacagccgtcatcgactttgaaatattctcaactgattgggtcatggttgttgggaaaacagccgtaattccctctgaaatttgcccatgcaccatcttaatgatatcttctgtcacaccgtccatggtatcaaaaccataggcaccgtgcgtgtggacatcaataaagccaggtacaataactttacgatcggcccggacgacttcatcagttgccgtcaaaaccaattcagccattggccccattgcttcaatttgcttatcaaaacggatgtaagcatccttgataactggattttcttgttccccggtatagatggttgcgtgggtcaaaactgtgctcatgattaactcccctttaagcgaaatactaaattggtacaggcggtaattagccgtctctatcatgttcttatcgcttacaagtttacacggtctaggtcactttttccagtgacagttaaaagccaccatcccctgtacatcgactggagatggtggcttttaaagttaactattaatctgctgacaaagcatcaattgggttcaactttgctgcacgacgagctggcaacaaagctgccaagaatgaaatgaccaaagctaagatcaatgtcatcacgacattgcccaatgagatttgaatcatatcaaacttcgcgatttggtaaagggcactgttcaaaccagccccaataccgaatgccaaaatcactgccaaaatgaaacttgccaatccaatcaacaatgattctgacgtgaacaagttacgaacgtccttcttgctttcacccaaagcacgcaagataccaatttccttcgttcgttctgaaacggacatgaacatcgtcacaataatcatcaaggctgacacaatcaatgagatggccgcaatcgctgccaacacatttgttgccaatgacacaatcgtgttaatcgtatccaagattgaaccaaccgttaccgcttggtacaaacgcttgccatctgcatccttcatcttgttgactgccttttggaaggccttcacatcatcggtatgcttcacacgaaccgtcacgaacaacgcacgcgtatccgcaccagcttccttgtaggcatcttcgatggtgccggccgttgtcacgttagctgtaccggcttggccagcatcgataacacccgcaaccttgaatgtcttattaatttcaactggtgtcatcccgtctgacttaactgtcatccacttaaccgtcatcgtcttaccaacaactgattgccaatccttggtattgaacttcttcgcaactgtcttcttatcgaccaagatttcgttcttgccaggcacatgaccagccttgatcaacttcttttgataagttgctgaccacgtttgcactgtgccaagtgagtaagccttaccatccaatgttgcttgcacgttaccggcttgataacccttttgcaacgtcttcacgtacttattggccttaatcttcttgatttggtcatctgaaatcgtcgtcttatccatgtcaacgccggctgtggccccagaagtttgaccaacgccgccgttatcaccttgatgacgggcaaccgttaccgccgttggattagccaaagaattgacctggtcattaatgtaggccttaacaccatttcctaacccggtaaacagcatcaccgcaaacaaaccaattgctgttccaatcataatcaatgaattacgccagaagttatacgttaagtgcttaaacgcattgcggaatgatgctgacgctggcaatggtcggtcagctaaacgcgtatcatcggctggaagttcgaatgctggtcgcaaacgttggtcgtcatcaatttgaccatctgccaaatgaacaattcgtgtcccgtggttcgccacatcttgtgagtgcgttaccgcgataaccaacttaccatccttggcaatgtcttctaggatttccaaaacttcagccgtgtttttaccgtccaacgcacccgttggctcatcagcaataatcaccttagggtctgaagccaacgcacgggcaattgccacacgttgcttttgtccacctgacaattggttagggtgcttcttaatttgttcttgcaaaccaacctttgtcagtagttcagttgcgcgggccactttctccttttggctcaacgtcgtcatctctaatgagaccaatacattttccaaaaccgtcaagtgactaatcaaattgtaggcttggtagatgtaaccaatcgtcccccgacggtaagcatcgagttgcttttcttttttgtggtccaaaacttgaccgtcgatggtaacttgaccctcaaattcacgatccaaaccaccaatgatattcatcagagtcgacttaccgccacctgattcaccaagaattgaaacaaactcgcccaattcaaattccaagtcaattcccttcaaaacaggaaactcttctttacccaaaaagtatgacttgcggatattttgtaattccaaaaatgccattgttcttcctccggcctttcatattcatattttcattaagttaaatataagtgtaccgccaccccatacccacgtcaagaaaactttaatataacacttgctgattaaactttttgtggtatattaaaattaaatcaaggaggtacatcatgaaccgagaaaccaaaaaagcgctcacgaaacaacaattaatcgcgagcgcaacggctttgttccgtgagaacggcattcacaatactgacttaaaaagtatcgcagctgatgccggtgtttcagtggtgaccttctacaagtatttcgatagtaaggatacccttgtccgggaaattgctaacgatgaactcaataacctttttgaccgtatcatggcgattgcagattcacctgatctaacgattttagataagataaaggcttttgccacactcacggccactgcccaaaagaaaatcgccaccacatacggcccagaaatgattaccttgcttgagacagatgatgcacacattcgggcagttgctgacacacgccgagatactttttttacgaccattattgaacaaggccggtctgaaggcttcttcaatgctgacgtcagcaccgctgctattcgcgtatacatcgatatgttcatgtcgtacgatcgccaaaaaaccatcgctcttgctcagggtgaaatcgatatcaaaacaatcgatcagcaacttgaacaactctttttctacggcttaatgggttatatcaacgttgacaagcgcgcccaactagaccaaattcgccaacaaaatagagagtgagacaaaaggcttttaaggctgagacagaaacttctgtcccagccttatttttctacactcatattagttcttgccaagtttgcaacacgccgtcgtgattattgtcagcgacagcgatggcataatcatacgcgaataatcgcttatcagcattaggcataataattggttgccctgcgattgccagcatttctaaatcgttcataccatccccaaagacagctaattccgatggcgtaccaccaagtgtctccaataattgctggaggctggccgctttattaacacctggcgccatgacatcaacgacaccatttccgggtgtcgttgcatgcacatcggtctgattttcgcggacttgggtcacaaatgtttcgctttcagctagcgtccaaaacaccgtcaccttcatgaccggtacgtcgacttgcattaacgaatccacaaagcgtggctgcccatataagctagccatcatcgttaaaaaaccacttgggatggccccataatcgcggacgactaataactcatccggactgaacactaggataccaccatgcggtttaactgacatacgatcgatttcgtgttgtagactacttaattgttcttgcgtcatcatgtgtcgttcttgaatctgaccgtcagcagaaagaattgttgcgccgttatccgccacaatattcacccggtctaagaaaccaccaaataacatttggacgtgttttaaatcacgtccactcgccacgatgaattccccacccgttgcttcatatgcttttaggacctgcgcaaataaatcacgattaaatcgtttctgatcatttaaaaacgtaccatctaaatcagtcgccacaaattttgtttgcttcatcatgtcacctcgctcaaaaattaatctaacacagaattttgaagttggtgttcaaatgcgagtaagttttgcttccaagtcacaccggcccgataattccccaatgtgccatcttgacggacgatgcgatgacaagcgcccaaaatcagtaacggatttttcgcaaccgccgttgcaatggcccggacagcattaggtcgcccaattgccgtggccaacgcttgataactcattgtcgtgcccgtcggaatagtttgcaaatattgccaaacttgccgttgtaaatcggtgccatgcgattgccagtccacctgatatgatggcaaggtttgtcctgctaaatacgcagccaccagactggcatagcgctgcttggttgctggcgttggctgaccggttggataccaagcttgatattcagcaactgggtcatcggccaacgagacaaattgcacgcccattggtgaataaaatagcgtaattgtgccatttaacaatggataactttcataattaatcatcagctaatccccctacgcataagtttagcaaaaaggagcgaacctgcgctcgctcctataatcagttaaataattgtttccagcgttgccaagacaccatcatgctcattatcaaatagtgcctcacggtagccacggccaaagagacgttcatctgaattcggcataatgtacacttcgcccgccaactgcatcatttccaagtcattcatgccatccccaaagaccgtcaaatcttcaggcactaattgtaattcggcaatcatcgccgatagactagtcgctttattgacacctgctgctaaaatatcaactgccccatagcctgacgtcgttgggtgcaaaggcaatgttgtcgcttgaatacgggcaatcgcctcatttgaatggacaacatcaaaaatcgccgtcacgctagccaatggttgggggatgtcgcgcaagtgatcaaccatatgaatttcgccataaacctgcgtcatatagtcttgcaagtcagcacgtagctcgccatacccatttaagcggtacatgctgtccgcagaaaaggcaataataccgtcctttggtgaaacatcaaccaaaatttgttccaactcagttagtgtgactgggtcaatcgtgcgtaaagtcgtcgtttccgtcccacgcacgtgccatgcagcaccgttattggtcaccagatgaacacggtcagctaaagcaccaaactttgtgcgcacccacttcgcttctcgcccagtagcaatggcaaattggtcgccttgcgcatccaacttatccaaaatagtcgtaaaacgatcagcatcaaacgtcttatcctcgtgtaggaaagtttgatctaagtcagttacgtacaatcgtgtcatctatgttcacctctacttatcatttgtcacttacagtgtatcaaaggtatttggggatagatacccaaaagtacaaaaaaggcgattgctttcgcaatcgcctttttaatcagtatagctcatcagggagtcgaaccctggatgccggtgtgaaaaaccggagtcttaaccgcttgaccaatgagccattatgtcgcttcgttgcctcaacaacataatatatattaccaggataatcatctcttggcaaccctttttttaaattaattttcaccccatgtacgtgccgttttattgataactaaaacaccccgccctggtactgtaattgtcgatagttgatcacaatcttcaaattgtgacagagccgtcacccaaattgccgcatccgttaaatctggcaacatcactgccgctaccccatcgattaattcatgcgttgcaatggcccccgagtgaatcggtacttctaaataaggatcgacatcatccgtcttatcaaaaacttcgaacgtccaaaaccaatctggatcctctggctttgtctcaacgcgacgcataccgccaccttccaacgagacagctgcgacttcaggtagcgccaacaacggtcgtaaatgttgttcaaacgcctgttcaactgcccacccctgcactaatgcacctggatgataatttggcatttcaccagcagcatataactgattagtcatctgctccccatatgttgccgctgctaagaccgtccgaaattgaggcgacacctcatgaatcgacagttcgcctgcattgaatcgattcaaagtcgacattggtcgcttttctgaaaactcacgaaagatccagtcaaaccaatactgcatttgcacttcggccaaattgccgtgctcagcaatcgcttgtcgtgccggttcaccacctttaaacgctatctttgcctcatacatgacaccgtctttttccactgacaaacctgcaagccaatactttgcattaattggttgtacaaacatttggtagcccccttcatttggttactaaaagtttagctgttcaggcttaacctcaccttgatttaaacttaccggttcttcacgtataatgaaatagacaagaggataaacaatatgacaactaaacaattagctcatccgaagctactgctattctttgaaacgttgacggctatcggagtcgttgttgcactattacgttttcttgccagtatcattaatgcgatttataagcatacaactggcaatgaattaacgtttgtcacaactattcgtgataatgcctggcaaaattatttaacgctagcgctattaatcattggtattattggcactcgcatcttaaagcgccgtttcaagtaaaacaaagccgcaacctcatctgaagttgcggcttttaagcgtgttccgaaaggcaaatccttaccataacgccattcatctcgctctttttgttttattcaaactcggcattctttttcatagttgcttgaatagcgtcagccactaacccatttaagttgccttgttcaagtgcttcccaaccagctgctgtagaaccacccggtgtcatcacttcatgggccaaggtcatggggtccttctttaaatcacccatgtgacgagccgtaccaacaactgtttgttctgccaaacgcgcggctgtatccggtgcgatacctgcctgaatacccgcttgcgtcatcgcttccgcaaatgctgcaacaaaggctggtcccgaacccgctaatgcgctaacagcgccaaactgttcttctggcaattcgtctgtccgacccaactccaggaacaacgctgcgattgcgcccttcacatcttgatccatatccgtatcaaatgccaacgctgtgtagccatacttcaatgccacattcacatttggtaacgtgcgtgcgaccataacgtgctcaccaaaggctgcatgcaaggttgccaatgacacaccacccaacacagatgccacaatcacacttggcttcatcataatcccaagttgcaactcttttgcgacagcttcaagctgcgccggtggcatagccaacacgaccatatctgattcagcccagacatccaaggccgactgcttcgcttccaaacctaattccgcagccacttgggcaccggaattaggtgaataaactacttgacgaatatctgcattgcctgaccagccttgcatcatcgctttagccatattacctgcgccaataaaaccgattgttaacatctcgcacctcatttatcacattgttattagtcatatcataacatagccaaatcacccgcaccggctcaaaatagttttaaaatttcggataaagaaaaaggtctagcaattgccagacctttattattgactctatgagaaaccttgtcgttctgataatgagaatgaccggttatgatagcgcatcgacattatcagaccgataccaatcatatttccgactaacgccgaaccaccttgcgaaatgaatggcaatggaatacccgtcaatggtaccaatccaatgttcatcccgatattttcgaaaatgtggaagagtagcatcatcacaacgccagctgcaatataagcatagaattgatttgacgtatcgtaaacaacttggaagatttggtaaatcaacaagaagtacaaaatcaatagcaagatactacctacgaaaccaaagttttctccaataaccgagaaaatcatatcagattcacgcactggcacagccacgtgtgatacgttgaaacctgtaccactcaaaccacccgaaccaattgctttcattgattgccacaactggtacgcactgtttgatgtatcaccagatggcttcaaccaagcatcgacacgcgcaaactggtaagcttcaaatcccaccttttccagaatatggcgtccccaggtttgggtaacgaacagaattgctgtcgttcccagtgccccggcaacccccataattggtccaaggattttccaactcaaaccagatacgagtgtcataccaaaaacgattgccaagaacaccatcatggttccaaagtcgtgttgggcaagcaccaaaacaacaaccggtgccgaccaagcaatgatttttaagagcaacatcttatctgaacgccaatcgtgaactggattattcagattgtgttgcgaaataatgcgggccaacatcacgatgaaggccggcttcataaattcagctggttgaaaagttaacggtccaaaggcgaaccacataccaccagtccttgcataatacgcacgtgaataaaacaccaacacggccaacatcaagaaaccaccaaatccaaagatgtaaggtgctactcgccatagctgttccgagtcaaagcgcataataatcatgacgacgacaatacctgcaaaatagtaggccgcctgcataattaccattcgcgtcacgttcacaccaactgtatcgtgtgttcccgccacatataaggatgccaaaccaatcaacgctagcatcatgacaacgaagatgatcgaccaatcgacctcaccttcgtgtgcaaaaaagcgtttgatcatgttttacctcttaacctgcaattagtggtgcaaattgaattctgcaatcaacatttccattgcatcatcaaagtccttagccgttactgaacggttatcagaaaaacgcaccgtcaatggtgtcgttgattcatcaatcgttcccaaacgaaccttgttaatctttacttctgagaggttatctcccatatcgttaatttctactgaaactggcttattattccgtgacataattacttcccttgtgatccgtgcatgtgttctagcaactttccagcacccttggcaacattatccaatgggctttctgaaatcataacgggtacgcctaagtgatctgaaatcaacttatccatcccgcgtagtagggcaccaccaccagttagcacgataccacgatcaatgatatcagaagctaattctggttgaatacgggccaatacttggtgtgccgcatcgacgatttgtgccaatgcatcgtgcatcgccgcctcaacttcattagcattcaacgtaattgtacgtggcatacctgagaagttatctcgtccacgaacttccatctcttctggctcgtctaatggtgttgccgtcccaatcttaatcttaattgtttcagctgtacgctcaccgatttgcaaaccgtggtctcgcttgaccatgttggcaatgtctgcgttcatcttatcaccggcaactcgaattgattcagatgccacgatatcaccaagtgacaacacggcaatatcagacgtaccaccacccatgtcgataaccattgacgcaattggtgagaagatatccaaaccagcaccaaccgccgcaacctttggctcgtactctaggtagaccttaccaccaccagatttttcggcagcaccgataatcgccttacgttcaatttctgtaatattcgttggggcgcacaccataatgtttggtcgtgacatgataccctttgcgttcaactttgacataaagtatgacaacatcgcttccgtcatatcgaagtctgaaataaccccatccttcaacggacgaactgcgcgaatgttacctggcgtacgaccaaccatttggtaggcttcagttcccacagccaaaaccttatctgttttggtatcaattgcgacaacagaaggttcgttaaggacgattccttcaccctcaacataaattaggacatttgccgttcctaaatcaacgccgatttccttggccatgattttccacctcttattttacttgcgcatactcgctttaattcttaaatatgtatctttaatagtatacaacaaaatccgccttaaattgaccccagtttgctttccagcgtaaaataggggtgacaaaaaataaaggacattattacctatgaaactgacattgcaagaaatggcaacggccatcaacgcggaaattatcaacgcggccgatgtcgctgttaccagcaccacattcgattcacgtaaagctgaagccggtagtttattcgtcccccttgttgctgcaaatgatggtcacgattacgttgctagcgctgttgctaatggtgccacagttaccttatggcaagctgaccaccctaatgtaccaactgacgtgccaacattggttgttgccgatacgctcgtggccttccaacaattagccgtctactacttgaagcaagttcaaccaaaagttgttgcgatttcaggttcaaacggtaagacaacgacaaaagatttcgttgccgcaattggtgcttcaacattcaaaactgtcaaaacaccagccaacttcaataacgaaattggtgtcccaacaaccatcctatcgatgcctgcggacactgaactgttagtcatcgagttcggtatggatcgccctggcgacttgaccttcctatctgaaatggttcaccccgacatcgctgtcttaacgatgattggtgaagcccacattgaattcttcaaaactcgcgaacgcatcgccgacggtaagatggaaatcattgccggcttgcaacccaacggcgtcctcgtgtacaacggcgacgaaccattactccgcgaacgcgctggtcaacatgcattcttgcatactgcaacttttggccttaaccctgataacgatttgtatgcgtcaacaattgctatgaatcccgtcggtgccaccttccaaacggataaatcagcgatgacttaccacattccattgacgggtcgctacaacgtttctaacgccttagccgccatttctgtcggcatcttgttggggatttcagacgacaagattgcacaatcgcttgcagaagctcccatcactgaaaaccgcaccgaatggttagctggtaattttggtggtaagattttgtctgatgtttacaactcaaatccaaccgctgccaaggaggtcttgcacttctttgccgagacacctgttacaggccgacgtattgctgttttgggtgatatgctcgaactcggtgaagctggcccggccttgcacgctagtcttgctgaaaagcttgatccggcaacgattcaacacgtgtacctcgtgggtgacatcatggcgagcctcgaagatgccttgagcgttaattacccagctggtaccgttaaacgctatagcaaggatgacaaggcaaccctgattgctgatcttcaagctgatttaacggctgatgatgccgtccttctaaaggggtcacacggcattcaccttgaagaagtggtaactgccttggtctaatcaaacaacagaaaaaagcgatgcagacattcgaatgtcgcatcgcttttttattgtcattagactgacttaatatagttcacaccgtctgccgctggggcctttgacttggcgaagaagacaaccaaaatcaaaaccgtgaagacgtatggcgcaacttgtaggtaaactgctggcacttggttcaatagtggcaattgtgcaccgacgattgccattgattgtgagaagccaaagaacaacgcagctgccatggcaccaactggattccagcgaccaaaaatcatggccgccattgacataaatccttgtccaacaatcgttgatgctgaaaagttacccgcgattgattgggcgaacaacgccccaccaattccaccaaggacacctgaaatcagcacaccggtataacgcaaagcataaacattcaagccaagcgtatctgcagcttgtgggttttcaccaactgaacgcaagcgcaacccaaagcgggtcttaaacaatacccatgaagctacaaaagctacgataatcgcaacccacgctgtggcagaagtcttcgtgaagaagattgtgccgataaatggaatctttgccaaaccaggtacattccagtaaccaaagttttctgcaatcattgatgtttgacccttaccgtacatcaacttaatcaagtaaacacccaaggctggggccatcaaattcatcacggtacctgacacaatgtggtcagcgcgcaaagtcaccgttgcgaccgcgtgtagcaatgagaaaatcagaccaatgactgcaccagcaatcaaaccaagccatggcgtcaaagccccaaattggcttgcaaatgttaaattaaagacaacgccggcgaaagctcccataatcatggttccttctagcccaacgttaacaactccagcacgttctgagaacgtaccccctaatgcagtgaaaatcaaaggcgctgagtaaaccaacgtacttgaaatcaccaattgcaagatcgtttccaaactcatggttactctgcctccttctctaccttcttgtctttacgaccctttttctgagggccggctaacttcttggctttttgctttgcatcatcttcatcgatcttaaccaaaatcaaacgaatcaagtagttcgcaccgataaagaagataattgacgctgtcacaacagaaaccaattcagttgggacaccagaagccaatggcattcctaatccaccaacagacaaaatagagaacaacaaggcagcgaagaagatacccaagaacgaacctgacgccaacaaggcaaccgccataccatcgtatccaacttgtggtgcaccagtttgcgagaagatgttcaagtacgttcccaaaccttcagttgcaccagccaacccagctaacaagccagaaatcgtcatggctgtaactgccgtgcgctttgctgacatacccgcataacgagcagcatcggggttcaacccaactgcacggatttcaaaaccaagtgttgtccgcttcataatgaaccaaatggctaccagcgccacaatcgcaatgataaacccaatgttcaaacgagacccacccgttaagttcgcaagcaaatcccaacgtagcgaatcctccgttggcaacgtaaccgtcatatcagttgtcgtcatcaacttcttaggtaacccttgcacaaaggcatttccaccatataaggcaatgtagttcaacatgattgttgtaataacttctgatgcaccaaactgagctcgcagccaacctggcaaggcacccatcaaagcaccagcgagcgccccgatgataactgccaacggaattgacagccatggtgtcattgattggttaaccaacacaaaccacgttgatgcaatccaaccaacccaaacttgaccagcaagtccgatgttgaagaaaccagctgattgtgcaaccaagaaaccggctgccgttagaatcagtggtgtcattgatcgcaacacttcaccgatattcaatgatgacccgagcgctgattgcaccaagctcacataaccagtcactggattaaaaccagagaccaacatgatgatcgcaccgaccatcaaaccaaagaagacagccaggcctgcaacgagacctgtaccgtatgaattaattttattcaccagtctactcccccgctaattgcgcacgcgcttcagccaatgacattcctgccatcaacaatccaagctcattctttgacgtttcatttgcgtcaacgacacctgtaatctcaccatgtgaaataacggcgatgcggtcagcgacattcaaaatttcgtccaattcaaagctaaccaacatgacagctttaccagcatcacgttgattaatgagttgctggtgaatatattcaattgcaccaacgtccaaaccacgtgttggctgagctgcgattacgaagtcagcatcacgatccaactcacgcgcgataatggccttttgttggttaccaccagacaaagcactagccggtactaattcgttcaccgtacgaacgtcaaacttttcaatcaactcacgcgcgtgggcgttgattttgtcataatccaacacacccgccttcgacatcggtgccttgtaatacgtttgtagggcaatgttctcagccaatgtcatatccaattccaacccaaaacggtgacggtcttctggaatgtgtccgacaccactttcagtgatttggcgaggcttcttgttggtaatatccttacccttaagtgtcaccttacctgacgctgttggcatcaacccggtcaaagcagaaataaattctgattgtccgttaccatcaataccagcgatacccacaacttcaccagctcggaaatccaaactcaagtttttcacaacttcaacaccacgagcgtccttaaccgtcaaatccgacacggacaaaatcgtgtcagttgggtgagcaggctccttttcagttgagaagagtgatactgagcgaccaaccatgatatcagccagttcttgtgatgacacaccagcaacagggaatgagtcaattgactttccccgacggataaccgtcacttggtcagccaccgctttgatttcatcaagcttgtgcgtaatcaaaatgactgacttaccttcagcggccaagcccttcaaaattgtcatcaactcatcaatttcttgtggcgtcaacacggctgttggctcatcaaaaatcaaaatatcagcgccacggtacaacgtcttcaaaatttctacacgttgttgcataccgaccgaaatgtcccctgccaaggcgttcggatcaacatccagcccatattgttcagataactttttaatttcagtcgcggcagctttcgtatttaacttcagcccattaacgggttctgatcccaaaataatgttttctgtaactgtaaatgcatcaatcagcataaagtgttggtgcaccattccaattcctaattcagcggctttcgaagggctatcaacaataaccttttgaccattaatcaaaatatcgccggcagtcggttgtagcaaccctgacaattgattcatcagcgttgactttccagctccgttttcccctaacaaggcatgaatttggcctcgcttcacttgcaaattaatttgatcattcgcacggaattcaccaaattgcttcacaatgtcgcgcatttctagcacgattggctgatctgccatagcacatttctcccagacatttttctcgtcacatcttcatcaagactatgacgtaataggtatattttacctactttttactaaattttctagtctatgcaatcgttattattcgtctattaacatggttgtaatacaaaaatcgattaactagaatttttcaatacataaaaacaggacattcaattaaatgtcctgttttaagttcgttttttaaacgttttacttcatcgtgcttggcacagtcacatcgccagacttaattgccttttcagccttctcaaccgcagacttctcttcagcatccaagttcttctttgtgattgcaacaccgccatccttcaaaccgtaagtcgttgtcttaccaccagggaacttaccgtccattgattggttagcaaccttttcgattgagctagcaatctccttaattgctgacgtcaacgtgaagttgtcgctcttgccatcctttgtcttgtagtttccttggtcgttttgatccatatcaacaccaatgacccaagccttgtcctttgaaccagcattcaagcccgtattgatgtccttggcagctgtaaataccgcgttacctgcaggaccagcagcttggaaaataacgtgcgcacctgacgtgtaaatagcgctggcgattgtcttagccttcgccgtatcagtaaatgactccgcaaattgggcatcaaccttcatatttgggtcaactgactttacaccggcgatgtaacccgcctcaaatgattgaatgactgctgaattcattccaccgatgaacccaaccttgctgtcacccaactccttagccttcgttgctgcagcaacaccagctaggtatgacgcttcttgttgcttaaacgtcaatgaagcgatgttcttatattgctttgatgccacatcgtcgaccaacacgtagtctgtctttgggttttgcttagctgatgcgaccaacgcatcattcgttgcgtagcccacaccgatcaacatgctgtactttgctgatacaccttgttggaagttcgttgcaaaatcagcatttgtctttgaagcaaagtagtcataaccatttgcgcccttcttcaaatcgtgtgactttccccaagctttcacaccattccaagctgactcgttaaatgacttatcgtcgacaccaccaacgtcagtaaccatcgctactgagaaattcttcttgtttgaatctgatccgttgtttccggcgactgcggccccaatacccacagcagcaacaacaacgacaccaccaataatcaaattacgacgtgaaaccatttctcatatcctccaaagtaacaaactgtatgttcctagtttaatcgcttggttaacaaaacgtttaactgttaacctaacttgctgtgattagtatataaggttcttttaataaaaacaatgaataaagtgtgaatttcgttcgtttacaccctgaaaagttaaacgttttactatattttagacttattatagccccaataaacgaacaataacgtctaaaaacaataaaacgtttttagtaaaaacgttttacttttaaattatccattggttaaatggcgtattttcgtcacaattttttctttacagtttaatgacaaaaaagctatctcgcgtaaatacaacacgagatagctttttatcgttcatactatttagagttcactttactgaaatccattcaagttatcgtcaccatcaacggtgttacgatcgatcgctttaccggccgcacgcttggcttcagcgattacacccatctcgcccaatcggtttgccactgagtatggcaaattgatttctgattcgaagtacgtgtccaggaatgctaattctgtaaccgttaaccctgaagaaacggcgtgtgacaatgtcgtaatcacttcagctgccgctggtgcgttcgttgaaatttgtgcgccatacacgatgcctgactcatagtcataaatcaacgatgccacaatgtccgtttgttcacccaaggcatgaatcgtggcgggcgtgtgaatatcgagacgctcgatgtggtcaccaatacgctccttcgctgcttcaacagtcaatcccgtcttatagaagaaacgatcaaaaatcgagaatccaatcgtacgcaaaattggttgaattttaacatccaaacctgccaccgcataacctgccacgcggcccatcttcaacgcagcggacatcaacgggaagtattgatcaaacttaccatcaaccacagctgaatcgccgatagcgtaaatatcagggtttgatgacttcatcgtgtcgtcgactacaatcgcgccgttttcacgcatatcaacctgaccagctaacaacatcgtgttaggctgcaacccggctgcaatggccatgaagtcgaacacttctgacgtgccattgttaaagttaacttcaatcttcttcccttgattatcaactgaaaccacttcttggcccttacgcaagacgaccttgttatcagtcaacgtcttttccaaatcttcttgaatggcttggtcaaaatagcgcgtcatcaaacgctttgaacgggtcacaaatgtgacatgaacacctgaatgcgccaaagcggccgccaattcagttgaaactggtccaccaccgtaaaccagggcccgcttgcggaagcccttagcaaacttattgatgtccacagcatcttgctcgtccttcacgaagacaacccggtccaaatcagcccccacaaatgatggtacgcgtgctgatgatcccaaggcataaatcaacttatcatatgattcctcgataatcgatccgttatcaatggtacgggcataaaccttcttggctgcagcatcaactcgttcaaccaaaacgcctgagcgatacgttgtattgggttgaccctcaaaatgctcgaaatttacttgttcagcacttgtcacgcgtccattcaacgccaacttgatacccgccgaaataaatggtcgttcgcgtaaattcttttctaagatgacaacttcatctgtttcattcacttgacggaacgcattgacggccgataagccagcgtgcgcccctccaatcacaacaattttcatacttaatatcttcccttttaaccaattctacctattaactaagcacgcttttcggggaaacttgccccaaacaatcggaaccactctgacgcaaacaatgattgacgacgtgtacgttgcaacatcaattgcgtatccaagcgacgttcaatctcaacccatgaaatttcaggttcagccacaaccatctcgtgcgcttctgccaataattgcttatcaatcaagcgtgcatccaatggtatcgcgtccaaaaatgacgctgataataatgaccgaatttctgtatccatgcgtgaaattttcgtgttaaccggttgtaaccgcttttttacccacttctgtcgtgaaaaacgatcacgattcaaaattgagtaataaatcaataagtacagcgtcgtaaagaacgccaccgcagttcccacaacataggctataatcttatcaatcggcaagaatggcaagccaaaaaatgccaaaacagctgcaagcgccgtcaacacgaatgagagaataaacgtcaccgtattcttgagttggcccaaacgaacgcgacgttcagcacgcagccgtcggcgccgtgctgacaatcgggtaagcgtatcattcagctggcgcaagtgctccagcaaaacaagcttttcgttattgccatccataactcaaacaatcctcatctcactataattcaacatactataaggtagtatagcgggtttatttaacaaaaaccaccataacggcttctttcgcttacttttaatgtgtgcatttttacgaacgaatgcggtaaactatgaagtatggaattatcagaagaaatatttttaaaagagcaagaggctctcaaaattgccaaactcctcgccaatgatttgcgtctgcaaattctttgcctattgcaggaaaacggtgctgctactgtcactgaaatcatgactgccttacacgctgaacaatcccgggtgtcacaccaattgtcagctttacgcgaatatcaaatgatttctgccactcgcgaaggccgcactatcacgtacgctttaaccgacccgcacatgatggaattgctccaagatttacttgatcacgctaatcacgtgcgccttcaccgcaatcataatgacatttaaagcgtaaccatgggttgcgctttttttgtgatttatgactataatagtagaaaccacaaaaaggaagtaacaatgaaagaagtcaaagcgtttattttgcgcaatgatgtccagcggtatattgccctggcctttatcgtgctcttattgtttattgtccatgacctcatcagcatcttgctgctaacagccattcttggctacctcgctgtaaaaggtgccaacaatgtccaacggtggactaaaatcccctacggattctcagtgttgatcgtgtacctattgagtatcttcgtagttgtgatggcatttgtctacatcgtaccagctttggtcgatcaattcgccgtcatccccaacgaggtcaacaagcttatcaaagagtatccagtcattaagcagtacttcaacgaaacctatcacaagctagacctactgagtgaattttcaaaaaattggaagtcccttttggctagcgggtgggatactatcagcactgtcttgaatgcattctcacaaatcattctatcgattttcttgagcttcgtgctcgcgttgacttggcaacgcctacgcgtctttggatcacaatttctccactcaagctaccctaagtttttcaagaatgtctatgaacttggtagcacgttcgttctcattttaggtagcgtcatcgaggtccaattactaattgccttcatcaacacaatcttaatgatgatcggtttgagtattctgggcgtgccaagtgtcttggtcatggggttgatgattttcatcctaggcttaattccaattgccggtgtgattatctcactactaccactcagcgttatggctttcgcagctctcggctgggtcggcatgattgaggtctggattctaattgctgttattcacatgtttgaatcttatttcttacacccacgtttgatggctagccgaacagagttaccagtgttcttcacatttgcaacaatcatcgtgatggagcatctgcttggcgcctggggcttgattattggtgtcccaatcgtcgcctttatcttgagcgtacttggcgtgcaagatgctaacattacccgtagtacaaaatcagaataatcaaaaaagcagcgcatcaatttgcgctgctttttggttagttatgattaaataccaaatgtgccaccatgaacctcgtgtacattggtcgtcacaataaacgcattctggtcaatatcgtgcacgcgacgcaacatacgaccgtaattagcgttatccaccataaccatgagcatttctttattgttatcagtgtagccaccacgcacatcaaagacggttaaactctgagcttcttgtagcaacatcgtttgaatgtcagccaaacgttcattactcataatcgttacctggtgctttaaatcaagtccagtttcaatataacgcatcacaatcgacgtaatgactaatgaaaaagcagccaaaaagaatgcattggtgcctgaaactaacaaattaaacaaagtcaccaccatatcaatggctaacaatgacaaggcagaattaattttaaaatactttttcaaaatcattggtggtaccgttgtgccaccacttgacgcttcaagccggtatagaatggcgatgcccgatgcaaaaacagcgccaccaataatgacagctaagaccgcatcttcaacaagccgatgactaggtgttatgtacattaatactggtaataaaaaactaccaaacgcaatatttcgcactgtacttttatctaagaaaatagcagctaaaataatcatggcaatattaatgatcaacaccgttagcgctcggttaataccaaacgcagcatccagcaaaatggcgaccccggttgcgccaccagcagcaacgttaatcggggcatagaaaaagttaatagatagtgcaataatttcgagcgcaatcacaagcatgactactcgaaaccagccctgttgactcagtcttctcggcatatgggtctcctttgggttggaaatgtatatctgttacctttctagcataccatttaacgatatttcatgtatgacacttgtgtgaattcattccgtttcggcataccattcatctaccagttttgttcggagtggaataaaatgcgcttcatcacgttgcccaactgactcaccgtcgatagagaccacccgaccagccatcatcgttgaactcgtgatgaacacctcatcagccgtttttaactccgccaccgtgaaggcacgttcctcaaccggcatccccaatgaacgggcgacctgcaataaatgttgccgagcaatgcccggtaaaatcaacttatccgtcggcgccgtaattagcttgcctgccttaatcatatggacattcgttttagatccttcagtcactcgtgtgtcaccgttctcagtcatccggtaaaaaacagtttcatcaactgattcttgcatcgcacgttgcgcggcaagcacatttggcagtaagttaatcgtcttcacgtgcgttagtcctgagcgaatatccaattcggtccgtaaacgatatggacgttcttgtttgccccgatctaacgacataggtgttatcatcactgccaaattaggcgtcgcatctagcgggaaactatggctacgtcgccccgttcctcgggttacctgccaataaatcatataagcttccccagtcacgttggtgagtaaatcattcaaaatgttggttaactcttcacgtgtgaagtcaggcgttatcagcactgcagccatactccgccaaaaacgatctaagtgctcatctagcgcaaaaatcttttgattacgcgccatggtcgcatcgtaaacaccatcaccaaacgtaaacccacggtcagtcatcggaatcatcatgtcatcgatttccgatatcttaccgttatagtaagctacagtttccatactatccccaccgttcctaatcttttactcataatagcacctttttgcgcacaaaaaacgtccgaagtgcaattagcattcggacgttcattaactatttcttttgcaatttaacagccgtaccgtaagcagccaccatgttcatatcagcacccattgatcctgaatcaaaacgcatcataatcactgcatctgcacccattttagctgcgttatcacgcaaccgctccaaagatgaattacgtgtctcttcaagcaatgacgtataggctttaatttcaccacccacgatggtcttcaaaccagccccaatatctgcaacaacgttctttgagcgtgtcgttaggccgaagacctcacctagtgtttccaccacttcataacccgcaatattttctgtcgtcgcaatgataatatcatttgcatttgccatgtttgtttatcccccttggtttttctattgtaatcataccgatatagtctggtcagtggcaaccaaatttgtgtttaataattaattgttccagcagccatccctggattagacgaagaatccatcgtgacggttgcttcgtgtggcgtcatatggaattggtaacgtactgacgtcgtactgtttgggtcagtggcctgaacatgatacccaccgtctacataacgaatcccgctcaaagcccaagatgacaagtctgtttgtgtatattgattgactacttcacgtgccgcttgcgtcacctgctcaatcgatgcatttgaatcactaaaaatatcatactgagctgccgttgcagtcgatgccgccgcactcgccgattcagccccagcttcagctaccgacgtatcattgctggtcgttgcgtcaacacttgattggctaattgacgatgccgtttttttatcacttgtcgcttgcttttcactttcagatcgcaacgaacttaaagcgtgctcagctttactaagtcgtcgctcctgttgctgttgtgaatcattatgttgttgccatgcgtagtacccaccggcaccaccaagtgccacaattggcaccgcgataatcgtcgcaatcgttcctttcttaaccatctgccaaatacctccttagttaaacctgcgctcattaccttggatactaccaaagaaatgtgaccaaatttaacaagagctatttgtcgttgattatcaattacttcgtagccgcgagcgcacgttcaatatccttaaccatcttgcttggcgctgtcgtcggtgcatagcgtgcaataagttggccatcgcgcccaaccaaaaatttcgtgtaattccacttaatgcgaccgtgaccagactcagtcttcaagtagtcgaacaacggtgctgtctcatccccgttaactgccatcatttctgtcattggaaatgtgacgccataatttttttggcaaaatgcgccaatttcagaagcatcatccaattcttgtttgaattgattagatggacagccaataatcgtaaagccttcatcctgatattgatcatacagcgcttggagctctgttaattgcggtgctaggccacacttgcttgccgtattaacaatcaccatcacgtcccctgcaaattgttgcaagtctagttcttggcccccttgggtacgttctttaaaatcgtaaacagtcgtcatattatttcccccatataatcattcctgtgcaatcgattctacaattattgtaaccgttttcctttggcagatttattatatttttggcaccattattaaataatgtagattaaaaaaagacgcaatcaacatcactgtcgatagcgtctttttcaattacttattaagcttctggcttcaaaaccttcttcgaaacaactgacaaatcatctgccaagtcgtataccaaaggctcaccgttagcgatttcaacacccaagatatcatcatctgagataccttcgatgtgctttaccaaggcacgcaatgagttaccgtgggcggcaatcacaacgttcttacctgctgccaagtcctttgagatgtttgactcccagaatggcaatacacgttccaaagtaaccttcaagttttcgccgaatggcaattcaccttcaggtacatcagcgtaacgacggtcgaaggctgggtattccttacccaaaacttcaacagtctccgtttgctcttctagcaatggaggcaaaacgtcgtatgaacgacgccattgcaaaacttgctcgtcgccccacttttcagcggcgtcggccttgttcaaaccttgcaaagcaccgtagtgacgctcgttcaaacgccatgacttcatttcaggaatccacaattgaccagcttcttccaaagcgtagtgcaatgtcgtgatcgcacgcgtcaaaactgacgtgtatgcttggtcaaattggatgccttccttagccaacaattcacctgcagtacgagcttgggcaatacccttgtcgctcaacttcgtgtctacccaaccattgaacaagttcaatgcgttccattcactttgaccgtgacggatcaaaaccaactttgccattggtgatacctcttttgtattagaatatttcgttactattgtaacaaaatttcagcataattagtagtgattaattagtccccactagaatcttgtacatcataaacagcattggcactgcgcaaaccgtcgctacccacatcatgaccttattcgacttttcaaagttgcgtgccatgttatccatacgcacgttaagcaccttcatgtccccgcgcatttcagcgcggaactcagtaaactcagtccgcaactcacgcacatcatcttgtagctcacgcacatcgacttgtagttcgcgtacatccgagcgcaaagcatcaaactccccatcccgaaacgcttgaaactccacttttgtcacatacttttcatccattttgagtcctccgttaattggttaacattggtaacatttcccctaatacgacaacagaggtaccgcatagttgcgatacctctgttaaaaatcgttttaattgttacgtccaatataccggattgccgaccgattaacaagcttttagcgcttaatttcaccattctcaataaccaaacctgatgagtgaacgggaccttggcgatctgggtagatacgcttgataatactgttcacagccgttggcacttcaccaaaaccagttgcaatcaattccgccttaccagggtattcggccacatcaccaaccgcaaacaaacctggcaccgtcgtttccatctcttggctaaccgtgaacttctgacgttctacttcgggttggacggtccagccagccacaatcttattctctgatgtaaagccgtaattaaccatcaaatcatcgacattcaagaccttcttttcatcttcacggaccttagccaaagtcacattcaatgaaccatcttcagccttttcaaccgtttcgatgttatatggtgtctcaattgcaacgcgtgacttttgcaactcagatacggcgtgctccatcgcacggaacttatcacggcggtgcgtcaagtgaacctctgctgcaaccgtatccaacaacgttgacatatcaacagctgaatcaccaccaccagcaaccagcacgcggtgatcacggaagtcttcaacgtcgttcaagaagtagtggatgccttgaccttcaagaccattttcaactgcttctggcaaacggcgtggctcaaaggcacccttaccggttgcaacaatcacagacttcgtgtggaatgatcccttatcagtcgtaatatcaaattcagtcccattaggctgaacatcaataaccgttgtatcaagatacaaatcttgtgggaattgacgcatttgcttgtccaattccttgataatctcagcacctgttgtgttcacataaccagcgatatccaaaatcgtcttttgtgggtaaaggttagcaacttggccaccaacactctccaagctttcgataactgtgacatccaattcacgcaagccagcgtaaaaggcggcaaacattcctactggtcccgcaccaataattgttaaatctgtatccttaaattccgtcatgattgtttccgttccgtttctatcggtttcattatttttcttaattacgagtgttattatacgccaacaaaaaatcccctgcacggtataaaggaaccagcaggggcatttcaattacaaattacggtcgtacaaactcgtgaattctgacaaatccacgtcaaaatcagctgccgcgacaatatcgaccgcactgccttcttcgccagccttctcttcaaacgccttagcaaaacgtgggtatagctcttggaatgcatccttgtcaggaccatccacgaccaacaaataattagctgcgtttgtcgccccattcgtcaaccacaacaagtgcatgtgctctactgcacccatggcgtcatctgctaaaccaatcaattcgtaacgcaatggcgttggaatgatgtcttcagcagacgcaatttgcatctcagcatcgccatccccttcttgcgctgccaccatgccggcaatataagccaagttatcacgagtgattggcatgccattcgtgaatgggttcaaggccaagccttcaatattctctgaatcatcgttttgcaacaatggcaagtagtcagccaatgacatcgcccaagggtgtaccggatcttctgagtcaattggtccagcattgaaggcatccaaatccgtaaagattggaaatacggaatggccgttttccatctcaaacgtcaacaagcgcatctctgatccttctggaatctcaacgtcaccgttttccttaataattggtgcttcagtgaagttaactggcgcaacaaaaactgcctctacaagtccttgaacaaatgcttgttcattagctggattttgttcttcgcggaaagcttccaacgcagctaaaagctcgtcgttacgcaatacttcttcttggttatccattgtcgtactacccctgttagttctcgttatttgttactaagtataacggatattcacccctttgtcagtgaaatccgatgtctaacaaaaaaccgcatctcaaagtagatgcggttttttgtataaattagttagccttgttgtaaattggcgtaaaggcggctgcacgtgggtaaacgatttcttcaacgctcaatacatttgaaaatgctggggcattgttaatcgttgcaaatgcaaagaattgtgccttagcttcttctggatcaccttcagtgtggatcacgtaaatcaatgtacgttctggtgcacgaaccaaatcgattgcccatactgtgttcatctctggcatgttttctggcaattgctcagccaactttgccgcaaagtctgattggtcatcaactggctcttccagcgtgattgggtcttgttcgcgcatttgcgtcaacgttgccatcacatagttcatgttgtcttggttcatcacaacattttgaccaaatgcattaattaccaaaccagtatctgggttagctgacatcaaagctgcgtaagtttccaatgaaaccgtcaagcccacaacaccttcaacatccgttgaccacttgttgtactcttcagtgctcgtaaatgctgggaagaaaacttcttccttttggttttggataacttggtagttcaattgtgcagctacttcagaatcaattgagaaagtaccatcaccattgtcagtcaattctgcatcaacttgaactggcgcaagcaattgcgcagcgcccagcatcgcaatgaaatcatgctctgtttcagggtttacatctttctcgtaagcatcaagcgttgcttcgagatcttcattttgtagtggacggttgaaaatcacatctgccatgttcaaattcctcattcgtttatttttagttagtataacccaaccctaaataaatgtggtggaaaaaggggtactacttagctggtactttaacgtccccggccacaatagccttttgcgctttctgcaccgcttgccatgccccggctgacatctgaccacgggtcaccgcaacccccttgtttttcaaaccatagactaggtgttggccacctggaaatttatccgtcgccgcacgttctgtgacatccttgaccgccgtgccaacgcccttcgtcgctgacgttagcgtgaagttactcttaccatcagttgcttgataaaccccatcagctgcttgatccacgtcgacacctacaacccaaaccttatgcgccttagtttgcttctcattcaaatcctttgcttcagtgaaaacaccagcaccggcgccaccggccgcttgataaagcacatctgatccgttttggtacattgacgccgctattgttttaaccttaccggcatccgcaaaatcaccgacatactgcacatcgaccttaatattgggattgacagacttggccccagcaacaaagcctgtttcgaatgtcttaacaacggctgattccatcccaccgataaagccaagttgatttgttttagttgtcttcgcagccgcaacaccagctaaataagaagactgctcagtgtggaacgtgaccgagacaacattttgacgtttcttagcaatgtcatcaataatcatgaagttatttttaggatacttttttgcggctgcattaatcgcaggcgtctttgggaacccaatcccataaatattttggtagccattagcaactgcttgattgatatttgtttcaaaatcggctgatgtctttgcttggaaataagtgtaaccacccttaccttgcttcacatcgtttgccttagcccaacttgttagccctcgccaagccgattgttgaaatgacttatcatcgatacctgctgcatccgtaatcaatgcaaccgaagctttactagttgccgcatcccctttatttgcgctcgcatacaatccaattgcaactgctgcaacgacaacaacacccgtacccaaaacaaccttacgattcatgattaacccctattttgtaaaataaattaatttaaagttcgcgttttacgttaattaaacgttttaattaaccaactccacaataataacccgaacaaaacgttttgtaaacacaatcattcgtttttagataataaatagaaacgcaaaacatataaagagatgcaaaacacgaacaaaaagcgctcatcacgttttatgatgagcgcttttcgaactttaaattacttagcaggtacttctaccttgccgtcaatgatttgcttcttagccgcttgaacagcatcccaagttgctgctgacatgtgaccacgcgtcacggcaacacccttatcgtctagcccataaaccaagtgctcgccaccagggaacttatccttagctgccttttcagtgacatcaacaacagccttgccgaccttctttactgatgacgtcaatgtaaagtttgacttgccatccttagccgtgtaggcaccgtccgcgttttgatcacggtcaacaccgataacccaaaccttatcagccgccttcttttcactgttcaaatccttagcttctgtgaagacaccggcaccagctccaccagccgctgcgaaaataacatcagcgccgttttggtacattgatgcggcaatcgtcttacccttaccggcatcagtaaagctaccaacgtattgcgcatcgacctgaatgtccgggttaactgacttcgctccagccgtaaaaccagcttcgaaagtcttcactacagctgattccatgccaccgacgaagcctaacttattcgtcttagttgtcttagcggctgcaacaccagccaagtatgatgactgttcagacttgaacgttactgacaccacattcttttgcgtcttcgcaacatcatcgacaatcatgtagtttgtcttggggtgcttcttagcttcctcattaatggttgacgtcaattggaagccaatcccataaatatttttgaatccggctgctgccgcttgatcgtagttcgtcttgaagtcagcgttcgtctttgactggtagtatgtgtaaccacccttcccctgcttaacgccgttctccttaccccactttttcaagccttcccaagctgattgttggaaagacttgtcatcgacacccccaccatcagttaccaaagccactgatgtcttgtcggattcgcctgaagctgacttgtttccagatagagcggcataggcgccaccagcaataaccagcaccgcagcaccagcaagcaacatctttacgtttgaagccatgtttattattcccctttatgaataaaaccctataattttcgataactttgtcatctgtgtgaataatataactgactttcgtgaccttgtaaaccctcttgttcgtgttttatccaaaaataacacgttaactttttgtaatgttcatttttaaaaggttaaacgtttaaatatcgaatgttcgttcgttaaatgaatgtttagcgagaacaaaaaagaagcaatcatatctgactgcttctcaatgacttaatttacaagtcgcaccatatacgtttcgggaacaaacccccggacagcattgtaaatccgctttgcacgtgacgctttatctgtaatcgcgaaaacggttggcccagtccccgacatttgaaccgcttcagccccaaatttaagcattttttcttttaatttgataatttccggatacttcgaggcagtcaccggttcaagcacattgaacatgttatgaaaagccgtcttaaagtcaccagcttcaactgctgccattaagccgcccatatcaccatgcactaaactatcataatcaatcattttcaaaattttcggagttgaaacacttacagctggtttagagaccactagccaaagtggcgggaatttttgcgttagcggatcaaccacttcaccacggccggtcactcgagcagggcgcgagtagacacaaaaaggcacatcggcatcaatcttcaaaccgatttcggccaactgggcttctgttaagcccagttgccaaattttattgagtcctcttaagacagcggccgcatctgaagagcccccgcccattcctgccgcaaccggaatatgcttatcgatatgaatttccacaccgtccgcaacgccagcccgctgtcgcatcagttctgctgcttgataggccaggtttttctcattcaacggcaacaagccacttgtcgaatcgacgatgatattcgtatgcgccgtagtcgttctgattgttaccgtatcggccaaatcaattgcgaccatcaacatgtcccactcttgttcaccgtctgcgtgggcaaacggggtatcaaggctaatattgagctttgcgtaggcacgttccaatatctccatggtcatggcatcctttcgagtcttttgtttcattatagcaactttataagggtttgcgaaattctaccgtaccggttggttttcccttttgtcggactgttatccttgctatactgaaactactatccaaaaggacattgatttatgcgctatttatatatattggctggtctgattacctttggtatcggaaccgtcacaatttgggtgcctgggataccaaccaccccattttacttactaaccgccttcttttggggtcgttcatcagagcggctacacagctggctgattaacaataaacactataagacgtacattcatgaaggtatctatcaacgcaaactctcgcaacgagggcgcattgtgatttacttggtgaccgctgcgatgatgagcattccgttctttacatccggtaaactatggctccaaatcaccttggttcttgcctcattgtcacagattatttccatggaaggcttctaccgtggttggtggatgaacaactggttccttgtgaaagaggacgacgaagcttaaaaagccgtgtcactacgacacggctttttaagttagcattacatatcaaaacgactcttcaaactggtcaccacatcaggtgtcaatcgcatactattttgttggataaactgttgtacatccgcaaacgtgtcaaaccgctgtctaactggttgtaccaagtcagcttgcaacaatgcttccgcaaactggacatcagccatattaattgttgtcatcccccagggttgtgataacaataaatcttcccaagcccccttaattaacgcctccgcccgttcataacggcggtccttattaataaatgatcgtaaatcaattgggttcaaatcagtttcggccatcagtccactcctttatccaaacaacagcttcatcgcttagccattgttgatttgtttctaaaaattctgctgacgtatcgcgcaatgccgcttccgcaaccaaatcagcatcaagcaaagcggttgcaaattgcgcatcatcaagtgcaatcgtcgttggtgaaatcggatgactgacaacaaaccgattccactcattccataatagcgccactgcgcgttcgtattgtggtgctcgtaaaataacggcacgcaacatcaatggatctaacacactagtcctcccactttgttaatcgcacgacctgaccgaacggttcggttaatgataaggttacgccctcgggcagcacccagaccaaacggcgatacttcggttgtgccatctcatgttcgccatcaccgtccgtaaatatgacgacaaccgtactttcaggacgataacgatcttggtgtagttgttcaaatatcggtgcaaatgcagtaccaccacccgcacggcgttgaccattggccaaccattgtttatcaattggtgttgcaactgtatcaaaggcataaaaatggacactcgccgccaactgcttctgcatttgggcaacttcagccataaagcgcatcgccgtatcgtctgagattgatgctgaattgtcaataaatacaacgacattggtttgcgtggcatcaatttttcccgctagttccatccgatatggttggcgtcgattaaagcgtgcacgactatcttgtttatcggccggcacattactaatggccttccgcaataagcctcgccaattacgacgcggtgctaatagttgttcaatttgccgttcaacttcgcctgacatcgtcccacggccagcaaccaaggcatcatgattagcatctgcaaccacattccgcaaagcagcttctgcttcttcaccagcctctgccccggttgaccagcccttatgatcatcacctggcaactgcgaacttgcgccttcattatcgattgtatccatcaacggatgcaacaaattataataggtgcttgaatctgcatattccggcagttgcaagtcaatcatatctgtcacctcttgcaaggtatgtgccccggggaacccaccacggatatattggttaaccgctaagtcagttgctagaccaaccatttttgcttcagctgcattctcattcattttatctgcgtatcgaatcgggtgttcccacaccatgtgtagcacctgatgcgtgagggctccctttacttcggcaaccgtatgataaacttcttcaaataaaatcggattaattcgcaattcccaaaatggcgcctgccatgacaagcccatcgtgcccccaaccgtttcatcgtagacccgatttaagcgcaaaacgacttcaccataaaatcggctttcgtcaagcaatttcatcgtggccttctgaaccagttcatcaatcttctgataagtcataggccgcaaccttcgtaatcaattgatacaacgtcttcgctgattcatcatctgcgccatagagcttttctaagacatcgccagcagccaattgcttcacaattgcatactgaccatccttggccgttgccgttaaaatttgggcaaatcgtcctgcgttatctggctgggcaacatcaatggcaaccaaagttgacttaagcaaggccaacttttgaacttctggcaaacctcggtacgtttgcatcaccttttcgggcactactggcccccaaggttgactcacaaaaatatccataggcgtcaccgtttcttgattggtttgcatgaattgcacaaaacgttgcgctgcaacttcacccaaatcacccgcgaccaaatcaaaaaccaaagctcgttgcgtctcctcaggcaataccagcaactcaaacaaattatccgagacacgctgccaagcacgaggggttggattcaaatcgtcaccgcgctcagctggatacaattgggtcgcatcctcttggagataacgctgtatcaaatcatgaatatgtggacgttgcttttgtgtatcttcttccgcagcccaagcaagccaatctgctacatcaaccttcatcaccagtcgtaccgtgcgatctttgatagccgcatcaccagcaacaaccccataatctgcattttcaaatccagtcatcgtttcatcagggttctcagcaatcactaacttcacttcctcaggcaataccaacgaattgatttgccgttgcaaaactagattcattaattcgctttgcactgcttgtgacccacggttaaattcatccaagaaccataaaattgggcgacctgggtgtgcttgtgtggtttcaataatttcaatcaatgtgtgggtgtagccatactgcacatcggctagcgaaccatacttttctgtttcgacatacgcctcgcttgtcaaaggtggcacaggaattgccaagtcacctttttctgacaatgacacaaccgtcgtaaacaaagttgctcccatttgacgggccacctcagcaactaaggctgacttaccaattcctgcttcaccgacaatatttggaacgttaccaccccgcaataccacgggtactgccgttaataactctttaaatgataatgccatttgtgccacctcaacccttttaatcttgcttctagtttacgctgtttaatcagcttttgcttatgaaaagttattctgtccgtcgtcgcgttgcgacgaggcatgggtgtgggggattggctccgacaaagatgacatctggaaaactccgccggcgcgagcaccggctagcacccaactaattgtgttaagagtctgggtccgttcgccttatctaaccggcggtcggccgaacttgtgagttccccacctgtcatcgctacgccaatcccccacacccatgccaacagccgagatgttctctattttgcacgcaacactggccctttgatgccattaaaaaatgcagttattgccttgaacatgctttgacttcataaacaacatagaacaactcggctgctgcaacaggcgtggctggtatccggagcgttcaaaaatcggcaacatgccgcatggccggcgctattcagaaaagcccacacagaccttgaggctttagggggaattatttgccccgctgaatggcgtccgcgccattcggttgccgagtttttgaacaaaggcgtaggataccagccacacctgttgttcgtgcgctagcacgacaccaccacatcacatccaacaaaaaaaccagcaaacgtctagctggcgtttgctggttaccatggtgtttcggttgtctttcagtctgcaatcgcttaatcattcaccaagaacaaggacacaggttcgtccatctgttcgcttcttatccaaggaaggcctcgtcttgaaaaataattaggtttaggcactcacgtttgcgcgtttggtgtgagtggccgacacatcgattggcaatcaaagcatcaattcataaatgaattatacagaccccatccatattcgcctgtcaaaaagggaacttattggagatattgttttgcaattgcttcgtataggccaaccatatccaaatacgcctgacgttcaacgtactcatcagccttgtgtgctgtcgcattacctggtccaattactgcaagttctaagctcggattggctttgataaactgcgaagcgtctgttcccaaggataccgcaatagctggtgcagccaatggttcgggcaagtagtctggcaccaaccgttgaatcaattgaatcagttgactatcttttggtgtcaccacagcatcgtcatacgcactaacatgcaaggccaattgcatagtttcatcagtcgcatttacatccgcaaccagctcctctaatcgtgcaatcaattcttttggtggtaactctggaatgattcgggttaacaccgttaaggttgccgagtcaggcactgaattctgttgttgcccgcctcgaatgacatccggtccgtacaatgtccgatccaataccgggctaacctctggcaaggcgtcatagaatgccttctcagctaagtaatacgttaccaggtggtcaatcgcattcacaccaagcttaggcattgaactatgcgcagcttttcccgtcgccgttacttcatacgccaaaaagcccttgtgcgcgtgaaagatgaagtgttgctccggtgctgttgcagtttcaatagctgcttgcaaatccgtcaaggtcgcttcatcaattaccgcgccaccactttggaaatagtctgtaatatctggcaaagcaacccctgttggctcggcaatgaccatcgcatcgatatcatccgcataaccccgctcagctaacaagcgtgcgccagcttcagtcttttcctcatcaaccgtcactaacaaccgtaaagtgccatggagtggaaccgcttgttcatgcagttcaatcattgcaatcacatattctgccaaaccgcccttcatatcagttgtaccgcgaccatacaaacggccatcttgttcaaccagcgtaaacggatctgttgaccaggtcgttaaatcaccttcgtgaaccgtatctgcgtgcccagcaaatgccaatactgggccttgaccatccccaatttcggccaccaaattggcacgcttcgtattatcgtctgtcaccaattgtgcatcaatcccattcttacgcaatagatcctgtaaatagattgcaaccgatgtttcattatccgcaactgtattcagcgcaatcaaatcacgcaaaatggttaacttatcttgttcccgcatacttgtatccccacacacttagttttctcatgtaattctaatataagttgcggtaatatgcaaaaaaagcctggattaacaacccattcaggtcactaagccagacttttcgatcatcattttttactatgccgttggcgatcagccaaatcagccgcaatcgtagctgcgtcacgcggatgaacgccaatgttcatcacaatggcaatcacggtacctaagaacgtatcaaagacacgttcgatagcatacatatagctggctccttcaggaatcgttaacgaaatcatcaagaaggccgctacagaaccaattaatcccttattgttattcaagccatcattaattgaaatcaatagcatcaataatagcggtaccacgataattgtgacccactgcgattcatgcagtaaatcaaaaacgaaaaaataggtaatcgcaaaaataccaccaatggcatttccgattacacgcgacttaccaaattctaacgttgtttcaaagtcctgtcgcaatgaaaatacggcagccaatgaggcaatcatcggattaccacgatgtaaaaacgcaaacaaagcgatgataaccatcaccgatagtcccgttttaaacgtccgcatccccaatcggaacatccctaatttcattgcagaccctcactttattcatattgcgtggcgtggcgatagccgatcattatcatgactgctaccccaataaaggcaataaacacaacgcctgccccaccatagaacatagtaccatatccgctttgttctatgacagcaccaccaatcaacggtcccactgcgcgaccaacagatggggcggcagccgtcatcccctgataacgccccttcaactctattggcgataactcattaactaatgctggaatcattgggaaggccgttgcttcaccaatggttgtcacaaccattgcaatcgcaaagccagtaaacgtctttgcaaacggcaaaatcataaaggcaaggccaaacataatcagcccggcataaatttgaatgaacattgatttacggtttgccgataagttcaaggcattcattcccaattgaataattgcaatcaaaataccattgatggtccacagcattgaatactgccaaaccggcagtttcaggatactcgacatgtaaattgacagatttccctgccactgcgaataagaaatccacaaaacacctaacccaataacacctgtgtaaattaagcggacattccactttggcaagcgcagggtttgtttttgctcagtttgttgggtgcgtgccaccttaattttgaaggtaaactgtacaattgccattagtactaaatacatgacgagcgccaaccagaatagccaggtaataccaaaattataaattggcccaactgcagcggtcgcaaacaccatcccaaaattactaataaagtacaacatattgaagacaaaacggccatcatgactccgtacatatgtcccgtaagaattaatcgttgccgtattccaaccaccgaagaaaccggctaacgtcaaaataacggcataacttggccagccatggaagaagatgaagagcaaattaatgaaaatcatcatcagcgtaccgaactgcatcaatttacggggttcaaatcggtcaaacaatcggccacttactagtgaaccaaccgcctggccaatcgcgttagccatcatgacccaaccgataacaaccaaggtctgatacagttggtcatgtagataaattgaagttaagggccagataaatccataagccacgttattaataaaacttgccgttaataaccagcgaagtgacatgccggcttgttgtgtttgcatgataactgtatctccttttttccaaaaataagaacgaggttaccaagttggtaaccccgttaataaccgatattgtttaaccgaatccgcccggttcttcagcgtggaactcaatgtttgagaacttattgtatgacttaacaaacaataagcgtgccgttccacgcgcaccagaacggttcttttccaagataacttcaatttctcccacgtcctgttgttcttcatcgcgcgggtcattggggttatctgaatcatcgttggccttctcatagtagtcttcacggtacaagaaagcaacgatgtcggcgtcctgctcaattgatccagattcacggatatctgacagcattgggcgcttatcttgacgctgttccacactacgtgacaactgcgatagcgcaataatcggcacatccatctccatcgccatcatcttgatggcacgtgaaatggctgacacttcttgctgacgaccttcactacccgttccttcaatcaactgcaagtaatcaataatgaccaatcccagcttaccttcacgcttatacagacggcgtaactttgaacgaatttctgttaccttaattccagccgtatcatcgatatagatttttgtattcgccaacgatcccatcgcgaccgccaacgcattccattcttcagaatcaagttgaccagtacgcatatgctgtgaattaatatttccttcagccgccagcatacggttaaccagtgacgtatccggcatttccagtgagaacacaacaactggtaaatccggatcagccacagccaccttctgagcaatgttcaagacgaacgcggtcttaccaacggcaggacgcgcagccacgataatcatttcgccgccgtgaaaaccagttgttagattatccaaagccggatagcctgacgccaatccggtcacagtttctgtcgtgcgtgagttttgctcaatttgttcaaatgacttctcaaccacgtccgcgatattcttaaaatcggcgctcttttcgccaccgttaatcatatccaacttggttgataattcggcaaccgcgtcgtcgaccgaatcagcgccttcatacgtttgcgtcaaactgctttgcaacgtatcgatcatattgcgacgaattgacttctcacggacaattcgggcgtagtacaatgcattaccagcaaccggcaccgtcgaggccagttccgccaaataggccattccaccaacgttttcaacttgattatctttattcaattcatcgacaattgtcaatatatcgattgcacgctgcgattcatcaagcttcaaaattgccgcataaatcaaacgatgggccgtgcgatagaaatcagacggttccaaaatcgtcatcaaatcagcaattaaatcttgcggatccgtcgacaataaaattgatcccaaaactgcctgttcagctgtgatatcttgcggcacgctcaacgcgacagtttctgtttcatctgccatggaatgacctccttttattttttaatcagtactaactattgtaacagatatcgccatatctatccgcgttaacatcaagaaaaaagcaccaaggccgtttagcccagtgcttttacatgtttcttacaattcgccggtgtggatacgaatcttggcttcaacgtcgtggtgcaacttcaccgtcacgttacggtagcccaaggcacgaattggttccttcatatccatcttacgcttatcgattttcaaaccgaattggtcgttcaaagcttcaacaacttgctttgatgagatggccccaaacaagcgaccgtcagttccggcctttgccttcaactcaactaccgtcttatcatcttccaacttcatcttcaatgcttcagcagcagccttttcttcagctgcttcacgatcagcggccttcttttggccacgcatcgctgacacattcgcatttgttgctggttcagccttcttgtttttaatcaaaaagttgttcgcgtagccatcaggcacttctttaacttcgcccttcttaccgcgacccttaacatcttctaagaaaataaccttcatgattatcgacctctactttattaattttcttctgcttcactatcatctgatgcttcaagtatcgacaatagttggctgtaaacatcgtttgttgcgacgtctgcaacctgggtagctgcgttacttaagtgaccgccaccacccattgcttccattactaattgtacattaactgacccggttgagcgcgctgaaacggcaaccattttatcatcgcgtcgcgtaatgacgtatgatgactcaataccaatcatctgcaataatgcgtcagccgcttgagctgccaccaccgaatcatattgtacatcattctcaccgacaacaatcgccgcggtgtcatgaatctctgcccgttcaatcaagtgggcccgcttgcggtacgatgaaacagtttccttcataaagtcttgtaacatcttaccatcagcccccaccgaacgtaggtaactagccgcgtcaaacgtacgcgtacctgaacgaagggtaaaggactttgtatccacttgaatacccgccaacatagctgttgattcaatcttcgacaagccctttgcccgacgaggctggtactcaaacaactctgtcactaattctgacgttgatgatgcatatgattcgatgtaaaccaattgtggctcttcagggaattcttcgccccgtcggtggtgatcaataatcaccactcgcccggccaaatgattgtacacatcacgcgattccgaaatcgatggcttcgagtggtccaccatcaccagcaaactgcgctcagtcgcttcagtaattacttggcttggcgtcatcatcgccgtctcatcagcagggtcatgctttagttcatgcaacaacagctgaatatccgagtgctcatgcccggtttcttcgtacacaacccaggctggcttgcctagcatctgggccaaacgacgcacacccaaagccgccccaaacgagtccatatcagaccgtttgtgacccatgataaagatttgatctgcttgcgtcatcaaatccgccaacgcctgagaaatcacacgcgctcgaacacgcgtacgcttagccattggattagtattaccaccatagaagcgggcatcccccgtcggtgacttgaccacaacctgatcaccaccacggcctaatgccaagtccaaattagcttgggcattttcggccagcacactaatggcctcttctttataggcaattccaatactcaacgtaattggtgcgttttgcattgacgtcgcttcacggactgtcgtcaggacattaaacttatctgactctgcagctcgtaggccactacggtaaccaatcaacatataacgatcaaccgctaaacgacgtacatatatcgcatggtcagccatccaatctgaaagggtcttcgttacgaatgtacgcaacgctgacgcatctgaatcgctcatgccttcagtcacttcatcataattatccagcgacacaattcccacgaaaagacggtgcgcttcataatctgatgataattgcacggaagccgtcgcatcaagcaaatagactgcccgtaattcaggttgaacttgcacatcaaaagtgcggtctaaccaagttaggcgggttacccgcttatcttcatcaggccaacgcttaattacatcggcaagcttggttgaaacatctgttagcgtgcgaccaacaataatttcttccccaagataactctgcagatatggattaacccaatcaatctcggcttgttcattaaacaaaatcaccccaagtggcatttgaataatggcttcttgttcaccacgattaactcggtatgacaaattttcaatataatgcgcggtatcttccccaataatttgcaacgttttaaagatgacgattaaggcaaaaactaccagccctaaccagactaatccaattagccaattgaccatgaaccctaaaatcgcgcccatcaatgccatcaatgaaactaagacggcaacccaagcaaggcgccgattttgaaagaatgccggcaaagcatccaactttttcacgtgattcacctaacctaactccgtttaatttaatactttcttaagtataccatgaacgaccatatgacttataccgctattcaatgagttttctatgtttaattgatggataagaaaaacgattcgatgctcgccgtcatcgaatcgttttgctagttaatcgatcaagccagcctcacgggcacgctcttgatacatttgaatttcattttccgccgcccagacaaagtggtcaggtgcgatttcaaccatcgtacgatcgcgaccatccatctcatcagttgggtcatacacaattggctcacgggccgtttcaactgatggatctggtactgggattgcactcaacaacgagcgcgtgtaatcgtgcaacggttggttataaacctcatccgctggtccgatttcaaccatctttccccagtgcatcaccccaatacggtctgagatgtacttcaccatcgacaagtcgtgggcaatgaataggtatgttaagcccttatccttttgcagttgcttcatcaagttaacaacttgtgcctggatagaaacgtccaacgccgaaatcggttcgtcagcaataataaacttaggttgcactgccaaagcacgtgcgataccgatacgttgccgttggccacctgagaattcgtgtgggtatcggtttgagtggtcacggttcaagccaacgatttcaagcaagtcttcaactcgttgtgagcgttccgcatccgacttagccaaatgattcacatcaattccttcagcaacaatatccttaaccttcatacggagattcaatgatgcttgtggatcttggaaaatcatttgcacgttttgccggaagtttgacaagtcactcttctttttcaacttcgcaatatcttgcccgtcgaacaatacctcaccggcagatggatcatacaacttcataatcgtacgtccaattgtcgtcttacctgaacctgactcaccgaccaagccaaacgtttcaccttcataaatatcaaaagtggcattttgaacggctttcgtctcattactacggcccttgttaaaagtgatatcaagtcctttgatttcaactaacttcttctttgcttcagccattagttgttgtcctccgttccaagaactgccgttgcgtcgacggcgactgcctgcttacggtcagcctctgggtgtgccgcttgataacgggcccaacgcttttgtacttccaatggtggcacaacttctggtgctcgttcatccaacaaccacgttgccgcaaagtgtgttggtgacaattggaagaatggtggcttctgctcttcatcgattgccaaagcatgcttgttacgtgccgcaaacggatcaccaacaggtggctccaacaaatctggtggcgtaccaggaatggcttccaattcaccacgttccgtctctgtcgttggcattgaatttagcaagccccatgtatatgggtgttgtgggaagttaaacacttcatccactgtaccaatttcaataatctgacccgcatacataactgcaacacggtcagccattccagccacaacacccaaatcgtgggtgatgaagatgattgaagaattgatttccttttgaaccttcttcatcaagtccaagatttgtgcttgaattgtcacgtccaacgcggttgttggttcgtcggcaatcaacacttctggtcggttaatcatcgcaatcgcaatcacgatacgttgacgcataccacctgagaattggtgtggataatcattgatgtgcgcttcggcatttggaataccaactagcttcatcatttccaacgccttgccccaagcttccttcttgctcatcttcttgtgcttgatgagcggctcagcaatttgttggccaatcttcatcgttgggtccaatgatgtcattgggtcttggaagatcatcgcaatttcagccccacgcaacttttgcatttggtcttctgacttaccgataatttcatcgccacggaacttaattgaaccgtgctccacttccgcattcttggccaacaagcccattagtgaacgtgtcgtgacagacttacctgacccagactcaccaacgatagccaatgtttcacccttgtacaaatcaaatgaaatgtcgcggatggcttgcaccttaccgttgtaagtcctgaaattaatttttaggtcttcaacctcaagaattttttctgccatttgctaactctctttcattaatcctttgtacgaggatcaaaggcatcacgtaatccatcacccaacaagttaaaggcaatcataataaccgccaaaattaccgctggaataaccaattgatatggatagaattgtagcgccttttgaccatcgttaagcaacgttcccaaagatgccattggcactggaattcccaacccaataaatgacaagagggcctcgaagaagattgctgatggaatcgtgaacatcaattgcacgataatggttgaactcaaatttggcaccaagtgacgcaaaccgatacgccatgctgacgatcccagtgtacgggcagccaagatgtaatcttgctctttaatcgtcaacacctgcgctcgaatcaaacgcgccatcgatgtccaagatgtcatggcaattcccaaagcaattgagaacatacctggcttcaaaatcaaaatcaataagacgaacacaaccaggttcggaattgatgagatgatttcgatgattcgttgcatcacaacgtcggtcttaccaccgcgccagccggaaatgattccgtatgtcacaccgaagaccaagtccattgcagccgcaatcaacgccacttgcaatgagatacgcgtaccgtacaacacacgcttgaagatatcacgaccaaattggtcagttccaaaccagaagttcttcttctttgaaacacccgctgagtcatatgaatcaatcttcacaccatctaactttgcgtgtcccgtaaatcctggaatatcacccaaaacacctggcaaacgtggtggtaggttttgcaatgtcacatcttggtgtgatgtagcttttgaatttgcaattggtgttgaaccaaaagcaacgacgaacacagcaaccagtacccacaatgagataaaggcacccttgttcttctttagtcgacgccaagcgtcttttgcgaagctcaatgaaggcttcataattttttcgttatcaacatgacgatcagctgggagcagcttaaaatcatctgccgtcaaatttacttgttcagccatgcgcttctccttacttagccaaacggatacgtggatcaatcaatccatacaagatatccgtaatcaacaacacaaccatcaacatcatggcgtagacgattgttgttcccataatgatttgataatcattcgtcaagattgaactaacgaattgactaccaattccagggattgaaaagatttgctcgataacgattgaacccgtcatcaagttaactgccatcggaccaatcaacgttaccaacggaatcaatgaattacgcattgcgtgcttccaaataatttcacgttttgacaatcccttggcacgtgccaattcaatgtaatcagatcccaagacatcgaccatttcagttcgaatgaatcgcgctgacacagccaatgggctcatccccaaagcaattgttggcaaaatagttgatgcaaagcccttccaaccggcgattggcaaccaacccaacttcaagccaatccagtattggagcaatgcagcgaaaacgaatgatggaattgaaattcccaagacggccaagattgacaacgccgtatccgtctttgtgttacgacgtaccgccgcagctgaacccaaaccgattccggcaatcacaccgaaaatcaaagcttggatacccaattgtgctgaaggtcccatacgttgtgcaatcaacgttgaaacttcttggttagcaaattggaatgagaccccaaagtcgaagtgcaaggcatcccacaagtatgtgacgtattgaatgaagattggcttatccaagccgtattgtgcttcaatcaactttcgttgcgcttcagacaagcgctcggcgttagccaatggtgatcctggcatcaacttcatcaagaaaaatgtcgctgagataaccagcaccagcgtcagcaagatgattgctagacgctttagaatatatttgatcatagcgatgaccttcccctactattttgctttctacttctaatatgaaagaatcgtgttgcttatgagatataagcgtttggtttcttacaaaacttgtagcttttattagacttttatcattttaacagagatatctacaatgtaaaaggctttgttagctaatatcacatgagactctcattttcttaataattttgaagttatttgcgtttacatactttcgatatcacaaaaacattcattctttgttttgaacggggaatgtggtgtgatgcggtgtcgtcgcgttgcgacgaggcatggtgggtggggtgcgacttcgccaaagattggctggggtaaactccgccggcgcgagcaccggctagtgcccaaataattgtgcgaagagccagggtccgtaacgtcttgtctaaccggcggtcggccgaacttgtgagttcaccccagccaatcactacgtcacaccccacccaccatgccagcagccaaaatattctctgtttgtttgatagccatcgttaaaatcaataatcttaatgatgatttacccctattatttagtaacactttgacacttctatacatcagagaacttcttggtttctacaacagaactgacgggtgtacaaatcattaaaaatcagcaatatgccctatatattcacaaaaacttagagactcacagtcggacgaaaaacatcgacagatcaaccatattttcccgttgaatatcttcctatcattcgattattaacttttgaattaaccttaatttcacgatgctagttgtcagatttttctttggcactctgtgaaaatcgaatacggcagtactttcatagctgctggcgtgggtgtgggggattggcgtagcgatgacagtggggaactcacaagttcggccgaccgccggttagataaggcgaacggacccagacccttagcacaattagttgggtgctagccggtgctcgcgccggcggagtttcccagctgtcatctttgtcggagccaatcccccacacccacgcctcgtgcgctagcaagacaccaccaaacactaaaagaaatcacatcgcagcaaatgctccgatgtgatttctaaaagatttagttcttgtatgcccacttccagtcgtatggtgcaccagctgggtttgtgacaacacccttaactgatgtacggaacaacgttgcatatgaacggtagtacaatggcgccacaccgacttccttgtcgatgatttgctctgcttgcttgtaatcgtcataacgcttcttttcgtcgttcacgtcagtcgtcttagcagctgacatcaacttgttgtattcagcgttatcccatgaaccgttgttgaatgaagaatccttcgtgtacaagtccaagaacgttgatggatcaccataatcggcaccccaagcagtgattaccaaatcaaacttcttgtcttgtgacaaagccaaacgttgcttaaatggtacgaccttaacgtcgatatccaagccgtccaacttttccatttgtgattgcaagaattgggctgaacgcttagctgcatcagtgtcatctgtgaccatttgcaacttcaacttcttctcgccgacttccttcataccttccttgaacaacttcttggccttagtcttgtcgtaagcaatggcaccctttacttcagctgccttagcaaagtccttaccagtattaggatcttgcgccaacttagttgaagtaaacgttgtcgcaggtgtagccgttcccgtcaaaatcttatctgacaacgtcttacggtcaattgcgtatgacaacgcttgacggatctttgtgttggccaatgccttcaccttcttctcgttaaactccatgtagaacgttgacgcttgtgggataaccttataagccttgttcttctttgaagccttcacttggtcaggtgacaagttcgtaaagtcgaccttgcctgacttgtacaagttgtaacctgtgttttgatccttgattgtttccacaacaaccttaggcgtcttcacaaccttggcatcatagtacttgtcgttcttaaccaatgagtacttgttgtttgacccagtccagcccttcaagatgaatggacctgaagacaacgtgtactttgcagctgtaccgtacttcttacctgacttctccacaaacttttggttttgtgggtagaaaggtgccatcgtcaaaactgattcaagttgtggcattggcttttccaacgtcacttccaacgttgtatcgtcaacggcgttaacccccaacgttgacaagtccttttcttcaccagattgaatggcacctgcattcttaattcctgagaacaagtaggcatattgtgatgccgtcttagggtcattcgtacgttgccaaccataaacaaaatcgtgcgctgtcaaagcgtcaccgtttgaccacttcaaaccagaacgcaacttgaacgtgtatgacaacccatcatcagacttctcaactgattcagccaaagcaagcgcaggcttgtttgacttgtcgttacggtacaaaccgtcaccagttgcttgcaatgcgtcaaaatcaaccgcagccgtagactttgatggatccatcgtgcccaaatcagccccttcagtccagttgattgtcttgtacttagctgcgtcagccgtgattggtgccaacgttgagcccaaaatcaacgctgtcgacaacaatgctgatgtcttcaataccttattcataaaaaactccccatttcgaaaatagtaaataatgcctttcaatgtttagtatcatagcctggacaaaaatgagaagcaacgccattttttaatacaaactgtgaactaaatttgaacacgatccattaaaacgtttaaaccatgcgtttttactacgtttcttaaaatgagagtttcactcattttcagacgatacagccagaaaaaattatcatattcgccgtcatttttgtattctcagttagatgtaccactttgatactcaaaaataatcgagaacagtttggctgctacaataggctcggatcgcatccggagcgttcaaaaatcggcaacatgccgcatggccggcgctattcagaaaagtccgcacagaccttgaaggttttagggggaattatttgccccgctgaatggcgtccgcgccattcggttgccgagtttttgaacaaaggcgtaggatgcgagtcgagcctattgtccgtgcgatagcacgacacacaccaacccaacaaaaaaacaccagcacaaaagtactggtggtttagtcagtttaaattaagctgccattcgacggtccaaaatacgaccaatctttgaaatcacgtaattcaacgcgaagtacaatacagccaacgcaaagaacatcgccacaatggcatttggctcttgcgcataaatgatttgtgcacggtatgtcacttctggcaacatgataatcgttgccaaagacgtatccttaatcaatgacacaaattgtgacacgattggtggaatcatcttcttgtaagcctgtggcaaaataatgtgccacaaggcttgcttgaagctcaatccgttcgacaaagcaccttctaattgtccctttggtacggcgacaattcctgatcgaataacttctgccaacatcgctgactcaaaaatcgtcaaagcaaaaatcgttgacgtcataacgcccaagtgaatgccaatctttggcaaggcaaagtacgtaaagaagataatcaacaacagtggtaggttacgaatcacgtcaatgataaaaccaacaatccgtgataggtatggaatcttgacgtaacggataacaccaagcaatgaaccaataataaaactcaaaatgactgagacaaccgctacttcgatagtgacccatagtcccatcaacaagaagcggatgttaatccatgagaacgccgataagaattctgccatgattatccctccttattcaacttgttttccaagtagcgcatgtagtaactcattggcatcgtcaaaatcaaatagaagatagccacgatgataaatggaccaaacgtatcaaatgtctcttgcgaaatcatatttgcttggtacatcaaatccataccggccacgaaagccaatactgatgagttcttaatcaaattaataaattggtttccaagtggtggaataactagcttaaacgcctgtggcaataccacgtaacgcattccttgccaccaagataatccattggaaagcgcaccctccaattgaccatttggcacagcattaattccggcgcgcacggtctcagcaataaaggctgacgtatatagcgttaggcccaacgttccagccgcgaacccactaatttttacaacgttcgcaatcaccacatagaagaacatcgtaataaccaacaatggaatattacgaagcacttcaatataaatacgcccaataatattggccgccttatttggcacaacttccatcaaagcaaaaacagttcctagaatcagtgaaccaatcaacgccaatactgacgaagcgatcgtccaaccaaatccagttaggaagtcatgagcgtgtgtttgaaataatgacaacattacttagccaactccttccaatccattcccttaacaccagcgaaccacttcttggctagcttggcgtaagtaccgtctgatttgatatcatcaatcgccttattaacagccttgactaacttagggttgttttcatccatagcaacgccatatggttccttagtaaagggaccaccgacaacttccaaactcttcgagccggcagccataccatataagataccgttatcagtcgtcaatgcatctccttgaccagcctttagcgctgttaaagcagttgcataatcagacaaagcaacaaccttagccttaggcgcgaacttcttaacaaccaccgctgaagtcgaaccagcaacggccaaaatacgagctcctggcttgttcaaatcgtaaatatccttaatgccactacccttcttaaccaagatagcttgccccgcattaaagtaaggctttgaaaaatcaacaaccttctcacgatccggtgtaattgacattgtggcaataatcgcatcgatattaccgttcaacaacatcggaatacgtgttccagatgtgatttgcgtcaattcaacctttgctttgggattaacacgcttcgtaatttgcttcgccatatcaacgtcgaagccttccaacttaccagtcttgatattcatcaagcccattaacttcgtatcacccttaacaccccagaccatcttgtctgacttcatgatacgattgtaagcttcgtttttcttatcgctggcatgcactggggttgcaaccacactccctgctagcaaagcgacggcggcaccagcaagtaccgcacgccaagtacgcttaaacttgcgactcatactccgcacctcctagtgaatgatttgtgacaagaattgacgtgcacgtggctccttaggatttgcaaagaattcttcagtaggagaatcttccaaaatttgaccatctgccataaaaataacacgatcggcaacttgcttagcaaagcccatttcgtgtgtcacaaccagcattgtcatacttgaatccgccgcgatttcgcgcataatcttcaagacatcgttaaccatttctgggtccaaagctgacgttggctcatcaaacaacaaggccttaggcttcattgccaatgaacgtgcaatcgcaatacgttgttgttgtccacctgaaagcgttgacggcatcttgtcagccttgtcagcaagaccaactcgctccaacaattccattgcaatcttcttattttcagcttcgtcacgcttcaagaccaaacgtggtgccaacataatgttttccaaaaccgtcttgtttgcatacaagttaaagtgttggaaaaccatgccaacattcttacgcgtacggttcatatcagtttgtgggttagccaagtcttgaccgttaacaattaattggccttcttgaacaggctccaaaccatttacggtgcgaatcaacgttgattttcctgaaccagatgggccaagcaaaacgaccgtttcaccagcttccacgtcaaggttaatatccttcaaagcatggaaatctccatagtacttttcgacgtccttaaattcgatcatcgacataatggtgttcctccttattgacaattttctcaaaaatcatcattcaatataaaatgacccgtcgcgatttttcgtgacgggtcgctatgtttaataatagtctgtaagtaagactggtgtcaattatcttgtcaggtttcttgacaatcacctaaccggcttacttttgcttataagctagctcaacggctaactgataaggcttcgttgtttcttgtaggttcacgcgaccacgtacatggccaacgccacccgtaattaccgccgatgcgataaacaaatcatagttctcaagggccaactcaactggctgcaacccaaccgttttaatccgggcaacacgctgcgcaaacatctcgttcaagccaccgtaaaccgccaagccaccacgctcatgttccaagcggaagtatggcaatggtgtacccggatgattagcataaatgacatcgttaccagctgccaaataggctaactgatcgacttccgacatgccgttataatcttgttggaacatcccactagcttgtagttgctcggcaactttcgttaattctgcttgcatatcagcgtcagaaattgccgttgctggtaacacattttccttggcgtataatccgtttgctggtacataaggcattgctgttttggcagtctgactttcctcagcaggccggccacccaaaaccttttcaatctttggcgaaatatcccacttcaccgttttcttcgtatagtagtacaccatattcagaaccgcaaaataggcaatcacgatgaaggctagcatcaatactgccccacgaaggtaggccccattttcaatatgctttacgcccaagtacaggacataaaaatctcctgccgtagccaaaactgaatatacttgccctttccacttggtattaacattaaagaaccccaagtagtgatttaacaaatctaaaatagtcagcattagtttgttgcacctccgttcgctgtcgatggtgttgttgctggcgcagttgaactagccgtcgatgaactcgttgcgcttgaggccggggcacttgaagcactcgacgtgacggcacttgaactgcttgccggacgactcgtctcgctcgacgaacttacccgactatcagtcgtatctttatttgtcgataccgtacttgctgatgacgactcctcttgtttacgagacgactctgttgtggcagacgagtctgtctgactatcactgacgacccgactcgtcgatgtttcagcagtgtcagcggacttactctcttcagacttagctggcgcacttgttgatgtcgatgatgacacaatgcttgaagaaatttttgccccattcgatgtattcgttgaaacattaacaattgcgttagctgcactcaacgccaaaataattgaaactagtgcaaccggcgtgataacgggtggtgttcgatatgccataatgttcctcctaccgtggccaattattcttggacaacttgcttaacaatttgattgatttcttctttggtggtttcccaatcgtcattaatcacgacatgggcaacgccgcgtaacgcatcaggtaatgccgcatcgcgttgatattcttgactagccaaccgctccttaaccgcagtcacatcatccccacgcttttctaaacgcgttaacaaatcattttcttcgctaacagtgagataaataataaccgcttcatcgcccaattcttgcgcatatgtaatcgcgccggccgtatccaacacgatggtaatgaatggattcttctcccatgctcgggctaagccttcatgggatgacccatagtgataatttgaatacgtcacactctctaagtaatgattttgtttaaaactcgcttcagtttcaaaatagtaatcaacttgatcaacttcaccttcgcgtggtgctcgcgtggtgtgcgtaataacttttggcatttcaaagaattcattgaggtaatttgcaacagtggttttgccagtaccggtatttccagttagcacaaatactttacgattcatgggttttaacgactctctttaaacttaattatttccattataaaaccccgaacttaagttggcttaagttcggggtaaaacgttaatattccttaccgattgggagacgcatcacccgcccaatcatcatcgccaaaacgacgacaatgaccactttgattaaagtcggaatgatgaaggccaccaatcctgttgccatcgcattcgccaatggcatcttagccgctactgcaagccaaaccgtgccgaatcccaactgcaaaaacgctgcaattaggttccaggcggtcaacgcataccacttggcactcaacttaataccccacccaataataagtgggaacaagagcatcccaatcaggtagccacccgttggcccgataatgataccgacaccagaagtccatcctgcaaatacaggcatcccgaccaccccgagcaataagtaaaccgccacggccgataacgaaatcggtagcaatgtaaccgaagcaactaacggtacgatcatcgtttgtagggttaacggcacaatccccgttggaattgacaaaggtgccaataccgcaatcattgctgcaaagacggcggctagtaccagctgtcgtgttttcatgaaatagtccatcctgtcatatttaatttcgtgatttcaccagaatagaaagtttgttggccagtatccgtttgcacaaacaagccaccatcatccagcacatcttgaacacgcccctggatggtttgtttgccaacaaccaactcaacctgttgaccaattacgagtgataatttgcgatagtcgcgcatcacatcacgggcatctaacgaaaaatagcgaacaaaataatttaatagcgatgccaccagctgttcccgatcaacttgttgatcagttaacgcgccggcctttgcctggatgtcaaccggataatcggttgggttaatattcaaaccgatgccaataatcaaatgattgccgactgattcaactaaaatgccggccacttttttatgctgatagtacaaatcgttgacccacttaatgccaacttgcacacccaattcaactgacaatgcggtggctgctgccacagctacacttgttgtcacctgacccggattgagcgttcgactatcagccactggccaaatcaaagttagataaacaccaacttgatctggcgaaaaatactgtcggccatgccgaccgtaccctgccgtttgttcgtctgccacaattgccactggcgtcttcaactgtgtattcccaatcaaccgttttgcggcagtattggttgaatcaatcgtggcataacttgtaattgtcactggacttaaggttgtcaatcgtaattgatccatggtccatccctccaaactttctaatccccatcatcacagttagtcatggcgttctctaccagcataaccaactgttcctatcataccatgtacacacaccagtcaggttacccgctttaacgcaaaaggactagcccagaaatctctgcactagtccttttgcgttaattattctaatgaggcttgcttttcataaaagcgaacccgatcgacaatcggttgcactaattgacgataacgactcactaaatcgatttgatttgtggtcgtttcctctaattctttcacatgttcttccgcaatcgcgcgaccaatctttttaatccaccaaaccgatagtcgatgccaacgtcccattttgtcatggtttgtcgcaccccgtagttgaaagaaatcaccatactgttggacaaggtaattaaaattatcgacacaaatgtgtttgaaataagtcgcatcaatcggatggaggccaaccgtgaacaataaaatatgtttatcatacagcgccggaatcagcgtatttactagattagcaattttaacgcggccatgaaatactggaccaccaaaaacgatcgtatcgtaagttgttaaatccaacgcgccgatttcatcaagtcgatacaaactaatctgcaactcatttgcaatccagcgggcatatttttcagtatgcccgtagtgactgtcataaatcacaaccgcactcattcacgtgtcctccccatctatctttctgccactatcatacaagttgtaagttgatgacgtgtgcaaaagtttcgaagatagtgtgaagtccgacaaaaatcattacttattcaataagcccttgaaaaagttaacaattggattccaaatattcgttacaaaccaattagcggcttgcttaacatcctctgaattcgcaaaatccttcgccttagccatcgcatccccagctgagttttcaagcttatttgataggctcttagcattatcgacgaagctagatgagtcagaaattggggcgtccgcaacgcctaccaatgcttgcgccatcgtttgtaccgccgcgtcggacgtcttttcggcaataccttgcttatccaagttaatgtttaattgatcaattgcaatattaattgtaatgttttgtccgtcttgctttttctcagccagttcactagctgtgttcgttactgctgacgtcagcttaccagggtaggccttatcgtctttgttatcattcacggcatccgtcgtagcggctagcatgttattagctgccgacgtattttgttcgttcagcgtgataccatccgtatccaaagccttataaacaccagccaaggctgcttgcccagaaacttgttggtttgctgttaccgtaataatcacatcttttacaccagccatcgtagctgccatcgcatactgttgtgaggttacttgcgtaatattatccttaccatcgaagttcttaatgtttaccagcgtccccgtaccaggttcagccggtgcaatggcaacagaactaatcatcgcactatctgccacgcccgaaagtccaatgtatgatgcgtcggcacccgttgttgttaatttttcatagctgtctgtcactcccagcgttgtcgcaagggcactttgatctgaggccccagccccatacacaacatacgactttgataaggcccgtgtttgcacgttagttgttgccgctgcttgcacagcgttcggttgcaccaggacggtcgccgtcactgttgttgcccccagcaaagccgttgctagcaacgtcgtcgttataattttcttagtttgcatcgttatttcctccgataccatcgttttcattgtcacataattgtaacatatcgcgccttaaacagaacttcaaaacgcaacgcgcttagtttgtgaatttattgtgaacagtttgcacgaagtttgtgtattccgctcacaaacaaggaagaaaagagtactattataaggtaatatctcgtttagaaagtgaggcaattgtgacatggcgattcaaaaatcaagtttgctaacagcaacccttctattggctagcgtcttatttgctagccctgtgttagctgatgacacgacaaccgcagcatcatcagcaacaaccatcagtgtcgttagcgacaatactacagatcctgcgacaagcacggcaacgatagatgaatcaacagcagccacgccaattgttttaccagcatcagccaagtctgaagaagaaaccagcacggccagtgaaacaaccgctacgccagaaacgttagaggcgtgcgtaccaaacacaccggtcgtattacctgaagaaacaattactgattttgtaccacccgttaccgaaacgccagttgaaagcaacccttctgatagtaacaaggctagcgaagtcgtttcgtcagaatcagttgggcaagcaacaacaccaactgaaaccgacttggctaataaggtcacaacttcagaaacaccggtccaacccattactgaccagtccgttacacaaacgcaaaaggtcacgactagcaaaacgtctgacgcacggactgcgacaacgcaacgaacggcaagtgccactacaccgcgtacttcagtcaccgcaccaacgacggtcacaactagtcaagctacaaatcaacaggttaccgctgttaacagcagtgatgcacaacccgcacagccggttgcgctgaccacagcagttgcgcaagaaccaaccaatgttgatccaacaacaagtcaaacggcacaagcggtggctagttcaacagttaaagcagctgttacaactgccacaacgcatgaagcagccacccttggcacaccgtcagaaagccaagctaataccgttgcgcaagagccaaccacagcagccacggcaattcatgaagtggctgtccgcgctggccaaatggcagatgacatgctaccacctggtgcttaccaaatgaattggggcccggtcgctatcaccacattctcagttgctttggcttcttggattattgcttactacacaattcgccgacgccaagccgaccgtgaacgtgatattcttagtcactaatgttgaataactaataaaaaccgcaatgatttatcgtcattgcggtttttatgatcattattaatcttccacgttagccaattcgtacattgattgtccgaaaatagccatcgcacgtgtcaaatctgatactgggtagaattcgtcggcttggtgcatcgtgtcaggcacgccttcaaacattgctccaaaggcaacaccacgcttcaacaaacgtccaaacgtaccaccaccgataacttgttcaccggctggcaaacctgtttgctcacggtaaacttgcaacaacgtcttaactagtggatcatcaccaggtacgtagtgaggcacttgtgcgtgaccttcttgcttagccgttgcatcaaagccagctggcaatgatgatgctacgtgaccttcaatttcttcagccgttgtgttttgtgggtaacggaagttagcatttacaaagccatcttcaccatcagtaaagcgttggataccaacgttcattgacaagtcgtgcatcaaatcgtcgtgcgtcttcgcaccgatcttctcagcaaccgtgtcatcgtgcaattgcgttcccaagaacgtcaagaagcccttagcgttaccgccaaagtcttggtcttgcaagaagttagccaagtaagtaccggcgttttcaccagtttcaggcatcgcaccgtgaacttgctttccatagaaagtaaacgttacttggttaccatcaaccttagcttcacccttaacacgcttttcagcggccaaataagcatccatagctgaaaccaaagcagccgtatctgcagcctcaacaacggcaacagcagttccaggtaccatgtttggacgtgaaccagctgagaatgaaaccaacttcaatgaaccaccttgcgtaccagcaaagcgcgttacgattgaaacgttacccttctcaccgttgataattgggaactcagcgtcaggtgagaatcccatcgttggcataccatactcctcaaagaagtcatccataccagtccagtcagactcttcatcaattcccatcaccaaaactagcttgcgcttcaagtccaagttcaagtccttgatcatcttcattgcgtagtaagccgtaaatgaaggtcccttgtcgtctgatgcaccacgcgcatacaaacggccgtcttcgataactggtgaccatggattctttgtccaaccgtcaccagctggcataacatccaagtgaccaataatggcaactgtttcgtcagcgtcttcaggtcccaattctgcataggcaaccaagttcttgtagttaccaacacggaaaccgtcacgctttgcaaattcttcgaacttaagcaaagcttccttaggacctggtcccaaaggtgcgtcctcagtcgctgcctcatcatcacgaactgacttgatggccaacatttccttcaagtcagtcaacaatgcatcttcatacttcaatgcttctgcacgccattgcgttgtcatatctcattgacctccactgtcatattggttgtaattatacgccattttgcaaatctttgcagaatttaatcatgatttgcctggttaacttcccttttaacagtcttattttcatcatagaacagctaaaatgtgaacgcttacagaacgctttgtaaattccggctttttcgcattttttagtgatattatgagcatgcattaagcaattacatttctatattttgaggggtttgttcttatggatgcaaatacgcaatctgttaaaaaggacgaatttgctaagttgacattaatggaccgtattgcctatggtttgggtgactttgcccaaaacttggttttcggtactgttggtggattcttgctattcttcctgacaactgttaacggtatttcagctgcggctggtgccactattttcttggtcgttcgttggatcaacgttgtgtgggatccttgggttggtgccacagtcgataaagcacatcctaagggtggtaagtacttgccataccttcgtaacttcggtattccgctagttatcttggctgcctgcttgttcttgccagttggtcaatggttccctgctttcaaggtgccatatgccttcttgtcatatatggcaacagccatggtttactcattcgttaacattccatacggtgccttgaacgcatcattgacacgtgataacgatgaaattgcaaagttgacaacggttcgtatgacgttggctaacatcgcaaacttgttggtttacacatgcttccctatcttcgtgcaattggcaacatcagttgaccgttcatcaaaggatatcggaatgtttggtatccacatgaacttgggtgactactcatcagcacaatctgctggtgcttggttcaaggtttacgccgtctacatggtcatcggattcatcgctttgatggtaacgtatgctaagactaaggaacgtgtcttgcctgctgaagatgagcctgaagtaaagtactcagacttgtttgctgaattgaagcgtaacaagcctttgcgaatcttggggttgttcttcttggtcggctttacatttatgttcttcggaaacacagtatggccattcttcttgcaatacaacattggccactcagaatggaacggttcaatctcattgcttggatcaattcctggaatcttcttggtcttcctttggcctaagattcgtgccaaggttggtaagaagcaattctttgctttgttcctggctatcttcatggtcggatcaattgtcttgtggatttggacgaagtcacctgaaaacattgctttgggttacatcggacgtttcttgcaacaatggggattgacttcagccactggattcatgtggtcattggttcctgaagttgtctcatacggtgaatacacttctggtaagcgtgttgctggtatcatcaacgccatcatgggcttgttcttcaagattggtttggctttgggtggtatcattcctggttacatcaatgccgctactggcttcgatggtactaagaaggttcaatctgctgctgccttgatgggattgcaatggtcaatgatctggttgccaattatcatggctgtgcttgccatcttggtcatcatgaagtacccattgactgacgaagaagttaacaagatgaaccacgaaattgaggctcgtcacaagtaatttcaattagttaatcaaaaataccgccactcaattgcgagtgacggtattttttcgtctataagtttgattgaatgcgcgccatgtagtttggcaaagaatccgcaataaacgtcggcttcaccacatagctatgtccggccatttcttgagcaatggctgaatgtgcgtacactgccgcctcaacagctttcgttgtattagccttgaattgaccggcaaaaccagccacaattccagccaatacatcacccattcccccggtcgcctggtaagccccaccaatttgcagttgcttttgctcagtctctgtataaattagtgtgtggtgctgcttaaggaccaagacgtttaggttcaaaatctgtcgttgaacttcattcaactggtgattatcttggtaattgagctgaacaccactcaagcgggcccactccatttggtgtggggttgcaaccgtgaaagtatcccgtgggaatgtcaaattgtgctcggccattaccgttagtgccgatccatcagcgattaaaatttggtccttgttaactgatgccaacaccttacgcaccaattgcgtcgcaaattcatccgttcccaaaccaggaccaatcaaaatcacatcgtttgtttgaatggcagttgtcaattgctcatcattacgccaatccacgaacatcgcttctggcgtgcgggaacgcaatgctgttaagttaattaaatccgtggccactgttgtcaaaccagcgcccgatccaactgtcgcctgcgtggccatcaaaatagccccaccatattgaatgttaccgccaatcaacagtacccggccaaaattgcctttgtgactgtcgtctgggcggcgcaagataacctcatgtaaaatttctgattttagttcactaagcatggcgcgtctccgaatttattaatagtaacttcattataccgcgtgaaacccgaattgcggaacattctccacctgctataattcgtcacaaaataaccaagggtttttaattgcaagcgcttacagtgggtgttattataaccatgtaccaaaggaaaggcaggtaattgaattgcaggaagaattcatttcaacctctatcatctctctacctaccgacatccatgcgggcgtgtcacggcggaacgaccccaggcgatggcggaacgaccccaggcgatggcggaacgaccccaggcgatagtggcacaactccaggcggtgatggcacaactccaggcggtgatggcacaactccaggcggtgatggaacgaccccaggcggtgatggcacaactccaggtggtgatggcacaactccaggcgatggcggcacggccccaggcgatggcggaacgaccccaggtggtgatggtacaactccaggcggtgatggcgactcagcaccagttgctacagatgttattgcaccaactggcgatacaggcgcagctccggcagctttggaaaatgcagatgtagctggtgcaaacaacggtggtgctaccggcgcggtacctgctagcgataatgctggtatacctgcggtcgcctcaacagatggcagtacgaatggcggtaactctactgacgcttcgacaagtgctgtgccgactgattcaacgccagtagcgatgaatactaacggtgttgacacagacagtacaccgactggtggcagtcttgcctacacagctgatacgtcgctacaagacgctaaaaatgcagctaatgtggatgttgataagatgaagggcttgtcagatactgaaaagcaggggtacaaggatcgcattaattcagcaacgacgcctgatgaagttaaagctattttgagcgatgcacaaaatcaaaatgatagccaaattaaggctgataaattagccgataagaagaaagcagcaattgctgaaattaataaaatgcagcatttgtctgatgaacaaaaacgagacttcattgaccgtgtcgatgacgctcgtactgttaacggtgttgaccgtatcttgaatcaagcacgtgaacaaaacgttgaaaaagaagtagctgatgcacctgaaagtgaaagtgcctttaacatttggccatatattattgcgttgttgctaggtagcaccgcaattctagcttgggtaaatcgtggtaactcaaacgattaagtcgtaagcagctataaagctaagagaaccagtttaactgctggttcttttttattgagtattattttccggatttctgacatacaggaaataaatcagtttacaatattacgtatgatttaaagaggagttagtgaaatgagtaaagggtttattgccggtgttgcaacggcattagtagttgttgcggttggtggcgcaggggcgtacgcggttgtacaacatcagtcacaacagaaagcgttgcaaacggagcaagcgaaaacacggtcgatgtcagcgaagttggcttccgcacaagttaagcaatcatctgctaaaacacaaacatcgcaaacggtagcctcatcggcatccgtggcatcatcagctagttcatcatcacggcagtcaccaaatgatatttttgataacttgcctcagaagacacaattagcactgataattacggcagcgtggaatgatggtaatccttatatgaacacgcattacggtgtgtacatggggacggcaaacaagattgttatctatgattatggtgagggcgcaggcggttggccagatcacgtcgcccgttttgtggataatcatgatggatcgtttacggtagcttggcctcatacgacgactgataatgcatcggcaaattcggataacaccacatggcaagatcattcaacaatcacgaaagcggatatgttggcacgcttctatgcaacggatgctgaaaaggcaaccgtaacagcagttgaagaggaattggatttgtcgacaatcaacaaggcgtttgatttattgcctgcttaagtaagtgaataaagcgtaaaggagacgatggtcatcatcggctccttttttaggctggatatcataatgagtaaaatgattattcttgaccaatcagtcaaataagcaatataataatattgaacgaacggtcaagaaaaagggggcggcatggcaagacaacgaaactttgacaaagtagcgattgcgaaacaattgatgccagttttcattactcgtgggtatgaaggtgcatcggtgtcggaacttgtcgcagcatccggcttattacggggcagtttatatgcggcatacggtagtaagctaggaatttttgtggccggcctacaacagttaccgacgctcgatgcattaactgagcaagaattggattttttgattgttgcgttactagaagttgcaccgaataatccggtggtgaagaactttttacaggattacttggtggacattgatacagaacaattagcggttaagatcggtttacagatattagcaaaggcaaaatgatagggggatatcatggcaattaattcagtaacgtttggggaacaaacactaacaattacaattaacggactagacaagatgtggagcttcaaaagtaatttggtgatcccgtatacacatattgcgggagcaacactagataatgaagcattggcagaaccaaagggtatgaaatggcctggtttgcgtgtgccgggtaagtatgcgggtaccttcattttagagggtgaaaaaacgttctataatgctgaaatcggtggcagcgacgtcatcgttgtacaacttcatgatgaggaatacgttcacctagtattgagcgtggatgatggcgttgatattgttaataccatcaaccaacacgtcatgtaaagattctcgtgtggtcggtccaaggcatatcatttaacatttgaacgaattaagcgtaggctagaggtatccaacggctacgaaaggagttcaacgttatggacgcaatggagaaggcacaacggatcgaaaattggttgcagcaaaatggctcagtacaggtgatggttgcagagttcatggccaaaaatccgccggtgacggtacaggaatttttggccacgaatgattgcagcaataagcctgaaacgggtcttgagggaattttgacgcaagaggggctttggtacgatttgcgtggatcacacagcatgatgctgaatgcgttggcagcgcgtgatttaaacacgacaattgaagactatattaagtcggtaccaaaggtttgctacacagcaatgacggcatatgccatgaaaattacaggcgcaatgagtgtacacaatggtgtgcaacaatacgcgaatgacatgacgccagcgcagcgtaaagcgttggatgaatttgcgacggcaggtttaattacggttaagcctgaaccggtgcggattccaccaagaatgaaggtgcaattcgtgaagttggtacagcgacaaagacaagtactcgcggctaactagagaaagaggcctaatgaaaacgcacaactttgtgatggagttgtgcgtttttgttagttatggtgatataaggcatgccagtcatctgacatggtgccggtttgcaataacgaggcgatttgatcaattggctcctgacaatcacgttgcagccacaaaagaatcacactcataaagtgtgccacaatcatttccttggcataaatctcaggcagaccgtgtggcttgacctgaacattctccaatagaatgagtttgagcttgtactggaattgcaaatcggcaccgctgaaaagcaaaccgcggagcagttgacgttcgccgtataaatacgtcagcaaactatgcgtaccagttggcgttaagatttcagactgactaccaggattatcgtgaacaatttgttggattgccgataacagatcggcagccaagatttcgaccagagcatatttgtcctcgtagtgtaaatagaaagtgccacgattgatgccggcagctttcacaatggcagcgacggtgattttatcgaacgtattttgttgcatgagttgggtaaaagcgattttgatcttcgctggggcactttcagttttcataaatcaacactccgttcattttcgttcattggtttttagtctaaatgttttaagataaaaatgaaagtaggggtataggaggcaaatatgaacgacgaagacatgaagaaacaaacgatgaatcataattcgcatgacaatcacgaccacatgcagcatactaaccacgatatgcacgatatgcacgatatgcacgatatgcacgatatgcacgatatgcacgatatgcacgatatgcacaatatgcacgatatgcacgatatgcacgatatgcacatgaaccacggtgaccacgacatgatgatgcacggtggccacatgatgcatatgggtaacatgaagcaaaagttaattgtatcggttattctaacgattccgattattttgctatcaccgatgatggggatggccctgccatttacgattactggcattcctggccagaactggttagtgctcgtccttggttcgattctatttttctatggtggaacacccttctttaacggtgcacgtggtgaattgcaaagcaaacaaccagcgatgatgacgctgattacgatgggaattgtggtggcgtacttttatagtttgtatgccacaatcatgaacgcattgcaccctcacgcgatgataatggacttcttctgggagctcgctacgctgatcgatatcatgttgttaggtcacttgattgaaatgaatgcggtcatgaaggctggttcagcggtcgacgccttggccaatttagtgccaaaagcggcccaccgccggcaacatgatgaacattatcaagacacccccattgacgagttggatttgggcgatgtcgtgctcgttaaagaaaatgaacgcgtgccggttgatggtcgcgtgttaacggggatgccaaccttggacgaatcactcttaacaggtgagtcggttggcgtgatgaaacatgaaggtgaccatgttgttggcggttcgttgaacagcaacacaccgtttacgatgaccgttgccaagcaagcccaagatggtttcttagcccaggtccagcaattggtaacccgagcacaacaggcgaaaacaaagtctgaaacgttagcggatcgcgtggcgggctggttattctacgcggccacgattattggcattttggctttggtagtttggacggttattcacggttttgcttttgctttgccaattgccgtgacagtgttcattatcgcttgtccccatgcgttaggtttagcaattcccttggttgttgcccgcttgacaggcattgcggcacaacaaggactgttgattcaaaaccgtcccgccttagagcaagttaatcaattgcgttatgcattgatggataagacgggcacgttgacggctggaaactttaaagtgcaacaagtcctaacgacaacggatgctatgacggcggatgaaattttgcagaccgcagctgccctagaacaaggtagcacgcacccgattgccacgagtctattgcaggcggtcactggcgacttgccaacggttatgcatcaggaaaccattccaggtgccggtgtgaccggcatgattgggaatgatcactttgcgttgttaaatatgccagccttgcatgaacggggtatcgcccatgaccacactatgtttgcgtcactagctgacaaaggctatacggttagttttttggttaaacatgacacggttgtcggtgttatcgggttgggggatgccatcaaggatgacgcccgtcaatttattgcagatctcaaagcacaacaaattacgcccgtcatgttaactggtgataatgaagcggctgcccaagtaatcgcccgacaattagggattgaacaggtacatgctaatttgaagccacaagataaggtagctttagtgacacaataccaacaacaaggtggtgtgatgatgattggtgatggggtgaatgattcgcctgctctggcccaagctgacctaggggtggcgattggcgctgggacggatgtcgccattaatgcagcggatgttgtcctggtccactcaaagccaagtgatgtgttaacgttgttgtcattagcacgccaggccaagcgtaaaatgacgcaaaacctgtggtggggagctggctataatctaattgcgttgccattagcagccggtattctgatgccaattggtattcgtttggatccaatggtgggggccatcctaatgtccttatctacaatcgttgttgccattaatgccatgacgcttaggctaaaataaatgtaaaaaagcacgtcgcgatgaaaacgacgtgctttttctatatcctgatcatcccattaggacgctcaatctgactctctcaaaaagtcatactttgtgaaccacggattgtgggaaaagtggttcaccacgttcgatgtcgcaccgccgagaaagggaaagagagaaaaaggcgatgcgtacaaccggaacgcttattacttgatttagtatgcgtgaattatttgcattttttgcaaaagtgccaaagacgggaagttttgtgtatttttaataagtgaaatcccatttctcggaatgcttgtaaacgcagcaaaaaagccacgtgagggggcacgtggcttaatgggtggttaatcggcatgaaactaaggggatagggggatatccgattaaccggcatctgaatatgctagattctagggtgcatatctgcgccttgaatgattatagtatgcaacaatttttgaaacacataacaaaagtgccgaaactgacgcaaaatgcaagaaatttttcataacgcccctttaaaccaccattgtactgacacaatgttagaataaagcgtctagaaaaaatgaaagaaggtggatgttgtggagaacaagccaaagtttgtcggcattatcacggctgcaattttgctctcaacatttatgtcagcggttgaaggaaccgttatttcaaccgccatgccaaccatcattggttccttgcacggtatcaagttgatgagttgggtgttcagtatttatatgttgatgactgcagttgcaacgccaatctacggtaagcttgccgatttgattggccgtaagccagccatgttatcaggacttattattttcttattcggctcaatgatgagtggtatttccgacagtatgggtgctttgattttctggcgtgcgattcagggaatcggtgcgggtggtatcatgcccgtcgcctttacgattttggctgatttgtatcctattgagaagcgggcttcggtcatgggactgaactcaaccgcctggggtgtcgcctcgatggttggaccactagtcggtggttatttggtacaaaacctgtcatggcactgggtgttcttcattaacgtaccagttggtttaatcgcgattggtattttggtcttcttctataaggatcgcttcgaacgtcggaaggccacgattgattatcctggtgtgctttggatgacgatgttcattgttggcttgttgctaggtttgcaaatgatttctgaatcacaatggatcttgatgattgttttctttatcatgtcagtacttggtttgtggttgttcatcaagcgcgaacgaaaggccgaggaaccattaattgatttggcgatgtttaagtcagtcgactttacagcagcaaacgcgattgcaggtttggtggctgggttcatcattgcgtataacgtttacttgccaacgtggatgcaagctttgggtggcatgaagccatccgttgctgggttcgttgtgacaccaagttcagtggtttggatgtttggtgcgatgattgcgggtcgtgtgatggctaagcatggcgcacaatatttattcaagtttagtctgtttattggcacgttgtatgccattatgttggctgttattccaggggatgcaccatttgtattgttcttggcaactggtgtaatctttggtttgacgatgggatcaacgatgactgggacgacagtgatggcccaacaaacagttgcaccaagccaagttgggatggcaacatcattcaataatttggcacgggcgatggtccaaacgatgatgacaacggtttacggtgttgtcttgaatgtgtcgatggcaattgctttacgtggtcacagcaatttgaagttcaatgaattaaatgagctgattgatccaaatacggctaagaatttgccagctagtcacattgcaccattgcgtgacatcatgacatttggtctacacaatatcttctgggtaggtgccttattgatgattggggcgattgcaacaaatatgtgggcaacccgtcagttaaagaaataaatttaaaaggcgatgtggaaacacatggcctttttttcatggatttacgcaaaaaccaccccgaattgacgaaatgaccttataataagtgagtgaatgagcgcgtgttagggagaatgaaaaatggattggatgctggaaaagaaggaacggcaaaagattgaattgctgacgtatttgaaacggcagattcaaggcgaaatctcagttaaggaaatcggtgaggcgttgtcgtggtcaaaatacctggttttgacggtggcgagcgaattggttgctgatttaacgtcaatatacggtgaagaacaaactgctgataagtcgttgcaattgtcagcggacgagaaaaaattgctcttatcattgaaacggcacgttaatgttgatgcggtcatgctagtctatctgcgtgaatctttatattggaatttcatcaaagaagtgttcttggagactgtgacgtcgtatgaagagtttgcggagcgttatttaacgacgccaagtacaacacgcaatgttaaaaatcatctggtagagcgtctggcgcctttggggattggtattgatgatcattaccattttacaggcgatgaatctgcaattcggatgttctttttccgcctcgcagttcgctattttggtgatcgcgaatttccatatggtgaacaattgaaacagcaggccgacgaggggatcgaccgcttagttgcttcatttacggcagaaccatttattcgcgattcaaagcggattgctttgcgcttctattatgcgctggctgcgattcgagtacgcgaggggcattttgttgacccgcagaacttagatgatatttttgtgccaacgcatgatatggcgccaacaacgcaagccttgttggcggaaatggtggccgattcactgcagtatgacaccatcaacgcggagcaggcggcagttgaggcacgcgaaaccttgtattatttgtatattttaaatgtcgtcggttcaacggactgggaacatatcatttcaccaaagatgcagcaacgaattcaagcgattatgacaattgtcgctgactatcatcaacgctattttggtgttggcatgacaccagctagcgcgacgcaaatcaggcgtgagttattggcgcctgtgttgatgtttgagttacatgcgattgacgtcggtcaccgtcgttattttgacatggaagaggcttatcgcatgtatccggtgttggtggaaatggccatcaatgtcagtcgtgatattgcgccgttgcgagatcttacgcctgaagagtctgaacgcttgatgtttggttatttgttcacggcgtttgcggcttatctggaccaggctgatatttttgcgccgattaagattgatattgatattacttatcggccggcgttagaagtgattttgaagcgcatgttggcggggatggcggagtttaacatcgtgtttacgaatcgttttgaggataatgttgatttagtcatttcagatgccatgctggcagaagttgacagtcggaaccgatttgattggcaacaactgccaacgattaaacagattgcccaattacggtcacgtttatcggtcattaaacgccaaaaattcgaagcacggtttaaagaattgaaccccgaaaatgattagcaaaacgcccaccaatcaagtcaacgattggtgggcgtttcagtagagggatagtctttttgtcagtagcatttgcagggctgggacatcacgctataatgaaggttaataaagtagcttggtaatccctagactaagggctactgtgagaattgtggtgaaagagtggtgagaaagacgatggaacagagtaatcgcacgatgaggatgtatcaatcattggctgaaattgcggagcaggcacttctgaatatggagacacagcagtcagcaccagctagtaccacagctgaattggatccatctattttgaaagcttttgctaagcgactggtgaaggtgcttgatgaaatcgcgactgaagatgaagtagctgagcacgcccaatatgtgcaggcccgggctagtttgatggcaagcattgagcaggttgctgatgtcacagatgcaacaattaatcatttgtgtgcagctttaagtagcacccgtgatgccattcggccacttcaaatcgcggccacagctgacaatatgatggctcagcaagcgttggcacaacactggcttgatgtttatgcaccggcaagcgttgacccaagcttgagtgagccttatcaagcgttacatgtcacggtaaccacgaatcggtttggcctgctacaggctttaggtgtgttcgaccatgaattggtcgcttttcaccgcgaaagtcgggaatttttggatgaattggttggtggcttatatttgaaggttgcgcagtatcaattgctacaatttgctgatctggtgaacttcttttcagcagctcacctgtacgtggcgattgcctcggccccagaggaatacatggtcatcggtcaattaattcaacagttggaaccagtgctcagcgataagattatgtcgctttctgatttgccaacggtcgctacgtatgtgcaggatttgtacactaacgcagcgatggtttggcaatctaatgcaacgctgactcctgaatctgaccgtttgatggctgagagccaagccacgcttgcacaagctgccacgcgtgatgattatcgctcggttgtggcattgttacgccaagttcgtttcgaacagccaacgttggctaattaatgattgtattgttcaatcaaggcgataaagtcaggtaagctaatggcccaggcgagcgcagaagataaattatcccattgaaaaataacatccgattcgggctcaccggcttgattgaaaatgcggagggtcatgagaccgaattgactgaagctaggtaagctacgaatttcacgaccgttggctaaatcaatgcggccaaatccgttattgttataaaagctggtgatttgatcattgttcatggtaggtacccccattctttcagtattgtactaatccgatatgtcccagatttgagctaatttcacgacttttgcgtctgtttgttatccaattgcgctaaaattcgttaaatcgtgccaattgtggtccaaatcaactttttgtaagtataacggttatactaattaacataaagtaagttatcaaacaacgaagagcgggggatacaacaatgtacaacaagttagagaacaagcaatggatggtcgctggattgtcaactttggttatgacgcaaggacaattgtcacgtcaagttattgttgaaaaccgcaaagttgatttggcaacgaagtaataataaaattcctgtaggcatgtcttaagagaaggtatgcctacattttacatatctggcacggggtaccgatccgttgtgggaacggcttggaaacatagatgattctagttatgagaaatgtcgcgtaaccttcgcaagttaacgacctaatataaagattttcagggccacgaagttacgcataattgcggaactttgtggctttttttaatgcaacaaggcagtagggttcacggttatgatgagaagagggaaagataatgaatttcaaatcattacacacggctgattttgagtcaaaaacacactacaaaatgtataaagacggtaagcaatggatgtttgccggaattatggccatcgcgttgggggctggtattgctgcgccttcacaacaagcatcagcagataccactgatgctgcgacagtagccacgacaaccaatacaggaactagctcgaccaatagcaatacggtgacattgtcaacgtcgactagtacaacgccaacgactgatgttgcgacaacatcttctgacacagcggtaacaccagttgctacggctgcggcagtcagtgcaaacagtcaatcaacgggagcgacctcggtttcgacagcatcagcgacgccagcgccaagtgaaacagctagcacagcagcatctaacacgttgacgagtaatgcagtgggagctggtgacagtgctaatagtgctatcaagtcagcaacctctggttcaacggccgatggtaccggtacgttggggtcatatggtaacaaggacgcttacccatcaatttctggtaattcagcaacgtcatcgattaataatcaaggtgcggtaacggttaataagagcgcctcaacggcaagctcaaattcatttgatgtaaacatgtcaaaggctgcctcaacgtcagcgacggccaacacaagttctgttgcggtgacaatcaaggcaccaagcaacgcaacggttggtaacatcaagtacacggttgacagtgctggtaacacggtcgccgtaactcctggtggtagttcatatattgtgaaccaaatgggatcggggatgacctctgatatcatgtcacaagccactagtacgattaagtctgaattctcagttgcgtcaaagaattcagtcgctgcggtatctgctaagagtgtggctgatagttacaataatttggcgacggctaacaaggcgcaacaacaatcgcagctggctagtgctaagactgcgggtgatgcggcgataagtacgtcattggcagtggctaatcggatatctaattttgcgtcgagtttgaagagttcaaacgtaacttcttttggtgtggaatcagcagccttgtctaatgcagccagttatattaaggcgggtgactggattaatgcagccatccaactgagtgcggctaccacttatgcatatggtgggggattgggattttccaaggatgcaaacttcagttctttggcttctttgaaagatagttttacaggtaagacaaattggaatggaaattacgatactactattaccaattctgattacaacacctacaacaattatgtggcacagtcatcagctgcagcatcagcagcttcaagctatgcatcagttgctgcagttaatttgttgtctagtcagtcggcacaaacagattataattcatactcagccgctgcggtagcggctgctaagtcagctgctgatttaattacgtcagctcgttcaattgcagctggcctgaatacgtcgagtgcggttattattcataattcttattctggcgctaatacgtcagtcacgcaaagctatgctgaaacggctaagaaagcagcaagtagcgttaatagtacacttagcaagtctttggcgtcattgagtaacggatttgactttgacgtaccgaataatgcggtggctggtactttctacgtttcggcggctgctgatacaaaaacccgtatgtcgtttgcatctagtgttggaaattatgcgcgttcgggtatggcacgaacgactggcaaaacagcatcgatgtatagtaatttggcgtcatacatggattatttgcaaacatcagcaggttcacatgaactgtcacgtttgcacatgagtatgggtgccggcgcaacgttctattttgatggtgttgtgcctggtatgagttatgctgcaggggaattggatagtgcttatgcggctttgtctgaagcaacggcaaacttgaatgacattgcaaattcttatacggttgcagctaatttaacaaaaagtggctctacatacgtaacaagttcgtatgggacaacatataacgcggccttagttaatcaattatcatcagcattgacggcacaaattaggactattgataatcttgttgatgacatcaatagttacgttgtgaatacgattccagcgtttgtgggaaattattttgtttaccagtacatgaatacgaaaccaggactaggtgtttatagctttgattactacgagacagcttggcttggtattcaagattcggcggcaatgattgttgataaattggcgtatgctcaagcatctcagtatggttctttgtatgcttcaattgccaatagttaccgcgctttaggaaccaatgctgggaacgttttgcttggtagcctatatgatgagctggcttcagctcaaggatcagcgtatacagcgatgaattcggcctacaattcgcaaaatgccgaatatacctcgattagtgctgctggaaacttgacggcgggtcacctaggtgtcatcggtggtttgattactttggcaattacgcaagggacaagttctgccggtagtgccttggcatctaatattcagaccatgatgacgcaaatgaatacaggcatgcaagccatgacggattcatatgcaagcttgtttaacgccacgtcagcggcagctgtaactgacgtgtactatggagtggttgcacaaacgccttctacgtcaggtttgacgggtggaacgtttattgacaacaactacaccacaacggcgactgtgaatggtactgataacacaaccacaactgacgtggtttaccaagtggttgacgaaggtgttttgacatctttggcagcgacaacaacaactgattcagcaacggcgacggcgattgtagcggcaaagtcagttttggcaaacagtaacgtgtcacaacaagacgttgatagtgccgtgaatgccatttggttggcacttgatcacacaattgcaccatcaacaactgctggtaagatcggtagtgcggccgtgtcagctgccacgactgctacagccccaatttcattgacgtcagcggcccaaacggtcacgacgacaacggatttgaataacgctggagaaaagaaaacctttacggtgactggctcagccaactacatgaagccaacatcagtgttgttggtagacagtcaaggaaatacggtcactgattacaccagttcagcaacctacaatagccagacaggtcaatttagcttgaaccaagtggttttgccaacccaaggcgactacaagttggtcgttgtttggacagctcaaccggataagacggatattaatagttacaacggtaagtcaacgattaacttggcaactagttggacaaatcttgacaagactgctggcagttccgctgagacggttaatgtgcaacgtactttggcagtgaaagtatctttgcaactgcaatacacggatgcgacgggtacggtacacacaactaatttggcaaacggtctgttgattggaacggggactgtgattgtcaacgatccgccattgggtgcgtacgttgggatgacagctgaccaaattttgtccttggacaaaacagctggtacaacaaattcaattttgccagctggatatcacttgtcagttaatagcaacggtacgttgttgattactgtgaatgggaaccctattaataacgcttcttatacaattgatgctgataacgccacaaatgatgcattgactttggtattgcatgcagatgcaaatattcagagtgcccgtgttgtcgctaagggcgcccgttatagtaatactggagcaacgatagaaattgccaatggtaagacaggcgacagtattcaactcattcagaccaacgatgcccaactagcgattccgggtgcaacgtacacagtaacgggacctgatggtaagacctatgcaacgatgaaagaagcgctagcagctaacgcaaccttcgatgcaacgaattggactgacgacacgggttcagataaaacgcgtcaaatctttacagtgaactacgtcttcaacaaacaaattgcccaactgcaagttggtgcgccaaacgaaggcttgtctgagcaggtgactggtgataccgactctgatattgcctttaaggctagcgatgctgatttgaagaaggccggctttacgtacacggtaacggcgccggatggcatcgtttacgcgtcacttgcggcggcattagcagcaacaatgacggtcaacggttcattagtgaaggccggtaagtttgatgaaaccgactttgcggttggcgttaccgacccaagtcaacaaattttcaaggtgacttacacgccagatgcacaatcggcgacggttattgctaataaggacggcgtgaacagtattttggaaacaatcactggtaagacgtcagataagttggcgtttacgaccgtttcagatgctacgttggccacgcctgggtacacttacacggtcgttggaccagatggcgtaacctatgcaagtttggctgaggccgttgcggctaatgggtcatttgataatacggataacgcgggaacggctgatgaaagcgtccagacgtttacggttaactacgtcaagacaacccaacttgccacgattacaattcatgacaagtcaacgggtaaggtacttggtacagttacgatttcaggtaagtcaggggatgcgattactgcggaccaattggctacagctatcagttcagtgactgatgcacaaccaaattatgctggcaacattacgattacgagtgatacggcatcgggtcaaaactttgactttaacgatggggcagatcaatcgtttgatgtgacgtttgtccacaatgccaagttggtatcaacggatacaacgtataccggttctgtctcatttaagggcactaacttagctgttaatacgcaaactgccgtagtgactaagactgcttcagttgacgcaatcactggtgaaataattgatgctgccaatgcggataactttgcaaattatgtggcaccatcttatgcgttgaagtctggtaccgcacaggttgatgcgacggctggaacagtgacgtttgcctatgttgcagcaacgtatgtgaagggttactttgcagacaaaaatggggtgcaattggcaactttgagtggtaacacgacgtcgacgtcggcggttattacttacaccgagattaagacggttccaccaactttgcctggcgatgcagcaactgatgctagcgaagcgggtagttcagcatcaaaggccagttccgcagcatctgcagcggactcagcggcgactgaattcccagcagcgtcaagcgcagctagtgcagcagattcatcagctaccgtagcatcaagcgcagcttcagaagccagttctgcagccagcgtcgcagcttcagaagcagcagaagccagttctgcagccagcgcggctgatagtgcggcagctgctggcgataacgccgcagcatcaagcgcggctaaggatgcgagttctgcagcgtcagcggcttcaagtgcagccagtgccgcctcaagtgcggcagaggtagcatcaagtgcagctagcgatgcggagtcaagtgcttcagaagcggcagcagttgctaagtcagaaagccagagccagtcaacgtcgattagtacgtcacaatctattagtcaatctacgagtttgagtcagtcgacatcaacgagtcagtctttgagtacatcaacgtcattgtcaggctcgacgagtttgtcaaattctatttcgttgagtggatcaacgtcattaagcaactcaacttcgacaagtttgagcaattcaacatcattgagtaactcaacttcaacaagtttgagcaactcgacgtcattgagtaactcaacttcaacaagtttgagcgattcaacgtcattgagcagctcaacttcaacaagtttgagcaattcaacatcattgagtaactcgacttcaacgagtttgagcgattcgacgtcattgagcagttcaacttcaacaagtttgagcaattcaacatcattgagtaactcgacttcaacgagtttgagcgattcgacgtcattgagcagctcgacctcaacaagtttgagcaactcgacgtcattgagtaattcaacttcgacaagtttgtcagactcaacatcgttgagtggttcaacttcaacgagcttgagcaattcaacgtcattgagcagttcaacttcaacaagtttgagcaattcaacgtcattgagtaactcgacatcaacgagcttgagtgattcaacgtcattgagcagttcgacttcaacgagcttgagcgattcaacatcattgagtaacttgacatcaacgagcttgagtgattcaacgtcattgagcagctcgacttcaacaagcttgagcaactcaacatcattgagtaactcaacttcgacaagtttgtcagactcaacatcgttgagtggatcgacttcgacaagtttgagcaactcgacatcaacgagcttgtcaaactcaacatcattgagtaattcaacctcaacgagtttgagcaactcaacgtcattgagcagttcaacttcaacaagcttgagcgattcaacatcgttgagcagttcaacatcgttgagcagttcaacttcaacaagcttgtcagactcaacatcgttgagcagctcgacttcaacaagtttgagtgattcaacatcattgagtaactcaacttcaacaagtttgagcgattcaacgtcattgagtaactcgacttcaacaagtttgagcgattcaacgtcattgagcagttcaacttcaacaagcttgagcaactcgacgtcattgagtaactcaacttcaacaagtttgagcgattcaacgtcattgagcagttcaacttcaacaagtttgagcaactcgacgtcattgagtaattcaacttcaacaagtttgagtgattcaacgtcattgagcagttcaacttcaacgagtttgagtgattcaacatcattgagtaattcaacctcaacgagtttgagtgattcaacatcattgagtaattcaacctcaacgagtttgagcaactcaacatcattgagtaactcaacttcaacaagtttgagcgattcaacgtcattgagcagttcaacctcaacgagtttgtcagactcaacatcgttgagtggatcgacttcaacgagcttgagcaactcgacgtcattgagtaattcaacttcaacaagtttgagtgattcaacgtcattgagcagttcaacttcaacaagtttgagtgattcaacgtcattgagcagttcaacttcaacaagtttgtcagactcaacatcgttgagcagctcgacttcaacgagcttgagtgattcaacgtcattgagcagttcaacttcaacaagtttgtcagactcaacatcgttgagcagttcaacctcaacaagcttgagcaactcgacgtcattgagcagttcaacctcaacgagtttgagtgattcaacatcattgagtaattcaacttcaacaagtttgagtgattcaacgtcattgagcagttcaacatcaacgagtttgagtgattcaacatcgttgagcagttcaacttcaacaagtttgtcagactcaacatcattgagtaactcgacatcaacgagcttgagtgattcaacgtcattgagtaactcaacttcaacaagcttgagtgattcaacgtcattgagcagctcgacctcaacaagtttgagcaactcgacgtcattgagtaattcaacttcgacaagtttgtcagactcaacatcgacaagtttgagtgattcaacatcattgagtaactcaacttcgacaagtttgtcagactcaacatcgttgagtggatcgacttcgacaagtttaagcaactcgacatcaacgagcttgagcaactcaacgtcattgagtaattcaacttcgacaagtttgtcagactcaacatcgttgagtaactcgacatcaacgagcttgagtaattcaacatcattgagtaactcaacttcaacaagcttgagcgattcaacgtcattgagcagctcgacctcaacaagcttgagcaactcaacatcgttgagcagttcaacatcaacgagtttgtcagactcaacatcgttgagtggatcgacttcaacgagcttgagcaactcgacgtcattgagtaattcaacttcaacaagtttgagtgattcaacgtcattgagcagttcaacctcaacgagtttgagcaactcaacgtcattgagtaactcaacttcgacaagtttgagcaactcagcgtcattgagtaactcggcttcaacgagtttgagcaactcagcgtcattgagtaactcggcttcaacgagcttgagcaactcgacgtcattgaatggatcaacttcaacgagcttgagtaactcaacgacgaatgggcgtaatgctggtactaacattgcaactggtgttgccacgattggcacaacagcagctactgttgcgggtacgccgttgacgaaccagggaagcgctgttgtaacatcactttctaatgcaacagttaatgtcgcgggcgttgttaatacgcctggtcaatcagctggaattactggttctcaagcaagcgatgacaataacggacgcattgatgccgtgactgtcgatcagaagtctgcaaatttggaacacgcaacggccgatgaccaagtctcaacgactgagttcttgagtgttgctgcgttgattatgatgggcttgtttggtctctttatcgcccgtcgtcgtaaggatgatgaggaagatgaggatgactctacaacaacccgttagtcggtaagcgttgattataaaaaataaggcgaagtgatagtccggagagggattatcgcttcgcctttttgtgatgcaaaaggatgataaagtcgcaggaaatagggtattaattacgtgaaagcaacagttcttgcggtatataataagaagtaattgtacgacgattaaataaaattagtagcgttatgcgtagctttggggtggaagcaatatgaaaatttatatactaaatgattcgttctatgttcgacgctcggggttagataacgccggcattttacgaacaaaattattcaataaacatggcttacagacgcaattcgtgacttacaagcttgatttaaatgcacgttttggccttgaaacggtggccgacttaacgccaaattatttgaacatgtatgaggagttgatggaacgcccaacgacatcaaatccgattgatattaaaacaatcatgttgccaaatattgcacaggattacatcgacgaaaatggtcgtgagttgcgtctaacggatggccaaacgattaaattacaaccgggtattgatcacaaaacgttgttgctatggactgaaattgcggtaaatggccaaacaacacggatgaaattttttgatccacgtgggcaacaaatcgggactgaatatttttcacctgatgaccaacagctgtatttgcgagagtttgtgtcaacaaccacaccaaccaagttgtggacgagcgtgacagccactgggcaaacaacttatcgctaccgcacggctgataatcaagagcacatgtttgatagtgaagcggcgctccaagcgttttggttagatgaattggtccgtcaaaataggactgccggcgaagaaacagtctttattgtggatcgtaatgctgaatggtttgacgctttgcaacaaatgacggaaccggcacgcaagattagtgtcttgcataacaagcacacgattgatccgcagcaggtgatgggaccactaaatgaaaattacgaagcggtcttaaatcatcaagaattgtttgaccatttcattgtttccagtgaccagcaggcagctgatgtgttggcgcgatggcccaaggcgactgtgaccgcgataccggttgcagtattgccagatcagcgaccagtgaatacaccatttgtagagcgtgaagtaggtttggtggccattgtgtcacgaattgcaccggagaaaaacttgaccgaagcagtgcaagcaattcacttagcgcatcagcaaaatgacaggattcatgctgaaatctggggctctggtaatcatggtgacgacgaccgtttgcaagcattcattgatcaaattggcgctacagcctatatcaaattaaaggggtacacggcccaaccggagcaggtatggcaacgggcccaagcgacgttgctaacgtcacacaatgaaggatacgccttatcgttggttgaggcgttggcaaatggcgtaccagcaatttcttacgatgttaagtacggtccaagcgaattgattgatgagtcaacgggccgattagtccctgaacacgattacacgcagatggctgaaacgttagtaaggtggtttaatacgccggaagaattggcacgtaaaagcgcagctgcggtaacgtcaacacaacggtttagtgcagaaaatatttggcagaagtggaatgaggtgctgtcatgattggatatgtcacattaacggtgccggttaagcgacgccacgagttggtgtcagatacgatgcgagtctattcaggcttgttcaacataaatggtgattttttggtcaatgagtcgaatgcctacgaggtgcttggcgcttcttacgatggtgtgtcacaaacgccgcaacgtgggcctgaatttaccgagaatttgataaatgaacaccaaagtaattggttaatcggtgaccaggtgcgcgtgaccacacttttagatgatgtgggtcgcgtgcatgaagtcggttattacaatcaattaggcaaattagcactaagcgaacaattccgtccgaacgggcaattggtacgacgccagtactggaatcacgctggtcaaattagtttgacggaattttttgacgggcagcaacaagtaaccgttatggcaatgcaaactgaaacggaggcacactggtatcagtggccaaatcagttgcaagagcgccacttaacgggtgaacttgatttactctttgatctactacagggcgcagttaatcgtcatgaaattgattcgttgtgggtcgacgagtctgttgcaggggtaaattgggaagtgttgggtgtacctgtacgacgcataacggacgatgaggagttgtaagatgaacttttttattaacggtggcttagcacgcactaattcgggtgttgagcacgctattctcaagcgcctccaactgtttcgtgaccacgacgtaccggctatgttggtggcgactgattttttctttgatttgcatcgaaatgcatctatctggggtctaccagagtcccaattattagggttgcatgattggtttattgatgcgcgtgattttgttggtcagggtgcgcctaagctatctgattatccaatgccagatggcatggttgaattacagacggggaatgcccaattacgacagtttgcatttgacgggcaaacaaccagtctgattgatgtgaatgcggatgtgaatggggatatttacgctgtgtcatatttcgatcaaaatcgtcgccaaacacgggcagaatggtatgacccacggggctttatcattgcggaagatcgctataccatgctggcagataagaatgtgcgggaaagccgggcgttctattcaccaactgggcaattgaagatgttgtacaccatggcacatgatcgaacggatattgatgagtttgaaatggtctcagtatttgattatcacggtcatgattatcaattctttggcactgatgagttatttagattcttttttgacgaaattaatcaggcatttggtggtgcgaatgccttcatcgctgatcgaggcattaccgaagcgtgggcgttgaacaatatgcagacccgggcattcaaaacatttattctacatgctggccatctcaataatgaaaccgcgccaaacggcttggtgaattacaactatcaatatgaattcgataatatcggtgatttcaatgcggtgatcgtgccaacgcaaattcaactcgatcgggttgctaatcggtttggctatcgggaacgctttttcaagattccagtcggtatgattagcgatgcggtgctcagtgaacccgttaaaaccagtattgaacggcaaccacatacggtggtgacggtttcgcgcttggatgaggcgaagcaaattgatcacttgattgacgccatggcaattgtgcatgagcaactgccccaggcgcaacttgaaatttggggtaacggtagcgatgatggtcggcttcgtgaccagattgcgcgtttagatgccacagactatgtccatttgatggggcacacgacggcagtcttggaaaagttggccaacgctcagctgtttgttgcggctagtcggtcagagggctttggtttgacgatgatggaggccgagtcggttgggacgccaatcattgcgtatgatgcgttatacgggcctcgtgaaatcgtgcaaccgggtgttaatgggcaattaatcggattacatgacccggataatgtgcaacaaatggcgcattggattcaacattatttgtcgaatcaacaagcactggcggctttgatggctagcacgctagaagcgcgcatggcctatagtgaaacagccgtttggcaagcttggcaaaactggttgacggcaattgcagaatggcggcaagcgaaatgaaatatttattaattgaggcactacatccacaaattgatgatgtgactgaaaaaatcttagatgtttatcgacgactcaaggaacaacgagaaccaatcaatattatcgtggttgactatcaaccggaactcacgaaacttgcgcaagattatcgcattgatttagatgacatttggcaattggctgatattgtgcaacgaaccaaagggtatcggcatgaaccgcgctggttttgggatttgccacgggcaccaaaaacggagatctactctgattttacttggggcgaaattaaagctggttcattacgattagcgtggtttgattattttgaacatatcagcacagcctggcgctttgtccgacaagttaaatactataatcgacgcgaagagccacgcatgattgcggagtatgattatcgtgggtttgtctctcgccaaaagatggtgcgaaatgaggcagtctttcaggcggattattttgatgaaactggacttgaggcgttgacagtgctctataatcaggatcagcaaccatatctttggttgcgccgggacggcatgcgcaatacgacggcgtatccatcgcaactggcattgcaaacggcggtcttgacggaagcattgcagctcgatgatcgaccagaaatgtataccgttggcgagtcacaactgattgatgacttgatggcctcagcatcgctgacattgaccgcccgaattggcgtgaccgatacgacgtggcagtgggtgccagaacgtggggtgcaaccagcacatgatgggttagtcgtgacaattatgacgcacagtgatagtgatgagcgactcaaagcggcggttacagcggcgaaaacagctggtgcgacgcaaattcatttattgcggatgttcaatccaactgattatcaaacggccttagtggcggatgacatgattgatgaccatgtcgttgagtggacgttatggtcagaaaaagaagtgttggcttatgaattggctgacacggatttattgctgaccgtttcagatagcaacccagtgggcggcatttatgcgtacgccatggcggttaagttaccagtggttaacatttcaaacgacgcgcaatcacggccatatttagatggtatgactgggcaacgtgtaccgattgagcggttgtcacatgctgttgacgttgtgttacagcaagcaaatttagcagactaattagtctgcatacatagagaaagcgaaggggagtaggatgagttattgggtgtttgatcatattgaagtggatgattatttggcatttgataaacccaagcgcgacgttgttacttttgcgacggcgattggttggcaaaagttgccgtattttattacggcttggtccgacgagcctgaagcgtcgattcgtgcccgcttgattggtgtgttggcagcaacgcaagcaggtgacaccgttctccaccaggtaccgagttataacggttatcagtatgacgaaattgtgctcgatgagatgacgcaacgtgggttgattaatgttgcaattgtacacgacttggagagcattcgacttggtgaaaaagtcttagaaccggaattaacacttttacgccaatttaaggcaatcattgtgcataaccaacggatgaaggcgtggcttgaacaacatcaagtgatggtaccgattattgtgttggacgtctttgattacaggagtagcgtaccggcaccgacacaacaatttgcgcgaaagttgcattacgcgggttcactggcgcctgagaaagccccgtttttgcaatcctggtcaccagcgctgaacttaacggtttatggtaatcccaaccagacgttacgcaaccaacaagcttttgcgattcaccccccagtccatggcgacatcttgccaggtattatgcaaaatggctttgggttagtgtgggatggtgatattcaaccagctgataatgaatttggccggtatacgcgcatgaataacccgcataaatttagcttgtatatggctgctgggttaccggtcattgtgtggtcagagatggcaattgccacggtcgtgcaacgtcatcagttgggctatgtgattaattcgttgacggatttgccagcattgttaaataccgtgacggctgcttcatatcgaaagatgcaagcaaacgcacaggctatgtcaatgcgtgtccgcaatggcttttatacgaaacgagcgctattaacgatgatgatcttactggaggagcgggcatgaattggttagttacaagtgatacaacatcaaacttagcccaagcagccttacaacggcagtttgcgttgcgaccagtgccaacgattcctactgcagttatcgcacaagagtcattactcgttgcgacagctgccggcacattgacggggatgcaacgaggagatgtggtgttaattattctgtccgatgatcaacccgatgaggtgtggtggcaattgatgcgttcagcatacgactggcatgcccgcgtattggtcgatgatcgcagtcatcaatttagtcggccaattttgggtgagcgattcagtgaggtgctcacgaaattggacctgaaggacgatatcttacaggacgcattggcattgttgaaatgggagttcaatgatattgagagggattgaagtggcaaaatcatattttgaaattccggattggactactagcgaaggtagcaatccatttgatgaaacgttggcccgaacccgtttgttacaacaagcgggcatggcgccaacgattattaatctcgattggacgccccggttgcgggcctaccaacaacgcgatggttggcaagaccaccctgttttgggtttgtatgatgatttgcaattagccacggatgtccaagagcgggtgctgagtattcgtgatttaaactggccgtctgacgtgttgttttttacgacagatggcggactgtttgtttatcaaggggcaacccgaattgcggaagcttttatgaatccgatgatgacagatcgcttagatgtcgtgcggtatttcgcggacggccaggtagtagcggaaaatcgttatgattaccgtggcttcttgtcgcaacgtattgagtacgaaaatggtcaaccagcaacgcgccggttttattcgccaggtggccggctacgtggcttctatatttttaccgagcaacaacaagcgtcattgagcttaacggaacccttctacggccgagatgtattttacgatgagactgatttgcaagcccattatctacaacatctattgacagatgttgtcggagagtcggcggtgattgtgaatgccaccaatgcgaagctcgcggtggtggcgcgtgttactacctcgttagcgcatgtcacattgaacgtcagcagtcgtgataatttgacacccgatatggaccaactacaggcattgcaagcccgggggagtcaggttgtgacaacgacggcccatcaaaaggcgcagttggtcaagcaattatcagccgaaacagttcagcagattgtggcgtggccaacacggccggacagctttgggacgagttcgcagtaccgcgaagaaattgtcgcctggtatgtccctaactttgagggatcgtatgaacgtcaagtaacctttgaaaagctgatgcaattaatggtggcgtaccccatgatggctgtttggattgtgggtgatggcccagcgatggacttttatttgcaatgggcacaagagacgcttggcgatgaattttattttccaaaagaatattcgacgtataagcaacaaaaaaacgacgaggtaaaaccgcgtgttgcgttaaaaattgcgacggatgcccaaacgacttatcgtgcgttgctgccagcacgcatgattcttgatttaggtgatcaacccgatgacttcgttgggtcgactgccctgacgttgggggtgccgtatttcacaaaggtgccatctgactttatggttgttggtgataatggtgcgttggtgacaacagttgatgaattggatactggcttgtcgcagtatctctatcggctaaatgagtggacgcaggcacgcacatttgcagagagttttgcgaagcgttttgacagtgcgcaccttgtatctgcttggcaacaagtattgtcagcgcaaggaggacgatgatggctgaagatttagagaagcaaacccggcaacgattacgtgatgaagaagttttagatcgtgatcgtcagaaaaatcgtgacgaaattgcacgtttacagtcaaaccaagcggcggttgataatgacgaagtgccggttgaaaaaatatcagaaaaaacgcatcgcattgtcgtggaggtgcaggagaagcccaaaaaagcaccgaaagcgaaattccgcctcattcaggttggtacccaagcgtggccggttgatgaatgggacttggatcctaaattacagtcagtactcgttacgacggcagcggcgtttccggcccgaccatctgctcactatgcagtttttactgatgagatattggctgggccagacgttttagcaattgtgaaacgtctgccaccattttcaatcatttatgccagcacaacagttgatccagaaattgcggacttcttgcgccaaaaagcagctttttttgtgccaggtgctggacacgccttatttcaaacaattgttgacaattttttcatgggtcaacgtggtatccattcaggtgttacggaggcgctggatattgcggaaacgtttacgggctctgtcgaacgccggggacgttttcaaatgacattaagtggtgattttgggcctaccttgcagcaagtggtaacgtggcaccccatcagtgttgaaaaatttgaaacggttttagccggtatgaatggtatttttttggatgccggtgataaaaaggtttacctagaagggaatcaacgtggcgatgtgtactgggaatggcacgttgaatttattcagccggatggtaagctggtccaattcgtgattcccatgacggaaagcttgcaagaacatgtctttccggatgtgcacccattttattctttccagatgtcattgtggattagcgggcaaggcgaggtggattttaaccgcgtgattgttcggcggtcgcggtcgacgtatggcacgctgttgccaggggatgaaaaacagatgaccagcaccggtgatgaggtgttgtcatactttaatccaggtgatttaaagccaccgctattggtgtcctttacggggtcccgtttatacggggatggctttgaaatgatgagtgtgtacggtcgccataaattaccgtatctgctttttactgatagtcggacccaaggtggtgccttcatggttgggacgccagaatatgagcaattggtgattgataaaattcgtgagaagctacaatggctaggttttgacgagcatgatgtggtgttccaagggtattccatgggttcgtttccggccctttattatgcgcgccacttcaaaccccaggggattattgtcagcaaggcaattgtgaatttggggaccttttccggtcaggatggctttgcacatggtggtacgaaggattggccgcttgatatgcgacgccatttattcggtcgggtgcttcgtgctgatacgccggtcattgatcaaaaattatggcaatcgatggaccaggttgattggacacaggttgccacgtatgtcttttcacttgcgcaagacgaatatgatggtcagtccttaccgcaactgctccgttttattaaagatcgtggcggcagtgtggaacatttctggctggatggtgaccacttggcgcacactgacgagatgattaatttcgttgaaggtaagttagagttattgattaagcggaggcgcgcgacgttatgaaaacatggcagaacgtctattggacacaacaatccgagctcctggaattgcaaggtgcgacggttacgcatgcccaaattgatcaagtgaattacgaaaatgacatttacgcgagtgggtttggtgtcgtcgtttggcgaagtttagtcaattttcggcgtgaatttcggcaagaaacgctaatgccgctcgtgccaggtcatgaataccgtttccgtttggatgcggttgatgaagggctaaacacgtatttgttggtgacgatgtatgatcaagcaggcacgattattttaagtagtggtcgtggtcaaaaagaagtgcaactagtggcgccagctaatttggatcattatgatgtgcaaatcatcgcctttggcaacggccgctttgttttcgaaaagatttttattcaagaagtcttactgacgggaacctacattccgaatgattatgttagccaggatgggcggacgttagcgcgttatgttaatcgtgatgcaaatcgtcatctctttgtggcatttactgaaccgttagacaaagagacacaatggccgattgctagtgcaacggcggcccaggtgccgattttattgtttgctaatcttgggttagcggcagattattatcaatcaagtccagagtttgttacaaccttgatccacaatgcgcaaagagatggccggtatgacacgattagcttggttggtacgggactaattagccaactagcagcagcctattacggggaactgcttcagctaccggttacttggttgacgccgttacctgattatgaaacggcacgcgcacattatgctcgacctaatgtgctacgagcggcggacgcacatgggtggcagttgccccaagcaaatgtggcaggggtgataactagtcagcagccaacacaagcatttgacgaaaccgccttaacaggccaaacggtgagtgttgatacaaatgagttgttacgcttcctcaagcatgaaaatagtggtgtgtcataacccaaaatgaaaacgcaaatctcaccaattaactgtggtgaggtttgcgttttcacttttgtaaatcaatttcgtttaaagtgttgacatttaataggtaggtctgtattatattacttgtggttgcgataagtaattacgttatggagaattacccaagtctggctgaagggaacggtcttgaaaaccgtcaggtcgggaaaccggcgcgtgggttcgaatcccacattctcctttaacgtcattggcgttacaacttaaatatttattatcgcgggatggagcagtctggtagctcgtcgggcccataacccgaaggtcgtaggttcaaatcctgctcccgcaattaatggagaattacccaagtctggctgaagggaacggtcttgaaaaccgtcaggtcgtgaaagcggcgcgtgggttcgaatcccacattctccttacttaataaccgtgtccttatgggcgcggttatttttgtatcacggcagttttaggttgagattctgggagacttggtctgcttatctaaatgactttgggaggttgtgagacgatgctgacactacaattgaggtacttgagatatgccattgcgtctgctgtcttaacgattattacggcgctaacgatgccacttttacaggggaaagcggccctgttgcacataccggtacctcattttgagctaatcgcgtttagtgtgacagctatattcattgtgttagttaatgtgcgaatgctaatgcaggcgtatcgccaacaaaaggagacccaattaaccacgttgtgggtaccagtcgtgggtcaagccctctggtttgcaacggtagcgtggttacatgaaatgccggcagcaggggacttcttgcggacgatgacattgccgtttgcgttagcgggggtcacgttgttgttgctatcgcttggtttgctgcaacgccgtgaacgtgcgattccattagatgcgatgatgcaacaaaatgctcgccgactaacgtggattacggttgtgttggccatttacgccttgctatttttcggcatgaccttaaattggcaatcgggtttggcggttgcaacctcagttttgctaatcgttgatccccgttggccagcgttttgggccggttggcgtcgttttaaaattttgcgggcgttggctgccgatggggtaacctttcaaaatccacaagtattggattacgtgcatgatgtaaaaaatgttgtggtggaaaagacgggtattctgacgagcgacacgattgttgtgcggtcggtcttgtcggttgatgaacggtacagtgattttgatattttggggattacgactggtttgttggaaccatttgattcagaattaacccgctcggtcttggcatttgccgaagagcgtggggtgtatccatcaagtgcctcagaactagagcttatgccactcgttggcgtgaagggcgtcatcttaaatgagcgtttctcgattgtgtccgcggcgtatgcggttgatcaaaagtttgctatcgatgcagaaacgttacggtcgtatcaagaattaggcaattctgtgagttacattgtcgatggcctacaagtcattggggtcattacgttcggctcatcgcttaataacgcattgctagccgttgaccgtctctttactgagcaaggattacaagtgcgcatggcgacggccgatacgactggttcaacaatgcaggtgaaaaagctaatgggctcgttaacggaaaccgtcgctgatttgacgccagcgggtaagcaagcccaactggtggcttggttgaatcaagataatacgatgttgattacgaatcaaacattgcctgctgatgtgcaaccaactattacggtcgcggttggtgatcagcctgtcaatgcagacattcacgttgcgacagtgaccgatttgcgcaagctttgggacaccactgaagcactctttagtacggataccaaagtattgcgttggacgtcggtggtgatggtgctgtttctcttgctggcagctggcttaggaatctttatttcaccatatttctttgtggcaccagttgttgcaacaatcttaagattagcgctttcattgacccttttaacggtcgttgaccccgaatcataacaaatgttacaagcgtaaaacaaggcacccgccacaccgccaaaaggttgatgtggcgggctttttgtaagcgtcacagtttccgcttctaattgacttattatggggaaaagcctaaaatgaaacctgtgttaataaagcgcaaaaaaacactatcgatttgacataaacgtcaactctatagacaggagatacaagatgaacattgcaatgatcatcctgctgtcgcttgtcgcaatcgtaatcggtgttgtaattggatatatggtggctaagacacggattaaccacacattgacgattgcgcaccaaaccgcatcagatattacgagtcaagctgccactgatgccgagcagatgaagaagtctgctttggttgaggcacgagatgaaagccaacgttaccaagatcgtatcgaacgtgagcttcaagaacgccgttcggaagtgaagtcacaagaagatcgcttggtaagtcgtgagtctgtattggatcgaaaggacgcctcattgcaaaagcgtgaggaagttatttcggaaaaagaaacgaaacttgatcaacaacgacaaagtgtcaacgacaagcagaagcgtgctgaatcattgattgatgaacgcgaagcgaagttggtggagattgcaaacttgagtcgcgaagacgctcgtgagcaaatcttgtcagaaaccaaggaagctttggtttctgaacgcgctgtcatgattaaggaaagcgaagagcaagctgcggccgaagctgaaaagcgggccaagaacttggtagttagtgctatccaacgttctgctgcagatatggttgctgaaacaacggtatctgttgtgacgttacctaacgatgacatgaagggacgaattatcggtcgtgaaggtcgaaacattcgggctatcgaaacggttactggtattgatttgattatcgatgatacaccagaagctgtggtattgagtggctttgatccagtccgtcgtgaaattgcgaagaatgctttggagaagttgattgctgatggtcgtattcacccagctcgcattgaagagatggtggagaaggcccgcaaggaaatggacgagcacatccgcgaagtcggtgagcaaactattttcgatctcggcattcatagcatgcacccagacttgattaaaacaatcggtcgcatgaactatcgtacaagttacggtcaaaacgtactggtacactcaattgaagtcgctaaactaactggcatgttggctgctgagttaggtgaagacgttacgcttgccaagcgcgcaggattattacacgatattggtaaggcgattgatcatgaagtggatggttcccacgtagaacttggtgttgaaattgccaagaagtacaaggaacgtccagttgtggttaacgctattgcctcacaccacggtgacgtagaacctgattctgtcattgctgtcttggttgcagctgctgattcaatttcagctgctcgaccaggtgcacgttcagagtcactagaaaactacgtgcaacgtttgcaacaacttgaagccatcgcaaatgacttcaacggggttgaaaagtcatttgcgatccaagcgggtcgtgaagttcgcgttattgttgagccagcagctgttaccgatttggaagcaactgttttggcccgcgatatcaagaatcaaattgagcacgatttggattatccaggccacattaaggttacggttattcgcgaatcacgttcagttgaatacgcaaagtaagatgaaaaagctaccaatcggtttcggttggtggctttttttgcgcgtttttgtgtctttagcgatttggctaaaaatatctagacaaagtgccatatcgaggcaatgggtcttggtgcaataataatcacgtagcaaaggaagcgcttacataagtgctttgttaaaagttcataagggggaaaatcatgaacaatcctgcgattaatgttaattctgaaatcggtacactcaagtcagtgcttttgaagcgacctggggccgaggttgagaatatcacaccagacacaatggaacggttgttatttgatgacattccatttttgaaaattgcccaagaagaacacgatttcttcgccgatacgctgcgcgataatggcgttgaaacgttgtatgtcgatgatttggcggttgaagcgttagatagcgatgacgtgattcggcaccggtttgtccagcagtacctggatgaagctggctacggtattggtacgacacacgatgccttgtttaactacttggagacgtttgatactcgggacatggtgacgaagttgtatgccggtattcgacgtaacgagtttgattttgaaaatgattctttgcatgatttggcaggtcgcgatgcggcgaacccattcttattggacccattacctaatgcgtatttcacacgtgatccgcaagcttcaatgggaaacggtatcaccattaaccacatgacgtataaggcccgacaaccagagtcgttgtttacggaatttatcatgcagtatcacccacgctttgctgggcatgtggatatctggcgtgaccgtaaccacaacacacgcattgaaggtggggatgaattgattttgaacgaccacgtgattgccattggggtatcgcaacgcacgtcatcaaagtcaattgaagccttagccaaggagctgtttgctaatccaaatagccactttgatacggtggtcgctgtcgaaattccgcacaaccacgccatgatgcacctcgatacggtcttcacgatggttaaccgcgatcaatttacggttttcccaggcattatggatgccggtggtcaaatgaacattttcattatgacgccaggacctgagggcacagtgaagttggcccaccgcaccgatttgggcaagaccttgcaagaagtgttggatttgccagaattggatttgattgaaaccgggagtggtgatgaaattgtggcaccacgtgagcaatggaacgatggatcaaatacgttgacaattgccccaggtgaagtcgtgacctacaaccgaaattatgtcagcaacgaattgttgcgtcgccacggcattattgtgcacgaagtgatttcaagtgagttgtcgcgtggtcgtggtggtccacgttgcatgtcgcaaccaatctggcgtgaagatttgtaaccaacagacaaagatgaggagtaaaaatcatggcaattaattcagtatttcaaggacgttcattcttagctgaaaaggacttcacatcagctgaaatccaatacttggttgattttgggttgcatttgaagacattgcaaaagaatcacatcccacacagttacctagagggcaagaatatcgccttgctctttgaaaagacgtcaacacggacgcgttcagcctttaccacggcagcagtagaacttggggcacacccagaatatttgggggccaatgacatccaattggggaagaaggaatctgttgaagataccgccattgtgctaggcagcatgtttgatggtattgagttccgcggcttcagtcaggcggatgtggaaggactggccaagcattcaggtgtgccagtttggaacggtttgactgatcaatggcacccaacgcaaatgattgccgactttatgacggtgaaagaaaatttcggtcatttgcgtggcttgacactcacgtttgtgggagatgggcgtaacaacatggcaaactcattgttggttacgggggccatgctgggtgtaaatatccacattgtcgcgcctgaagaattgcatccaacgcaagaagtggtggatttggccaacacgtttgcaaaggaaaccggagcagagctactcgtgacagctgatatcgatgcgggcgtcaagggttcaaatgttatttacacagatgtttgggtatcgatgggtgaaacagactgggagacccgtgtgaagttgttgacgccttatcaagttaacatggcgatgttgcgtaagacgggtacgccagatgatgagttaatcttcatgcactgcttaccagctttccacgacgtgaatacgaagtacggccaagaggtgcaagcccaatatggcatcactgaaatggaagtgacggatgaagtcttccgcagtaagtttgcgcgtcaatgggacgaggctgaaaaccgcaagcactcaattaaggcaatcatggcagcgacattgggtaacttgtttattcccgatgtgccagcgcttgaagaaaacggtaagtagctatggcagatactaaggatcacgggattgcgctaccggccttagttgcccttgttattagttccgcaattggagccggcatctttgatttaccggccacgcttgcgcaaggggcaacacccggtgccgccatattagcctggattattactggggttggcatattaatgttagcgcttagcctgaataatttggtgttgaataaacctgaattaacgggtgtgtcagattacgcacgggctggttttggtgactttgctgggttcatttctggttgggggtactggctatcagcgtggcttggtaatgtggcgtttgccacgatgttaatgtcagcgctagggtactttttcccggcgttgcagtccggcaatagtgtgccagcaattgttttggcgtcactggtgtcgtgggcgttaacgcttttggtgacgcggggtattgaatcagctgcggcaatcaacacgattgttacgattacgaagttggtcccaatttttgcctttgtggtggtagccattttgagcattaaggcgggcgtatttacggctcatttttggcaaaatatgagcaccaatgtggggggaaaactcgtttttagttcagcgactggtgctgggattgccgagcaaatcaagaattgtgtcatggcaatgatgtgggtgtttgttggtattgaaggcgctacgatgatggcggcacgcgccaagaaaaagtctgatgcgggtaaggcgacaattatcgggttgatttcgttgctgattatctacatggttgtctcgatcttgccatatggctacctctcattgcaggagttgcaacatgtgcagcatccagctttgttgtacttatttgaaagtatgacaggtccgattggtggtgcgtttatcagtatcgggttgattatctcgatcttaggggcatggttgtcatggacgatgttaccagtggaagcaacgtcattaatggcagaacagggtttgttacctaagtggtttggtgttttgaataagtaccgggcaccgcaacattcattgttgttaactcaggtattgattcaaatcttcttgattacgcttttgtttactgacgaagcctataattttgcctactcattgtgtacagcagcgatcgtggtttgctatgtcctagttggggcctatcaactaaagctggggttacaactgaaaaagctgtcggttattctgccggggctgattgcagttgtctttgaagtgaccgcgattgtattttcgggcatgcagtatttatggctctgcacaattctttatgtcttaggcttcatgctgtatgtgagagcacggcgagaagtccaacaggcgatttcaaagacagagctcatgatgatgggtgtcgtgattgttcttgcactaggtgccattgtggccttagcaacggggaacttaaagatttaagtaaaggagtgtcacgaatgacgaaacgactcgttgtggctcttgggggaaacgccattttgacggatgatcccagcgcagccgcacaacaacaggcaatccagcaaaccgcgcaacaattgattaatttcttagcagctggggatgtgcaacttgttttgactcatggtaatgggccacaagtcggtaatttagtgctccaacaattacaaggtagttcggtgaagaacccggcaatgccgttagatacggttggggcgatgacgcaaggcgaaattggcttatggctggccgatgccttgaattatgaaattagcagtcgtggtttatcacaacgggtggccacggtattaacgcgcacggtcgttgacgaagctgatccagctttccgtcaaccaacaaagccaattggtccgttttacacggttgctgaactaccggcgattaagcagcagtatccagattggcaatttgtcgctgatgctggccgtggtttccgccgggttgtcccatcacctaagccggttagtatcatggaggccgctgaaattcaggccttggtacaagatggcgtgacattaattgccggcggtggcggtggtgtaccggtgatcgaaaaagaaggtcacgtgacaggggtcgaagcagttattgataaggattttacggcagctaagctagctgaactggtcgacgccgatgaattgttgattttgacggcggtacgttatgtggcgaaggactttaaccaaccgtcgcagacgatgatcaaacggattagcgcgacggaaatgcagcaattagtggatgccggccaattcccggccgggtcgatgaagcctaaggtggaagcagctattagcttcgtacggaatacggggcggcctgccgtcattacatcgcttgataatgtgcaagcatatcttgctgatggggacgggacagtgattgtgccagattaatcgagttatagttaagcgagcggtcatgctcgcttattttttcgtaaacccaaaaaatttaaggggctgcatgcatgaggacgcttataattaaggaggagagtttttgagctgcgatttcaagggggaaatacaatgctacaaaatttcatgacacagtggctgtatatttcagactacgatacagccttggaccaagcttttattagtaaagctaaaataaacggtgttgatttggaacaacgctatatagcggttgttttaagtggggatcaacgccggatgcctgaacatcgcttggcgcttaatttggatacgaagcgccggatttacgttttgtcagtggagggggtgcaacctttcttggatgctctggcaccggacatctttgcgggtgtcgggggtgcgcactttgatatttcgacaggtatcaaagaagcgttatttgccgtgctactgaccaacgagtttgagcgggttgtcatctttaatcgggttggttatctgtacgatttggtcaaatctgatttggcctatccaaatgttgcagcgtactatgaacggattgatgatgaaacctggttgacgttttgggaatatgtccagcatctgtcatcaacaaaggagacagcgtgtttaatgttggtacatcccaagacaattgtttataggctaaacaaaatctgtgcaactactggactgaacccgaagcaaggcgttgatttgttgccattgattgtgacctatgttcgcaaacagactgcctgttttgataacttggtaaacgagctacaaagcctgtcggacagtttgttgccacgggataaagtggactagcccgctagtatggtcaatgaatggctactacgacaaagtagacttttcccggtaacaagttctaaaattgtggattttctctcgtaccatgttgcaaggttgtataatgaccgtgagcaatggcttttaggaggggacctattatgcaaacgattaaaactttgggattaacgttaggactgttggcactaattttggcgtctattttcttacactgggggattgttgtgacagtcattattatggctgttgcgacgttgaccttaatttatgccacacaacatcgagataaagcagactaatatattagtaatggctaaaatgctaccaattattaaagttggtagcatttttttgttaaaaatcgaaaaaaatctgtcccataatcgaaactaattttaatgaaagggtttacattttaatggaaagcgcttacaataatatttgtgttagagacacggggaacgcaatgttgatgatatagactgaaaacgtttaaggaatcggggaccgtgttgataagtaacgtcgtcatgtttcactcttgctgttcgagtaatcgttcaatatcttaaaaactagctgaaaactcttctccttcagaaaataccgatcgatgaaatttctctccaggaaatattcgaacagcaagagggtgatgagacgactctttatcaacatcaacgctttcacaatcaaaaaatattttgtgggtcgtcaaccatacctgagccatatcgcggatacgcggtgtggcttttatattatctatcatgttattctagtgacataactgatgaggagatattagtcgttatgattgggattattttgacggtgttggttgctttggaagcactttacatcatgggcttagagatgtttgggtcgccaaagaagcaagcggaaacgtttgagttagaggaagaatttacgaaagtaccagaagtacgttcattgttgggaaatcaaggcatttacaacgggatgttgggtgttttgattttgctaacgatggttgtgctaaatggcgcagctgaaatgacgatgttgaagctctttatggcttacattatcgtggttgcgatttacgggagcatgacagctgccaagaaaattatcttggtgcaaggattaccagcagcgctcgcattgttggcattgatcttgcacatctaacggggaaaatggggtttcgagagttattattagcaaaaatttaagaagccccctatactatagttattccccgtggtagttacgctaatgactatcagtacaaatatttgtacgacgcgccgtagatatacggcgcgttttttgtgtggtttgatgatgtgtcgtgctaccgcacgagcaacaggcgtgacgtagcgattgccaggggtgaactcacaagttcggccgatcgccggttggataaggcgatcggacccaaaccccttaacccaattagttgggtgctagccggtgctcgcgccggcggagtttacccctggcaatctttggcgaagtcacaccccacccaccatgcttcgtcgcaacgcgacgacatcactaaaccgaactttccccacgtaattaaaaaattaaccaccttattgttttgacatggcatattgttcgttgtatagtatgtgttgtaatataaatgaaacaaaacaaaagatattaatcagtggggaaacgaacatgacagaaccagtacttattgcggataaactaaataagacatataccagcgcagccggggtggaacaacacgttttgaaggacttgtcattgactgtcccacgtggtgaatttgtggccattatgggaccttcaggatcaggtaagtcaacattgctcaatattttgtcaacgttgatgaagccaaccgaaggggcagtggccattaacaataaagatatcctccacatgactgacgatgaaatctcaaatttccgcggtcgtgacatgggctttattttccaaagctacaacttgattgaaagtttgacggtgcgtgagaatatcgcgttacctttgactctccaaaaagcaaagtcacgggtgatcaacgatgccgttgcgaaggtggcagcattgcttcacatcagtgagtacttggataagtacccatcagagttgtcaggtggtcaacaacaacgtgttggagctgcccgtgcgttggttcacgagccagctttgatttttggtgatgagccaacgggggccttggattcagaaaacgctcgcgaaatgatgaattatttgacgacgattaaccaagaacgtgaaatctcaattgtgatggtgacgcacgatccattctcagcgtcatttgcctcacggattttgttcctgacagacggtcaaattacgaagacgttgacgcgtgatgatcgttcacgtgaagacttttataactatgtgttgtcagaacttggcaactttaactagtggggtgataacatgtttcaaattgctttaaagtcactccgcgcgaagtggcgtgattacaccgtgcttttcgtcgggttggtcatttcagcagctatcttttacatgctgagtgccatcgcgttgaaccgtgattttttgttaaataattcatcaattggtctgattgtgccagtctttatggtcggtgaatttttgcttggtgtgattacgtttgtgtatttgaattttgccaacagtttcctgttgcggttgcgtcagtctgaatatggcttgatgtcaatgttgggagcgaagaagtcacaaattggtgatttgttaatgcaagaaacgctcgccttgggtgtcatctcaacggtcattggtatctttgctggtattgggttaacagctgccagtggtaatttcttgatgaatttgctggacacgaagttggcaaactggtcagtcttctcgtttaacgctgcattagcaacgttggtattcttcgtggcattgttcttcattaacgggctctacaaccgtggtcggttgagcaagcaagatacgttgacgttgttgacggcagataagcaagtttcacaaccaaagcgtcacaagcttcttgatccattgcttggcttggttggtttgggcttgttgattcttagctatgtgatgatgccaggtatcgtaaatcttggtttgtacggttttatcgttgtcctggtgcttaacgtctggggaacgtactggtttgtgagccggacgttgaagatggttacgtatgctttgcgtggctcacgtttcaataaccgtggcttgcggtcatttttgaacggccaacttttgttccgtttacctgaataccaacgtattttgacggtgatttcagttatgtttggtttggcgcttggtgcaatgtcagtgggacaagggtattatcgtgccttgccacaacaagcacagtcgggccaaccattcacggcggcctacacgtcagataaaattagcacatcaaatttgaaggacatcacttgggaagctacttatcactacagtgtgaacaagggtaaggtgtactttaacggtgatgagtttaacgaaaagaagttaccaacggttgttgagaccggtaagggtaatgacacacggattaagtggttaacgggtgattacttgttagcaacgccaggttccgaatacacattaaccagtattgctaaccaaattttggataagcaatatggtgcaacagcggttgtgacacacaatgagtctgaaatggccgttgagggggatgtgaaatcagttcgcttggtgacggttaagagcttcgccgccaacgaagcaacgttgacggcgaatgcaaagcgtgaagctcgtttgaccggcacagcaatgaatcaccaagccggtgtgccaggtatgtttacgttgcttaagaacgtcttcggcggtttggaattcatgggcattttcttaggaattgccttcttggcgatgctggcatcaacgttgatgtttaaggtattgtcaggggttgctgatgacaagcgacgttatcgcatcttgacgatgattggaacgagcaagcgtcaagtaacggctacggttgtgaaagacttgggcgtcttgttcttcattccgttggttatcggaacgttagatgtcattttcggtctaccaatgttcaaagcattaatggcggatccatacgttggctttatgccatcgctgattgcaattgtcgttttgtacgtcatttactttgtcatgacggtcattttgtaccgccgtttgcttaagtaatattagatatgaaaactattctgaaagcgcgataatcaagatataaaaaggatgataaattaatgcatttaaaaagactggccaaatttttggtcagtcttttttgaatgattgtgtgcatgtatttagaatttacagattacggtacgtacaaaagcaagagttattgaagtccggcttgcatttttgttgccaaagcaaatgaaccgtcgctttgcttaatgaaactcaacgtaactgttttggtcacatctgttattggcgcattatctggtgcgtttgaccaagtaactgtcatagattcagcttgcatggcattagcttcgtttcggtcttttgcttgtggttctccaaatttttctacaatgttttggtaattttcaccacctgcaccggttaacagatcacctgattgtaaagccgaataattatcaaatgtccatttaaattgattattggcatccttaatcttggcttgacgtgcaacttcagcattgtgagccttgtttatcgcgacttgttggttatacgccactgtttcggatattatagccatgacaatccagagtaaaattgcaatccaactaatggttttcttatttcgtacattgacgatgatcgacccgattgataataccaacgctaagacaataacgatcaaaaacaatatgttcttaaaaatacttgtggatgttgtaaaaccaaagtagattgccaatgccataacgattgcgtcgatgacaattgcaacgattggtagagcaataaactcattattagctgcttgtttgttctgacgtgtttccaaaatcttaccctccaataattatcaaacctcatttattatagtcggaaagagtgtcaattacagaattttagttttttaaaggtattatgtatcgtgatttcggactgatgaggagaataaattcatgtatttcataatatggtgaatttaatttaggattgacgtagcatagatgtgaattgatttatttttgatcctgtatacttccatttcgacgttctgagaagttagggattactaagtctgctaatgcacgctttttgtagttcttaaattattcatgtaatttaagggcagatacggtataatgtaagtattcaaaatgctgtggagtaaatgacgtaaaacgtttgtttgagacatctacgacacctgaaagcaggttacctaaacgcgcaaggtagcctgctttttttgtacgtgcgcaatcaggcactttcccgtaaaatgaaggggctggggaaagtgttgaagtacaggggaaatcttatgcaaaaaacagctaaggttggcgtgtttattatcatcgtcaattttttaatttatattgggctcgggctgcctgattctgtgttagggagcgcttggccggcggtacggcaaacttatcatgtgaatgttgactatgttggctatctaaccgcaatttcattagtctgttcatttggttcaactttgctttatccgaaattatcggctaagctcacgatggatcgcattatgatgctaagcatgtggtttgtgttaatcggcttgttggcattgatgtggggccaagctgtctggttgttaattgttgcggcgaatgccatggggtttgggcaaggcgctattgatatcgcagtaaatgactatgcggcaaagcgcttttcaagtggcctaatgagtattctgcacggcatgtatggggtcggcgtaacgttgagttcattcgtgatggccctgagtcttgtgtttccgatgggctggcgtttgggtgtgttaagcgtcatcgtgctgcaagtcgttatcatggcggttgttatgagctcacgacaagcctttcgggggtctgatacagctgtaacagatgatgaaatgactaccgtgaaactgtctggttcagattggctattgccggttttctactttgtctacggcgttgagttggtgattggcaaatatgtctctagttttgctgtggatcattggcaatatagcgcgacaacagcgactaatgtggcgacattgttttgggcggggttgatggtcggccgtttcttgaccggagtgacaacgcgctggcaatcaaatcggcggttgattctaacgcatattattttgacagccatagcgactggcatgatgtttttgccagttgaggcattgctaccgttcgctggtttcggacttggcctgggactatctgccatctatccgttgatgatgatggtgccgtatgcgcgctacaatgaccaaaaggcgaagcgggtcgtcagttggaacttggctttttgccaagcggggatggtggtcttaccgctagtaactgggtggacttaccaagctgtgggggcgatgagtctaccgattattatcctaattttagtcggcgcaatgcttggcttgggtagcgttattttgcgacaacattaataacagtgaaaaaggcaccgtgcgatgaatccaatcgcgcggtgcctttaatttatgattataagatggcgccagtccacttcttcatggcgatgttggtaaagtcaaacttttccaaagcagcgaaaccttctgttgcaaggtcaacgtttgaaacggccccgtatgacaacattaagttaaccgggtgttcgttacgatcaccgactgtgaccaaaatagcaggcttgtttgaagcagtcatgtaaccaacttcaaatgccgtacctgaatctggatcagccgcatcgataaaggccacaatcaaatcagcgttgttcatcgccgtgatgtcagccttgtaagtcatcgtaccccattcgaagtcgggttcaaaatccccgtctgcttcgataacttgtccaccgtattggttaaggaggggaacatagatatcgttaattgttgggttagccttcaacgcttggtagccttgcatcaagatattttgttggtcttcgttgaaccaacctgcgccaagataaatgttgcgagtgcgttggccaacaacttcgctggcctcagcaatttgcgcaagttcagaaatcaattggtgttcagtaagcattaaaaattccccttatcgtatgattattaatagtatagcaatattttttgaagatattttggtgaccaacatgtttttaacagcgaaatgcccgcgcctgtaaggatgacgacaggtaacgcgaattttttaaattgttttgaaaaataagatgtcgaatataaagggcggttaggatagcttgaaagttaattttaaccgtgttatattaggtttaacttaacgaagataggtgaacaatatggcagataaacaaacggaatatcgcatgtggcacggtcggttggcggcgctacttgcgagtgaaattgaagatattagatacgatgcttttaacgaatttgatgccaaagtcaatggtggcttgattccggttgtcgcgtttaaaacgatgcaacgtgattttgtgttgccaattattcaagcgcacaacctagacatgagtgatttttacgatgcagaggcaagcgtcttggggagtgtttcgttagctgatattaagttttgggcgaatttagcgacccgaattggtgtgagtgctgctaatggcaattggcaggcccgcgataagaaactgtacgtctagtcttggtgggtaaccgcaatttccaatgtcacgtcgatttcacgaccgagcgcatcataatgcccatacgtcggataagtggcgagaaagccaatcgcaggttcttctgattgctgcgctaaatcggcaatgagttggcgggtcttggcttcatcaaatgggatgttgcggatgtccgcgtcaagctcgacgtcggctaaaaacaagtctaagtcgtcattgctgaagagtggttcgcgttcgtaaagtagggtgtattgcatatcatggcctcctgaaaatcgtgctattaagatagtacttattataagaggataccaggggtgcgtgctatgattatggtacaaactacttaagatagggggacaacaattatggttgaagcacaacatcaagaagcaattgagcaggtcattttgaatttgaaggcccaagttgccgggttgaatcaacaaatcgaagtgttgtcaaagttattagaagttaaacacgaagacgttaatattgacgatgtaccaggtcaattgaagcgtgcggcgactgaagtaatgaacaatgatcatttgaagatgattttggttcgtggtgagaattacgaattccgtgagcgcctgattaaccaagcgttcgatactggtgtgaccattgttgaagttgagcaattcatggaagactatgaagccggccaacgtggtggtcaagtaggggcgcaaaagttcaaggatcgttatgacgattacgatgtcctggtgattgaaaacttggagcaattagccggtaatcgtgctaagttgcaagaagaattattcgatcgcgtctatgcccgttcacacgctggtaagttgacggtgctatcaggtaatgcggcctttattattggcggcgaatctgaagagtacttgcaaatgttgagtttgggtaagaatatttttgtgggctaacaatagccaaaaagccggtgggactttgtgtctcaccggcttttttaggctgtcgtggccccgtgtagtaattctggtacgacgtaaaccgatgttaccgtttcgccagccaactgtttcatgagcaaagcgaccatatgttgggcgatggttgcaagcggttgctgaatcgtcgtaagcggcaactccgctagttgatggatgtagataccatcgaaaccaacaatccctaaatcagtaggtactgttagtccctgactacggccagcccgtaatgcccctaatcccaaccgatccgtggcagccacgataccggtattaccgcacagattcaaatcagctaaaaaggcttgggctgcgtgctcatcatttggcagatgataaatctcagttgtccgaccagctgttaacatcgcgtcacggtaaccaacctcacgattaatagcaaatggttcagacatatcgatgccaagataaatcaggcgcgcataaccagcgtcgagtagggcgttggtcgctaattgggtgccggccttattgtcgatatccactgacgggattcccggttcagtaccataaatgacgacagggacggttaaactctgcaagagctcaaaatctgatccgcgtgcgccactgactaagaaaccatccacattcgttaaatcaaaattacgatcgtgccgcatttccaatgtgtaaccagcgtgccgtaattcatccgttaaatgcatcaataaatgcgcataatatggttcgatttcattgatatcatctaacaagatgaaggcgatattatagtgccgattgttggcaagcgctcgaccagcccggttttggacatatcccagttcggcaatcacttgccggacatcagcaataatctcgggtgatacctgatcagggtggttgagaacgcgtgagacggtcattttcgaaacgtgagcagcccgtgccacgtctaatagtgaaaccataatgattctcctcaaaaataatgaaaacgttttcaaaacaatctatttcaatcataacacgaaaatatgaacgagataaggtcactctgggaaggcgaagatgttaccggtaacatcaagaaaacgctttcatttgattttagggtcggctatagttggatttgtaaataaagcgcttacatttgcaaacaaaaacacaatggattttataaggggaacgaaaatgacaaatgaggggactcgtcaaaagctaccaacgttaccattacataccatttggatgttgagtttcgcattctttggggtacaaatggggttctcattgcagagctcaaacttgggacgactattacaaacacttggagctgatccgcactcgctggggtggttctttatcctaccaccggctgccggcttgttcgtgcaaccaattattggtcgtttatcagataagacatggaatcgatttggtcgtcgtatgccgtacctgattattggaacggttgtgtcagctatcgtgatgttcttgttgccaaacgcaggaaacttgggcttcaaagcaacgatcgcgttgatctttggtgccatcaccatcatgtttatggacacgtcattcaacatggcgatgcaaccaatcaagatggtcgtcggcgacacggttaacgaagaacaaaaaggttacgcttattcagtgcaatcattcttagccaatgctggttcagtgttagcctcaattttcccgttcgcattgacggcgatgggggtggccaacacggctaagccaggcgtcattccagattcagtggcgatttcattctatgttggtgcgattgttttggtgattacaaccatcatcgcgttgattaacgtcaaggaatacgatccagaaacgtatgccaagtatcacggtattcaagaagagggtccaaaagaaagcgtgatgcacttgttgacgcacgcaccaagcattttctggaagttggcagttgtacaattctttagctgggtagctttccaatatctttggacgtacggaactggggcgattgctgatacggtttggcatgcaacggatgcgcattcagccggctatcaagctgccggtaactggttcggtgtgttgagtgccgtgcaatcaattggcgctgtactttgggctttggttttgactaaggtgaagccagcgcaagagtgcttcgcctatggcggtagtttgctactcggggcgattgggtttggttcaattttgttcgtccacaaccaatgggctttgttagtgtcattcatgttaatcggctttgcctggtcagcaattttggcttatccattcacatttttgacgaatgcgttggatggtaagaacaacggcacatatttgggtctgttcaacggggccatcacaatcccacaaattgtggcgtcagttgcctcatttggcttgttcccattgttgggttcatcaatgccacacatgttgttagtttctgcaattgctctgatcattgcagcattgtcagcggtgcgtttgctccgtggtcacgtttaaaaataggggaatatcatgaagcgaatttttgaagttaatccttggacaattacctcgcctgagttgcaaccagcggacaagcgtttgcaagaatcaatgacgtcacttggaaatgagtatatggggatgcggggcatgtttgaagaaacatattccggcgactcattgcaaggcgtttacattgggggcgtttggttccctgacaagacgcgtgttggttggtggaaaatcggctacccagagtactttggtaaggcgattaacgcgttgaattttgtgaaagcaattattcaaattgatggggtcacggttgatttagcaacggtaccttacactgattttgaagtctctttggatatgcaagcaggtgtcttgcaccgtcaatttacggttaacggtgtgcaggtgcaagtcgatcgtttcatctcggttgcgacgaaggaattggctgatttgcggtggtcattcacagctattgatgggcagacccacgatgtgcagttgacggcattgattgatggcgacgtcgtcaatgaggattcaaattatgatgaaaaattctgggacgtgcttgatgcagaagtaaccaacgacacggcgttcttaatgacgcgaactgtgcccaatccatttggtgtgccccaatttaccgtggcggcccggcaacgatttgtgtcagatttgccagcaattgatgtcgtgcaagaagacaaacaagttggaaacgtttttgcggggcaagttggtgcggcaacacagcgcattgaaaagcgggtgattgtcacgacgtcacgtgattatgcagatgacacggctgttaagcatgcgactgacacgatttttgctagcattgcatcagcaacctatgacgacttgtatgatgcacatgtggctggttgggcggcacgttgggaaaaggccgacgttcagattactggtgacgaagcggcccaacaaggtattcgcttcaacttattccaattatttgccacgtattacggtaacgatgcccgcttgaacattggaccaaagggctttaccggtgaaaagtacggtggggcaacttattgggatactgaagccttcgcgattccggtttatctgggcgtgaccgatccagccgtagtgaagtcattgttgcagtatcgttatcaacaactacccggggcttatcacaatgcccaacaacaagacttagccggtgctttgttcccaatggtgaccttcgatggtatcgagtcacacaacgagtgggaaattacgtttgaagaaatccaccgtaattcgacgattgcctatgctatctacaattacacccacttgacgggtgaccgttcatggctggaaaacgaaggtagtgaagtactagtcggcattgcccgtttctgggccgaccgtgtgcactattcagcgcgcaacgacgcgtatatgattcatggggtcacgggaccgaacgagtatgaaaacaacattaacaacaactactacacaaactggatggccaagtgggtgctgcaatacacactggacaatgctgacacgtttgcatcgaagtatcaggaaaagttggccatttcggcagaagaaaaggcgcaatggcaattaattgtcgacaaaatgtatttgccagaagctgatgtgaaggatgtcaatgatgtggatcggcatatctttgtcgcccatgacacgttcctcgataaggaattaattccggttcgtgatttggatgcctcacaattaccaatcaaccagcactggtcatgggatcgcatcttgcgctcaccgtacatcaagcaatcagatacattgcatgcgatgtattatttcccagatgccttcaccgagcaacaaaagcgagataattatgaattctacgagccatttacggtgcatgaatcatcattgtcaccatcggttcacgctattttagcagctgacttgaagatgcccgaaaagagtgtggcattctatcaacgcacggcgcgcttagatttggataactacaataacgatacgtctgacgggttgcacatcacgtcaatgacaggtgcttggttgtcgatcgtccaaggatttgctggtatgcgtgtgcgtgatgaacaattgcactttgacccattcttgccagctgagtgggacggttataagttccgcttcatgttccgtgagcgtttgcttgaagtggccgtcgatcacgatggtgcgcaagtaacgttaatttctggtgattcattgacgattgacctctcaggcgaaaccgtcgcattggaggtgcaataagatgactaaatttgcagacattaaggggtttgcgtttgatttggacggtgtcattacggacacggctaaatttcatacgattgcctggcgtcatttggcggaacaactccaagtgacttggacgccggagctgcaagaatcgttgaagggcattgaccgcatgggcagtctcgaaatgattttgcaagctggcggtaaggaaaatgcgtacacgcaagcagaaaaagaaggctttgctgcttggaagaacgaacactatgtcgagctcatttctgatttgacgcctgatgatatcttgccagggattgccgcttttattcaggaacttaacgataagggctaccgggcgagtgtggcatcggcgtcaaagaacgcaccgtttatcttggatcgactgggcttaacggatagctttgtcggaattgttgacccagcgacgctacatgctggtaagcctgatccagaaatttttgtccgcgcagctgaaatcttaaacttgccaccagaccaagtcattggcttagaagatgcggcagccggaattgcgtcaatcaacggggccggtgaaatctcgttgggaattggggatgcgaccgtcctttcggcagcggaccttaatttcgccaacacggctgaggtcactttagctaacatcgcggcaaaacttgattaattcacaacggttgataatctcaaaaaataaacgactcaaataagttttgccactaaaaggccgtcggtttccattgcggagactgacggccttttactgtgatgtcaaaaataatcaggataactagcaatgacggccagttgatcagcaatcatgtgctgtaagtgggtgtgtgcgatgcggtatgccgtgtcagcatcatcatgacgcaacgcggttaagattgcttggtgttcagcaatcaacgcttgccaatctaagcgttgcgatgccactcgtaaccagcgaaaccggtcgagttgtttcgataaatcttttaaccagcgccacagtaattcgtggcctgttcgctcgtagaaaaattggtgaaacgcctcgtcccgggcaaaaaaggtcgcggtttcgtttgcatcagtcgcttgttcaactaataagttatccaaccaatctaaatcagccggtgttaaacgggttaacgcatcacgcatgatttgcggttcaatttgttcgcgggcatagcgagcttgttcagcgatttgtaagtcaactttcgcaatgtaggtaccggattgcggcaccacagtgagtaaaccttcagattttagttgcaagatggcttctcgaatgggcgtccgaccgtatggcaaatcagcagttaacttggtttcagaaattttttgacctggtaccaagtcgaaggtcagaatttgttggcgcaacaggtgatacgcttggtcgctttgcaggggagtgtgagtttttcgtgtcgtcggcatggcgatactcctagtttagtgtttggtttttgggtgaattgcaaacaaattatgaactgtttcgttgattttgatactgttttcacaatccggaatataagaacgaatacattataaccgagcatggcatgacctgtatatacgttttcactggaaaatgactgacagtttcagcgtgcacttattatgtgaattcagtaacaagttgtcacggaaaatgcaaacggttacaattctttgtgttgaaactaatatatcagtttctgagattatttggttgattttactttgaggagtgacgatatgtcaaaaaaacgtatttaccaagctaagccgatcacattaggtcgagcagttgcttatgggttgccggatttgatgggaggtggtgcctttaccatcatcggcgcattcttgttgtatttctttacaacgtttgctgggttgactgccattcagggggccacaattattggaatcgcccgaattgttgatgcggtgacgtcgttggtaatgggaagtcttaccgacaatttctatcggacccgtttaggtcagcgatttggtcgccgtcatttcttcttaacgattggcgcaccactcatgtttgcttatgtgctgatgtggatcccaaacatggcgtttctgtactacctagttgtttatttgttgtttgagattattgccgcctttgttttgattccatgggaaacactcccaactgaaatgtgcaaggattatgccagccgtaccaagttgtcatcagcgcggatgttcatttcagccgctggaacatttatggcgactttcgtaccgggccaagtcattcgcttgttgggtgaaaacaatgcgtcagcgtacttcattaacgcattagtttttgctgcaatctttgcggccgcgatcttcattacaaacatgaatacgtgggagcgtgaagtgacggaagagatgattgctgaatttaacaagcgtccaaagttgaacccaatccagaccgtccaaaaggaaatcaaggattacctctcaacgttgcgcatccgttcattccgcaagcacttggccatttacttgttctcattcactggtaaggacgtctttaacaccatttttgcttacttcgtggtgtcttgcttaggtttgacagtgactgattcagctaacattttgtcattgagcttcgttggtatctttgtcacgattggggccggggtcttgatggtgaagaagggacctaagttcttgttcttatcagcctacagtttgatgttgctgatgctggttgccttctatgccgtattccaattgcgtcccgaaaacatgttgatgtggttgctaggaatcggtttggtttaccaaatcggtcgcgccacgctggagtttacgccttggaacgtctttccgttgattccggatttggatgaattgttgacgaagcagcaccgtgagggaattttcgcggcggtgatgacctttgttcgtaagtcaacggtggctgtggcaacatttgccgtcggtgtcattttggaaaagggcggttacattgctggtgaaacaacgcaaagcctcgctgctcaaaacacaattgctggtgttttggtgattggaactggtggattgttggtgattgcgggtgcatttgcgatgacattgcaattgaaccgtgaaacgcacggtattgtcgtggccgaaattgatcgtttgaaggctggcggtgcgaaagcagacgccacaccaaaggttcgtgcggtggttgaagcactaactggttttgattatgacgatgtttgggatgacaaaaatgtcccaacagtgaaaacagcgcgggctcgcgtagacattgaggaagattaaatcatgaaactaactgataactatatgacagaacgagaagcgttcactacgatgggcattgaagtgccaacgtttgaccaagttgacttggtaaagacagctaaggtgaccccaacgtgggtgcactttgggggtggtaatttattccgtggttttcactcggaagtggcccagaaattagttgctgctggtgaattgccggctggcgtgattgttgccgaaacctacgatgatgccgtgattcaagatgtgtaccgacgttttgataatcgccacttgaacgtcacgatgaaggcggacggctcattgaagcgcgagctaattgcctcggtttcgggtagctatacttttaatcgcgatcacaaagccgattggcagacgatgatgactatttttgccaagccatcattgcaattagcaacgttctcgattacagaaaaaggctacaatctgcgccaaccagacgggtattttactaatcaagttttggctgatttggcgacagacccacacactactgcgccaggtaataacatggttgcgacggccgcgttactattacaccgttttgaaaccaatgcgacaccgattgcaatggttagcacggataacttttcgcaaaatggtgaccggttgcgtgagacgatgcaaaccattgccaagatgtgggaaacgaatggttttgtgggcgcagacttcatgacgtggctcaatcaggatgttacgttcccgttgtcgatgattgaccgcattacgccaaatccggctgcgtcggtggctgaagcgttacaagcaatcggctttgctgatacggagttgattcgtacgccgaagggtaccaacgtggcgccgtttgcgaatactgaagaggtccattatttggttatcgaggataatttcccgaatggccgccctgattttaccaaagccggggtgtacttaactgaccgggcgacggtgaacgacgcagatgccatgaaggtaacgacgagtttgaacccgttgcacacggctttagctatttttggatcattgttaaattacgattcaatcgctgaagaaatgaaaaatgtcgacttattgaagttgattcaaaacattggctacgttgaaggattacctgttgtgactgatccaggcatcatctcaccaaaacaatttattgatgaagtgattaataagcggttgccaaatccgtacattccggacacaccgcaacgaattgccacggatacgtcacaaaagttatcgattcgctttggcgagacaatcaaggcttatgttgccgatgagcaccgggatgtgaatgatttggtcttcattccgttgacgctagctgcttgggtgcgttacttgatggcggtcgatgataacgggcagcaaatggctttgagtcctgatccgttgttggcgacgctgctaccaaaggttgcgccgttacatcttggttatgccggtaacttgcatgatgtcgtggttgatatcttgcaagatgaacaaatctttggcgttgatttatatgaagttggtttgggtgtgcgggttgaaaatgacctggcccaattgttgggtggtgaaggcgcggttgcctgcaccttgcataatgcattggcagcgtacggtcgatacgacgttgcagaaggagtagtaagttatggttaagatgggatttcgttggtacggttcacaagatgatccaattccgctcaagtacattcgtcaaattccagggtgtgagcaggtggtcggcgcgttgtttgatattcctgttggcgaagtttggcccaaggagcgtatcaaggcgctcaaggatgaagttgaggcagccggtttgaagttagaagtgattgagtcggttaacattcacgatgacatcaaaattggcttgccaacgcgtgaccaatatattgaaaactacaagcaaacgattcgtaatttagcagaatatggcattaaggtgatttgctacaacttcatgccagttttcgattgggtccgcacagatatgcgttttgagttgccagacggttcgactgatttggcttaccgtcacgaaatggtccaggggacattgcaagaaacgcttgatatggtgacgagccaatcagaagggtttaccttaccaggttgggaaccggaacgtttgtcagatttgaagagcctgttcgatgcctatgccgatgttgacgaggacaagttggcggccaacatggcgtacttcttgcaagctatcatgccaacatgtgaggagatggatatcaaaatggccgttcacacggatgatccaccacgcccattgtttggcttgccacggattgtgaagaacgcagctgatttgcgacgaatcgcggcgatgtgggacagtccttacaatggcttcacaatttgcacgggttcgcttggtgagaatccagcgaatgatgtgccagcgattattcgtgagtttggggcacaagacaagattccgtttgtccatgctcgtaatatcaagttcatgggggacaacggtgatttccacgagtcagcccacttgtcttcagaaggttcactcgatatgtatgaaatcatgaaggcgttgcatgacgttaacttcgatggttacatgcgtccggaccacggccgtgatatctggggtgaagtcgggcgacctggttatgggttgtacgaccgtgccttgggcctatcatacttaaacggtttgttggaagcattggcaaaaggatcagctgatacaacggaaacggttgtcatgaccgaagaatttgagatggtgtaagcatggcatttttagatgataattttatgcttaaaacgacagtggcgcagcgtctttatcacgagtacgcggctgatcagccgattgtggattaccactgtcatttgagcccaaaagaaatttatgataatcaacaaccggccaacttgacccggttatggttgagtgaggggacagttggtgatcattataagtggcggattatgcgcgcaaacggcgtgccagaacgtctgattacgggtgacggtgatgactatgacaagtttgtggcttgggcaggtacgttagagcgcgcgattggtaatccactgtttgaatggtcacaccttgaattgcgccgttatttcggcatccatgaggtactgaaccgccagtcggcaccgcagatttgggcccgtgccaatgaattgttggccgatccagcattcacaccacgtgagttaatcaagcggtcgaatgtcgctgttgttgtcacgacggatgacccggctgatgacttgtattatcaccaattgttggctgatgaagaagatgcttttcgtgtattgccggggatgcgtccagatgctgccatggccatcgaacaactagatttcgcattgtacatggaaaagctggcagcggtaagtgggattgccatcgatagcttcgccagtttggtaacggcgttggatcaacgttttgaggcattccatgcactggggggacgtatttcagattatggcctaaatacgtatcattatgcagccgcaacgccggctgagattgaggatatttttgccaagggactcgcaaatgagccgttaacggagttggaaattgcacagtacacaaccgcctttttgcaggtcgcgatgcgccaaaataaagcacatggttgggcaatgcagtaccacatcaatgcagtgcgtgcagcgaataagccacaatttgatgaacttgggccaaacgttggcggtgactcggttgggacacaggccgacatgccggaccagatgcgcttactatttgaagagtcacaacgccaaggcattttgccaaagtccgttgtctactcattgaatgataaggactggttagagttggttacgttgttaggttcattccaagaaggacccacacagaaaatgcagtttggggcagcgtggtggtttaatgatacgcacgatgggatggtgaagcagctcaaattattgtcgagccaggggttgcttgctaattttgtggggatgttgacggactctcggagtttcttgtcatatccacgtcatgaatatttccggcgcatcctgtgcgacgtaattggcgattgggtggcaaatggccaggtgcctgatgacatggcgtatctcggccaaattgtgaccgagattgccgggcaaaatgcccatgattattttgatattaatacactttactaaagagggaaaacaatgaagcgtttgaacattctaaacaagttgcaacaagctggtgtgattgccgtggtccgagccgagtcagttgaaaaggcagagttgatcgtcgacgccttggtcgacggtggcattaaggggattgaattgacctttacagtaccgcaagcggacgtctgcattaaaaacttggtcgacaagtatcgtggtaccgatgtcattgtcggatgtgggacggtgctggatgcagtgactgctcgtttggcaattttggctggggcggaatttgtggtgagcccattctttgatgttgaaacagcaaagatggccaacctctaccaaatcccttacatggctggggcgatcagcattactgagatgaaagcagcgcttgaatatggggtggacatcgtgaagttgttcccaggttctgaggcatcaccgtcaatggttaaggcggttaaggcgccattgccacaggttaacatcatgccaactggtggcgtgaacttggataacatgggcgactggattgccgctggcgttgtggccgttggggttggtggtagcttgctaaagccggctgaatttgatgattatgcgggcgtaacggataatgcgcgcgcttatgttgaacgttatcaacagttaacggcggcaaaagaattaatgggggtctagcatgagtgaggtgttaacaatcggcgagccaatggcggtttttgcgtcaacggaagctgatgtgccattaacagttgcttgtaactatgataagttcttagcgggtgcggaagtaaacgtggccgttggcgttgcccgcttgggtcacacggttgactatgtcgcacaggttggtgcagatccaatcggtgactttgtacgtgctgagttaacgaaggccaatgtcgggacagatcacgttgttgtcacgccgacgcatacgactgggttgatgttcaagcaacgcgtcacggcgggcgatcccgcgactgctaattatcgaaaaaattcagcggcggcaaatttgatggctaaccaaattgagacacttaacttagatggcgttaaaattgcacacttaactggtatatttccagccatctcagcaacggcacgcgaaacaacgttagcactttgccaacgtttggcgatgcacccagaaattgtgaaaatctttgatacaaatttgcgaccggcactgtgggaaaccactgaagagatggtggcgacaacgaaccagtttgccaagatggccaatattgttttgccaggaattaacgaaggtgaaatcttgatggggtcgcgcgatccggaaacgattgcggatttcttcattggccaatcggcggtcacagatacggtgattgttaaattgggaccagcaggcgcgttcgtgaagacacgtgatgggcaaacaatgacggtgccgggtttccgtgttgctgaagtgattgatactgttggtgcaggcgatggctttgccctgggggtaatcaccggcttactggatggtcttgatttataccatgcggtgcagcggggcaatgcggttggtgcaatggccgtgcaggcagccggcgataatgacggctacccaacactagttgaacttgaagcgtttatggcgcaacccgtttaatgacgtaacttcatcagtttgccaataaaatataaatggtacgtcatcacatgagctacgttgtatagatacttatttttgttataattaaattaattatatgtttcaaaaagaggtcggtgtaatggcgtacgaaggtttgcataatgatggacaaaaattagcaaacttggcagatgtgcggtcggcggatgctgcgtaccaagcatggattgaaacgggcaagaaaacatattctcacgaagaaatgtggtcgcgattatcagatgattaaaactcaatgacaaaagttgttgacaaattagaaggacgcgcataatataatcaacatcgacgaagacgagatgtagtagcaacggaaaaatccgcagagagctagcgtttggtgaaagctggtgtttggcaagttgtgaaaatggtctctgagtctgtgtggttctgcgagcagtaatgtaagtggtacccgggtgcgcccgttatagcgcaagcgtatatccggcggccgttgactagtccggccacaaggcgtacgtctcaagcttatttgggtgatcaaataaggaaactgggtggtaacacgagtcatttcgtcccggggatgctagcaatagcgttcccgggctttttgtttattcggccaaataagcaaacttggttatcccaatatattattaaaaaatcatggggattattattatgagtaagtttgtaacaagtgcagttttgacattggcagtcgctggagcggtggtacccgcaacgacaatcgtggcctcagctaatagccacaaggagcttaagacggtgaaggtcggaatcaattcgccatcaaagacggatcaagctgtttggaaaattgttgagaagaatggtgaaaagcacggcattaagatcaagttggtgacctttactgatttcaatcagccaaatgctgctttgaagcagggtaacatcgacgccaatgcgttccaacactatgcattcttggctgattggaacaaggcgcacaagtctaatttgcaaccggttggtgaaacggtgcttggcccaggtcgcttgtactctgacaaatataagtcagttaaagacattccagacggtggtaccgtcgctgtagccaatgacccaaccaacgaagcacgtgcccttttcttgttgcaagcagctggattgattaagattaaggctggcgtaacgagtccaacagtgaaggatattgtctcaagtgctaagcatttgcacgttaaggaattggcggctgaccaaacattggctagtttgaagtcggtcgacgcggcggtcatttcggcaaccttcgtagaagcagctgggcgcaacccaaactcagctatttatgtttggaatgcgaacaacaagcaatcacatcaatgggttaacattattgctgcgcgccacgatgacgccaagaagtggtacatcaaggcattggtaaagtcttaccaaacgaaggaagttggtcagtacatcaatgatcacaacaacggcacggaaattgccgcttggcaaggtgccccaaaggctaagatcgtcacggccgacaccgcgtcatcagctactacggcatcatcaaagtaaagttatttaacgggggtatcacaatgggggcaacacaactaacggcacttcggtcactatcacagccggttttgctggctggtcaattatacgcagcacaaagctatgtagatgacatcgcgaacgattatcagacggatttgattagcattgttaatcaaactgccacaacgttggcaacaaatatttcgcagttaacagctactgagcacgcattgttttatcaacaagcgggccaagtttatcggcgcacgggcgatggtcaagcgacccagttgacgcaaacaagccacaaaattgtgagctttgcgcccacaccggacggcactaaaattgtgtttgccgtcctagtttcagacgcagaagcatttaacacggtgagtgatcgaccacaagtacgccactacacgaagcgtcgttataaggcggatggggttggctttattgatgagcaacgtcacttcgaagtgtatgtggcaacgattgccggtgagacacgccgtttgttgacgacggatttgccagtgcaagtggctgacacgacgacgacacaggcattgttgattgcacaaacgactaccgaggatgcggatgagttacgctcagccttgcggtggttggatctggagacaggcgatatcacaccgctgacgacggaagttgcggaagtccacgaggcgacgattgcgccggatgggcgacaggtgttgttcatcgctaatgatgaccaatatcctaatcgtcgggttgccagtttgtatcgttttgatggtgaggcaacgaccattgcgtttgatcaagaagaattgttagaagggccaaattcagatatcgtggtgcaaaatcaggcccgacatgtccgttggctggataatgacacttggttatttgaaaccggcttccatggccatacccgtgtgtatcaagggtcagctacaacgaatcagttgttgcttgatacaccgcaatacttgcaggactttgcaatcggtaaagggaccgtcattttggcacagcaagatacggcgcaccccagtcaattattggcgctcgatttagcaacgcagggcacgcaaattgtttttgatgccaatgccaccttgcaattcccacgggctgaaaagtatgtcttcagtagcgaggatggttcgccagtagatggttggttcttggcagcacaaagcgagggtccagcaccggttgtgttgtacgtgcatggcggaccgcatggggcttatggggatgcctttttctgggaattccagcgttttaccgaagcggggtataacgtggtgttcacgaacccacatggttcaaccacgtatggccaggactttatcaacgccgtggttaaccactatggcgaacaagacttccgtgatgtgattgccggcttggatgtcgcattgcaacgttttggtgagtacatcgatgccagtcagcaaatcattatcggtggttcgtatggcggctttatgaccacttgggcgatcggtcacactagtcgattcgaagcggcgatttcacaacggccggtcaccgagtggttacacctgaccggtgccagtgatattggctacaattttgtgcaagacgaaatgggcgccaatccttacacgccagctggtcgtgaggaattgattaagcgttcaccaattacgtatgccgcacaagtgaaaacgccactgctcatgttgcatggtgagtatgatctccgaacgcccattgcacaaaccgagatgtattacaccgctattaaaacattgacagatacgccggttgaaatggtgcgtttcccgcaagcttggcatggggtgtcacgaaatggcttaccaaacttacgtgagactcttttgaccgtcatgtttgattggctaaaaaagacactagcatagcgataatataaacaccgcctccgcacaagcagtgtgcagagatggtgtttttcgttatataactatatatatttatgcgaatatgaatttttgtccttatatatatattggcgtggggtataatagaggaaacattcggaaatgaggccacttatatggcaaaagtaaatccgttttcacctaattttgggaaactacctaatgtgtttttgggtcaggaaacgttaatgcggtctttattagatgctgccaaaaatagcaatagcccttggcgcaccacgttattgactggggcaaggggaactggtaaaacggctgcgatggaagagatgcgagttaaatttcctaagaacacggtttttgtgaacaccgcggcggatgataaattactagataccatgttggatgcattggagttggcgacaattagtgaactagacgtccatttaagtgttgatctgggagtgcttaaactggggacccaggacaagaagttggcgactttttatggtaaagccaccccgattattcagcaattgtcagttggcaatcgtttgattgtgtttacgattgatgaagtacagactaatgtcgagacgttgatcgaatttgctaaggcgtatcaactttgggttcgagatggctataacgtcatgctggttatggcgggattgtcattctatatggacgacctattgaacaataaagcggtgacatttttacgtcggtcacagcaatataaattacgacccgtatcgacccctaaagaaattgccgcaacgtacatcactgagttgcagaaaaacgggataacgctgtcgcaacaacatgcgttgtacttggcgaaagaaacccggggctatccatatttgattcaattatttggtgctaaattgtgggatttaggtgtaaaagtgattgatgatgaggcaattagtgccgttgagaattatgcgaaggatatgatgttcagcaatgttcaccggttaattttgcatgaattgtcagcacaaaggttgctatatgcacaaaccatggcaaaattgatgggtgatggcgatattgcaacgacaagtgtaattgccgagagtatgggaaaaacaacgtcagcactcagtcaggcacgcgaggcgcttttgaatttcggcttaatcgctagtccgaaacgtggggaagttatgtttactattccgtacacgaaggaattctttctaggtgaattatctgaattgcatgacgattatgactacacgatgtggttataaggattgaaaaacgtgggttaataagagatatgaaaataacgaaaaatacggtcatgctgggaattgcgacaatcgcagtgctagttgtcgcgatgctgggtgttgcgaagggcactaagcatgaatcaacaacgacgaagcatgaatcaacaacgacgaagcatgtggcggcaagcctgtcagcagctaaattaccaagcagtagtcaatcgattgcctcgtcacaatcaacgagtggtcaagccgatgacgtatcggcttcatcagcaacgtcggtgacaacagccacggcgacgaatgatgctaagccaactgacgctgatcagagctacgcggatgcggtagcgttggcaacacgtgaggcccgtcaaaccgtgacatcagaccgttaccgctttgtgggacctaagggtggtcgtaatacggataaagaaattaagatcggcttccagaagatcagtaacaaccaagatagcgcccaaggttatgcctttttagtttatgatcgcgcaggaaaattattacgtcgcgaaggattctaagatattactagcatctgtcagatttgtatgcgaaactggcagtacggaggggtatcttatgacattaccaaaattaatcgccgtcgatttggacggcacattttttgatgaccaccagcaagttaacgctgccaaatttacggcgttattggatcgtttagatgcagctggtggccattttgttgcagcaacggggaatagccgcgacgtggtggatcattttttggcaccgtttgtcggtcgatttgactacgtcatccagaatggtggtcaagttgtcaccaaggacaacgagacgttagccttacacggtttagaccaacgccaattggaactcgttaaggcgacggttgaagctgacgatttggcaccacgccacggaaacgtctacagcacagcaacggatggttacatgatgcgcgccgataaaggtcagggtgaattgtatcagaacatggtgatggagtttccaaacttgatttttatcgatgatttatcggaaattcctgatccagtaatcaagattattttaaactggcccgagtctgaagcgacaccctttatggccaagttgaacgccgaactcgcaggtacggcgcacgtcacaacgtctggcttcggcatgattgatgtggtagcacccaatgtgaacaaggcagttggattgcagacgttggcgaaccactatggggtgacgtttgctgacatgatggcctttggggacggcgcaaatgacatcgagatgttgcaggcggttggtcagccatttgcaatgaccaacgcagcgcctgctttgcttgagcagttcccccagaccgtcgccgacaacaatcatgacggtgtattagacacaattgcgacattctagacggttcatttcgttagtaaaggtagcaggcctgataataacgacatggaggtacggggatgaaaggatttgaattggtatttgagacaacagttgtgaaccttgcaacagccaccttacgactgcggtcggtgacgaaagttgagaagacagggttcaagtccgaagcaaataagtaaactaatcgtttctccatttaaggtttcactgataaaataatagtagaaacaagattggaggaacaaatgtcatgacatcatcactatatatgttgttcaatcaaacgacagggactccggaattaggggcctacttcgtgactgaactagacgccaaaaagtatatgtatgctcacggcatgcaaggttacacggttgtgaagccagcacgattgacttttgacaagccaactcgtaagcgtgcataaaatcagaatgatagaggacctgggtaactgggttcttttttattttgcctgcatgatgttgcatcgcatctactcagctaccttggatgataatcaaaaaaatcatgagtgtatctcggctgctggcatggtggttggggtgtgacggagcgatttgcctgggtgaactcacaagttcggccgaccgccggttagataaggcgctgggagctggacccttaacacaattatttgggtgctagccggtgctcgcgccggcggagtttacccaggcaaatctttgccggagtcacaccccaaccaccatgcctcgtgcggtagcacgacacgcgatgcaaaaccgaattcccgccgtttgtgttaatcaggttactcgcgttataattgtaaggataataagtaactgttgagaagttggaaacgagagtggtatgttaacagtcatcaaacagcacgaagatgaaaatgtgattgtttacgattactacatcgaagggcgacaagatgtttacgaagataccggccacattgtcattgagtcgatgggtggttctgcgacttggcgcgccgtaaacgatgatacagaaaagtatctaaagcaagccatcaccgcgttgatcatgaaacgcaacgaaaacggtggtgtgtacccagataacttaaaggttgtgcagggttaacaaaattgaataagagagtcagcaagagacataaaaccgctggcatggtaaacagatgatgtttattatgccagtggtttttttattagccattttcgagtatgattattaataataattactaaaaataacaataaagtttgtgacagggagaatgatggggaagataaaattaccaaacatgcggttttacacctttaatggcgtgcatgcggaagaaaaacagttggggcaacagttgagcgtggatgtggttgtgcattatcccattgagcgcctggtacacggggatgacttggcaaccacgatttcttatagtgcggtgtatcgcactgtcgaacgcgttgtgacaacgaatcaatttgatttaatcgagtccgtcgcattgttagtcatgcgcaccttgcaaactgaatttccgcaagccacgcaggtcgatgttgcggttaccaagcacgccttaccggtgccgggtatctatgacccgtttaccgtttccgtatcgacggcggaggaataacacatgactacggcatatctgagtatcggtagtaatcttggcgaccgccagcagcacttacaaactgcagtgaccctgttaaaggcccatcccgcggttaaccaggtggtggtatcgggcctgtatcaaactgaaccggttggaccagtacaacaggatgattttttgaatattgcggtgcggttggagacgactttgactgcgccggcgttgttagatttcctacatgagattgaacaggctggtaatcgggaacgtcaaattcattggggtccccgaacgattgatttagatattttatggtttggcgagtcagtaattaacacagctacgttacaggtgccacatccggaaatggctaatcggttatttgtcttggcccccttgcgtgaagtggcaacaccagcacgggtagcgaccgtaaccggcttaattgcagcgacaacggatacgaaacaagtcatgagaataggggagtttgaagaccatgcaaacgagtgaagaagatgtgcgtcggctacttacggcgattggagatgatccgtcccgctcaggtttgatagaaacgcccgcccgagtcgtgaaagccaacgctgaaatttttgcgcatactggtgaaaccacgtttactgactacaagttatttgaggtagccacagacactgatatggtcgtggtgaccgacatcccgttttatagcatgtgtgaacaccatttgctaccattctttgggacggtcacggttgcctatcaaccaaaacagcaggtaatcgggttgagtaaaattccgcgcctcgtcgattgggcggcccgtcgaccaagcgtccaagaagggctaacaacattgattgcagatgagctatcgcgcattgtgtcagctgaaggcgtcgcggtacacatttcggcccggcatatgtgcatggagatgcgcggaattaaccggcctggtacaaccacgacgactcaagtcacgcgcggaattttcaagacggatgccgtgttgcgccaagaatttcaacagcaggtgcactaaatgcggacctatgaagaagtacttagcttgatggacagcggttggcgcgttgatgatgcggggcgtttgaattttttgtgccaggtgaataaatggttgggtcagccagaccggcaacttaggattgtccatgtggttggaacgaatggcaagggatcggttgttgagatgacagcccgcatactagaagcggctgagtatcaagttggcacgtttacatcacccgccttgtttgatgcgcgtgaacaggtacaactaaatcatcacaacatatcaaaatcagcagtggtccattggtacgaacacattcgcacggtcttaatggcccatggtgaggaaccagccgcattatcggcttttgaatattggacgtttatggccttgctttattttgctgatgcccacgttgatgttgcaattattgaggcgggcttgggcggtaaacaagatgctacctatgtgattagtcggccggccgtggttgcggttacgccaattagtttggaccacatgcaatggttaggcgacacgcttgcagcgattgcgactaataaagcggcggtaattcaaccaggcagtcgtgtggtgagtgcgcaacaggaaccgagcgttacggctattttgcaacatgctacgcagcaagcccaagcaacctggcaggcaattgatgtaccagtcgaaatcttagtagatacgccagcgcaactacgccttcaaattgcgggggtgccttatgagcttgggttacgcggacaaatgcaggctgaaaacgttcggctggtttggcaaattttagcccaactcgacttgccaacgacacctgaaaagcggcaatttggcttatcacaagcgacgttatttggtcggttaacggtgactggacaggttatttatgacggcgcgcataacccagcgggtgctcagcagttagctaatgaattggatcgctgggggttacggggacacgttattttgattctggggatgctcgccgataaagataccacggcaattcaagcagcgttaacgccgttagcacgccaagtaattggggtgacggcggataatcaacgggcaatgttggcgactgacatcgcccaacacactgctacgttaggtgaagcgatgacacaggcaaaacaactcgcaacagcggcggattggattgttgttgctggttcgttctatacgattaaaggggtaatcacacatggcgatttggcaagtgaacacgacgcgtttatctgatgacgctgggttaattattggcattttaaataccagcccggaatcgttttacgacggtgaccaggtagccacagcgaccgcctcggttgcgcgagcgttgcaattatatgcagatggggccgacatcgtcgaagtgggtggtcagacaacgcgacctggcttccaagcgcagggacttgaattgacgcccaaactggagattgaacgcacgatccccattattacagcgattaagcaggcgcaaccgcaggcattagtggcgattgatacgtataagtatgaggtgatggtcgcagcggtaaacgctggtgttgacgtgattaatgatgtgaatgggtttacggatgatccacgcaaattggcgttcttggcgacaacgacggtcgggttgctgacgatgtggaatccccgccaagcgcatgtccctgacgtgcggtccggtctccgcgactgggcgatggctaatttgaacacattaacggcagcgggcattgttgcggatcgaattttacttgatccggggcttggttacgccaaagatagtgcactcgcgcatgatttggcgattatgaagcacgtcgacgttctgacagagctaggaaggccaatcttagttgcagtctcgaacaaagggtgggccaagcaattgctcggtttggataaacagcatcgcacaaccgtatcacttgtggcagcgcaagcgatgatgggccgtggtgcccgcgttttgcgagtgcatgatgtcaaacaaactcgtgatatgttacaggtgttggcagccattgatcacgtttaagtcccattttaggtaccattagccttgctttaaggaatcaccgttatagttaatcatgttgacagggggaacacctaatcaacacaaaccaaatgtgacaactcataactctctctaaataatgatcgcctgtcgcccagcagtctggatccgaaagacccgttagctaaacagccaacgggctttttgttataggaaaatgaaaatattcacgttgttgtcatttagttttcattaagggagaattgctatattggttgaattgaaaattctgaattaaaggagcgactgttgtgaaaaaatcaaataagcaggacaaacgacaggcggaaaaccttttaccgtggttaattcccattgcattgattattgtttggcaggtagcggtcgatgccaagtggattgacgcaacctatgtgccgagcccattagcggtcttggaacaaggggtgacgttatggcaagccggcacgctacaacaaaatatggggatttcgttataccgggccactatgggattgctaatcggcggtgcggttggctttgtgctgggtgttgcgaatggtctatcccgcatcagccacgcattgttcaactcgactatccaaatggtgcgtaacattccgcacttggcattgattccgttaatcattatttggttcggaattggcgaaccagccaaagtcacgctggttgccatcggcgtcatgtttccgatttatatcaataccttacatgggattcaatcaatcgacccgaagttaattgaaatggggcaatcgtatcgattaacgaaatggcagatgtttacgaaagtgattttccctggcgccatgccaactatcttgatgggcttacggtatgcgcttggggtgatgtggacgacgttgattgtttctgaaacgatctcagccagttccggcattggttacatggaaacgaatgcccaacaatttttggatatgccaaccatctttttagccatcattatctatgccattttaggaaaagtatcggattggatcgcggcattattggaatcaattttgttagactggcaagctagtaaaggaggccgttaatggcaacggatgatttaatacaactcacggatgtgacgaaaagctatcagcaacacacggtgttacatgacgtcaatttaacaattaaaacgggtgagtttgtggcatttgttggtgaatcgggtggtggtaaatcaacgctgctccggttaattgcgggccttgaaccagccacgacgggtcagctaacaatggatggccgaccaattaacggtttgaatacagtcgctcgggtgatgtttcaagatgatcgtctcttaccttggatgacagtccttgaaaacttgtcctttaagtcacgcgatatgaatgaaaaagtgcgtgcccaagagttgcttgatcttgtccaactccatgattttgcgaattattatcctaatcaattatcaggtgggcaaaagcaacgggttgcattggcacgagctttaatggcgtcgcctaaattgctgttgctagatgagccgttgggggcactagatgccttaacgcgttcacgcatgcaagagctgattgcggacattgtggatcaagaaaatctcaccacgattttaattacccacgacgttcgtgaagctgcaaaaatggcggatcgaattgtggccattaagcatggcacaactgggttaaccgtccctggtcatcgtcatcaaactgatgaaatggccatgatagcggtggcaaatgaggtccaagaatttattctgtcagattaaggtgaggcatgaacatgaaaaaacgatggcaaaaagtaattttagtcgtgctcctgtttttctgggcaggtggaacttactacggctaccaacagacaaccggttcacgtgataagttgcaaaaggtgacgattggttaccaaaaaggtgatccagttgacgtgtcacggtcgcggggcgtgcttgttaagaagatgaaggaacttggctatcgagtggtctttaaagaatttgcagatggcgcatctgaaatgcaagcgctggcagcgggaagcattaactacgcgcggacgggtgatacgccaccagttacggccgcggcatccggcacggatattgcctacattgcagccggtgcgagtcgatcatctggatcaggcattttggtacaaaaggattcagatatcgattcagtgaaggcgttacaaggtaaaaaggtggcgtacacacaaagtacatcttcacaatttttgttgctgcaagccctgtcgaaggcggggatgtcagcttcagatattgagtgggttaacatgaaacaagccgacgcggcgattgccttctctaagggtgacgttgacgcgtgggtcacatgggatccgtacacggcacaaggtcaagtgacgcaacaagcaaaattgttaacaaacggagatggtttatcgcagaatcgtgatttcatcttatcaacgcaacagtatgcaaaaaagcacgaagcggttagcgaataccttgtgaaatacttgtctgaagatatgacgtgggcaaatgagcatcccaaggcgttgacgaaattgctcacgaaggcattgggcatgaagcaaacgattgtcgctaaaatggttgatcggcgcgattggacattaacgccgatgaccaaggcaattgcaaaggaagaacagacgattgccgatgttttctatgaaaatgacttaatcaagcaacgcattaacgtcagtgatgatgtgatttacgtgtcagaataacgaagggagtatgagatgacagttttaacgagggacttgcaggcacaattgacggcgcatgccgatgatgtgatgttagtctcgttgacggatgaacgccaatataacggccagcaggtgactgcgctggtcgaacaaacgaaacaagcactggctgaccaagcaattggtgcgggggatgtcgtccttatcgccttggccaatcattggctgtacccgattttggaacaagccttatgggaaatcggcgccattgcgcatccagtagcaccgacttcgggagtgcgtgaaattctagatgagtttgcagattatcactatatagccggcatctttgcggagagtttccgaccagcccttgccatgcaaccggactttttggatcagacattcgcaattcatgagcaaccggtctatttttatcgctatcagcagggtgaaacatttcagaatgggatgacgctaagtgatgacagtctggccgttattctaaacacctcaggatctaccggcaagccaaagcgggttgggttaacgcacgcgcaactggcgaattccgcgcaccacatcgcagcatcgcagcgtttaacaaatcaagatgccacgatggtggtgatgccgatgttccacgtcaatgcgcaagtgattgcgatgctgagcacgcgtttgtcaggtggcaagctggtcgttgctgaaaaattttcagcttccaaattttgggaagccgtggctgatcatcaagtcacgtgggtctcaattgtgccaactatagtgcaaatgttgcagcaaaatgaacgcgctcggacggccttcgcgcgtcgccaagcggacgtgcagttaaaatatgttcgttcggcatccttttcactaccggcagaacaattggctgcgtttcaagaccaatacggtattccagtcattgagggttacgggatgacggaggcagcttcgctaattgcgttaaatccatttgacgccccaaagcctggtacagtaggattaccagtggcaaccgagattgctttattggtggagaatcaggtgactaatgaaccaaatcaaactggtgaaatcctattgcgcggggatcatgtcattacagattatgatgatcccaagccaagcgcatttcatgacggctggttacggacgggtgatttagggcgttttgacgatgacggctacctgaaaattgttggtcgcatcaaagacatcattagtcgtggtggcgaaaaagttgcgccagctgcgattgaagcgacattgcgccaacttgattttgtggctgacgtggtagtggtcgggacgccggatgcgttatatggtgaagcagtgacggcggtggtaattccaacggcaactgacctgactgaagctgagatgacaactaaactgttggaatatgccagcacgcagttgtcacaaccggcgcgaccaacgcaggtgttctttgtcgcggattatccacgtaacccaactggcaaagtggttcggccacaactagccgcgacgataggaaagtaggcgcatggcagaaaaaaagaaacgaccttatctatatgaggtggatatcttacgattgatttttataacgggtgtgttgttaaatcacactactagtatgatgggtggccatatgggagttgggtcttgggaaaatcatttcctggacgcgacgcacttatcgctacactttacccggatgggctttatgttcattactggcttagtgttattcctacagcattatcataaggaactacatgtctggtcattctggaaaaaacgttatttaggcgttggcattccctttgtgagttggaccgctattctgttagccggtgacttaatcggcacaggcaatttttcatgggcggcattctggcctaagtttggctatctggtcacgcacggaacggattactatatgtattacatcatcgtgacgatgcaactgtacctgattttcccagcgttggtttggctatttaagcatttcaagcatagccacggtcaaattttattggtgtcatttttattccaaatcatcatgttagtgtttatcaagtatgggttgccgcatcttgatacatcggggtggccatttttgtttaaaaactatggctttagtttgctggtctaccagttctactttgtcttgggggcgtttgcgtcaattcattacgaagcgttcaagcaatttattgcgacccatcatcgcttcattgggtggagtacggtggtgttggccgtgggaacaattggcgagtattactacaatttaaatgtactgggattgagtctgaaaaagacgttggaaattcaccaaccgtatattttcatctatgatttgtttattattggctttatcatttggatcgggctgcaatacgccaagtaccgtgataatggcttgccaaaatggttcgtaagttttgtctcaaccggggctaaagttggctttgggatgtacttggggcaaacagtggcgcttgaaattgtcgatttgggcgtgacggcgcttagtttgccaacggtttggaattttgtaacgttaccactggtgtttatcattgttgtggcggtcgattatggcatgtcgctatgcttcttcaaaatcccaccatttggctttttggtcggacggccccagtggcatgtgtcacgtctgtggtcagcaaaataaatcgcattacaaaaaggctggacagagaatgtccagcctttttaagggtgaaggatactgctttttacgaacaaccagtgtgaagttaaataaggcctttgattgtcagccaaacggcgaacgcgaaaacaatgattactacaccgatagcacgaatgctccacctcaaaagcatgcgtacaggaccagtatcttttgttttatcgcgtcggaaaaatataaccataattataaggactgaaattcctaaaaataatgagtcatgattttgagtcaatgtagaattgttttgtgctgtttgttgagaataattttgtgtggtgtttggatttgctgaattgggatactgatgctgtgtttgttgagtgtattgttgattttgttgtcgttgctgttgaagttgttgatcctgctgcatttgctgaatttggcgttgctgttgattaatttgattttgttgttgctgctgttcccattgttgttgccgttcctggatttgttggcttgcataatcgtcatacattttatttaaatacttcctactctataaaattcacttattaatagtacgccggttttttcaatatggcatgaattgagttttctgcatgaattatacgttgtaacagaaaataacaatttcagacagaaaccattatttaatgggccattcgtttgtcgagcaactgccattttgaaccactattacttaacttgagcaattaccttgacacacacagtaatccggtgtaaattactgtgtgtcgcaaagtaatggagaaaacaacatggcagaaatatcaaaagatttaattcgggggcacacagatacgattgtgcttaacattttggcccagggggattcatacggttaccgtatcgtacaagatatcaagacgatgtcgagtgggcagtatgaaattaacgaagccacactgtataccgtgttccggcgtctacaaaaggccgagtacgtgacaccatactacggcaatgaaacgcaaggcggtcggcgcaagtactacgctattaccgaggctggtaaacaagcgttggccgaagcgcaggctgcatgggacgtggcgaaagttgtcatcgatcaactcatgaccggaaaggtaaagtaaaatgatgaatgaaattattgaacaagcattggcgccggtatttgcaggcgttaagcgaactgatgaagtaaatgatttttatgacgaagtacgtgctgatttagccgaagccgctcaagataaaatggcaaccaatgcgatgttgtcacaagaagcggcagtgaaagcggcgttgactgaaatgggcgatttacatgaagccgttaagatgatggcggatgatgaaacgctaacgccggcgccacagattgaacctattacaggtaagccgggcaatgtggaactgacggttgaagcagccggccttcgcaaagtgaaaattgacgggcattatacagatgtgcgattgacgatgagcgaaacaactgagtttacggttaagaccatgcaacgtggttatttcaacggcgaagtggcgtttaagacaactgacgggcaactaaaaatcaagatgccggaaccgaagaagtggtcatttgtggtgccgtttgctcacccacaccaaacgattgaactcggggtgccagcagaatttgcgggtgagttagcagttgaaaccaaagcgggtaatgtgtggattgaaaacttagcgaccccagccttaactttggtattggaagctaagaccggcaatgtccgaatcgctgacgcggagatgcacttaacccgtgtgaagatgaaggcgggtaacttgcacatggataatgtgacgactgagtttgagactgatgtgaagagtggtaacacgaaggtggttgctgcaaagggattcggccaactggctggtcaaagcggtaatttgacggttgattgggatgagttgcagggggatgtccacttgcgcctgcgttccggcaatatcaagaatattttgccacaaacggcgtcatttaagttcgatgctcagagtgaatccggcgtggtaaaggtcaagcgcgacggtgaattcgacgtgaaaaccatgtcctacgtggagggcgaaacggatggccgggctgagtatttggtaaaggcccaggtgaaatctggtaatgtcaaaatgatgtaaaaaatcggcgtccgttagtaggacgccgattttttgtcttatttattcttggctgtatgctaaacaaaatcttcaaatttgaaagactcgattgattcgccaatagtttttccatcttgcagtttgaaggacagggcatcaccgactgtatcaaatatgattgtccgttgaccaccgttaaattgccataatgacatttcgccaacgacgccggtcatcaacgctggattttcagggttgttataagttgttagttggttatttatataaaacgttgcttcaccgtgatatcgtaaagattcgataacttcatctttggtgagcgaaaagtactcgtaagtcatgttgaacccgctttgcttagttggcatgatacatatcgtagtattgtgggccttcatcaacagaataaactcttgttaccgcatctggcttcttaatctttccgatactagcgccaaatccggttgcggtattccaaagcaccagcattcctaaaatggggttagttgaatagggcatgaaaaagaattgtagcctgtcgtcgtcagcaaaatcgttggtaataagtttactgtgtaataaattcgcccaattttcccgtgtattgtccattgtgtttacctttcttgcacctattacaaaatattggtcgtaaataccttctatgcgttgcccagttggtgttatgtcatcatctgcagtcataccaaattgtagttgagcacttattatgtctagttggaactgagatatttggtcaccatctttgaaataaagtttaacccagttattgtcaaactttatacgtgcaacgttatcaaaaagatgttcaccaaacgatctcaaataggcgtaatcgtctagtggtaattcaaaaaataatacatattgattttgcgcagcctttttttcagcgttttccgcatcgattcttttattatctcgggttatctgaatttgttttgcaagccacaaggcaataatactgccaaagaataacactgataacgtgatggctaatatgacgtgacgattagcccacgcattgaaggcttctctaaacctatacaaaattgccaatgaaaaaataactttcaaaccgttatatatttttggtagcaataaaatgactgcccaaataatgacagcaattaaccaaatcatattactggactccttatcctaatataaaaattatatgcttatcgacaacataaggaacaagaatcttcaattttttagctaaaataacgaaaccagcatttgtttttatcaccgctcatcagacaaaagtccataattgccagacaaaacagtgattaattgcaagatgcttaaataattcgcaaatggtggtgatgccaagcgctttcgtgcatgatagttcagtctcacaaaacgggtgagactaattttttgatgtgggggcgtactgatgacaacaactattgtcattaataagcagggttatgcagtgaaagacctgcatgtattcggggagacggtgacgatttcaccggaacgaacagttatgattgtggcttgccaagtcaatgggatgacaacggctgccgtggtgtaccaagcagacggtaccttcatgggtattgcacaatcgagcaacacgctgttgcaacagttagaaacggagtcaggttattttcgccgacgtcaagtccaaacgatgcaacgcttgttaccgaaaacgttggatcctgatgcgaaatcattaccgtgggtgaaagggcaggacgcttttatgccgattacctgttataccgatggaccaacaacgtgggtgaatacggcctttttgacagcaatcgaaacgcaggggtttcaaacgcgattagtcatggatggggtaccagatatcgtgaccagcaagggacggaacaaatttattaagcaattgacggctattaaaatcatgagtttgtggatgtgccaagacctgtatgggtgcggatcgcagttagaacgggcaattttgccaatgattaattggccagataatgtcccgattaatgtggaccaggctgctttacaggcctcgcgtgatttaacgtgtctaaccacccttggcgaacgcctaaaattacccgtcgatgaagagaccactttagcggacctacaacgacaggcgcgtctaaatatttctcaacgtgatatgaaaacgttttaacggtaaaaattatcgttttaggataaaatcggaggtaatcatacagagagtgggtagaaaagatgtacgtgattaaatgttcagatagttacttaatgggcgcagctgttaaccatacatggcaaacggccaccagcgctgatttggcaaagcgatttgaagcaaagtcagatgctgaagcctttttagcaaagtacgagttagccgaagttggtaagattgtaaaactgtagtgattagttaatgcgtcgacgcgaaaccgtcggcgcattatttgtctcatttggattaaatgctatactttgaattatcacaatctgaaaaggggatgttcttcaatggcaaatgaagagaaattgaatatcaatgacattgcagaacgggcaggggtcagtattgccacagtgtcacgatatctccatggccggcttgagaaaatgtcggataaaactgcgaatcgcataaagcaaatcatcgaagaaaccggctacgtgcctaacgcctcagcggtccaattgatgacgcaacgcagtggtctgattgccatcgtggctgcggatgtggatgattatttttcaacggaattcttcaaaggagcctcatcgattcttgaagcggaatcgtataccggggtgctctttgatacgaattcatcagttaagcgggaagcatcattacttgatcgcatcagccaacaaaattttgatggtgtgattatgcaaccaatctcggctgataatgaagtgctacaaaagcacattaaaaagaatttaccggtcgttttggttgaccgtgagacgacgggtggcgactatgacatggtcgtgacggataatgagcaagctgcaaaacgggcggcgcaacactatcgtgaccaaggctttgcgaacgttgttgtgatttctgaaccaattgccaacgtgtcaacgcgtacggcgcgttggcgtggggtgcaggcagtttatccagatgcccaaatgattgaaattgcgcatgcagggatcattggtgcggaacaggtgcaagcgattattagtcaattgccaacggatgccccaaccgtcgtgttcttctttaaggaacggttgatgttggaaatcttaccgcacatgattcgtgaaaatgtattgacagcgcaattacaagtgactggtttttcagacacgaagctcgcccgtgacctcaatccaaacgtgaagttgatccagcaaaacccttttctgatgggggcttcggcggctgagttgctcttacgtcggttggataaaaaggcggccaaaacacaaactgaaaaaatcgtcattgcggcgacttatgaatagactgtttacaacacccaacttgggtgttattcttttcacgtaaggttaagcgcttacctaacttgtgagtaagcaagattagttagcgacttaattttaacgggccattgcgcccatatatttttggatattggttaagcgcttaacctaaaatgacaacggatattttagagattaggtgagcaatggtgcggtttgacgaaatggtgccactgttcttaggggaatgacatggcaaagctatttttgaatacatggatttttgaggatgcggtgaagcaaggacgtacgcaagccgaattagttgcccaagttaaggctttaggtgccgacgggattgaagttcgacgcgaatatttccacgacttaacaatggaactggccgcggtgagcgaagcagccacggcagcgaatttggcagtcgcattaagcatccctgatgaattgttcgtcaacggggcagttaatgaaaagttaccgcagtacattgcggagctacaaacactaggcgcggttaaagcgaagttcaatttgggtgattacgccaactttactggcgacctggcgacggcctttaaggactggccagctgatatcaccatcaacattgagaatgatcaaacggcattaagtggtcatctggaaccaatacacgccttcttgcaagacgcaaagtcagcaggtgtcgaaattgggtacgtttatgacttgggcaactgggcgtttacgaagggggatgccgtaaagagtgctgagctattggcaccttacactgattacgtgcactttaagaatgcagctgacacggacaatggtttgattgtaacgactgatttggctgaaggcttgttcgattgggaagccatttacaagttattcgacaatactgttgatgttgccttggaattcccaatggcaactaacgaacaaattgccgcacaagtgacgatgttacgtcacgcgatggaggcccgttaatcatggttaacacgattattgcaattttgctgttgctgacatttgtcggctttatcttctacatcttcaagggtggtaacttgatggttggcttcttcgtgatggcaatcctctgggcagtcatcgggttggtaccatttgatgttgccattaaaaaagttttcgctgagccagccttgaattacgggccaacgattatctacattgcgtttgggtcatggtttggtcgtgtcttggttgattcgggtattgcgccagccatttcacagcgcacggcgaaggcaggtaagaagaatgtgatgcttgccgccatcttagttatcttagttacggcattgattttcattagtgcgtacggggtcggttcggttatcgcgattggagttatcttgttgccaattctcttgtcactcggtattccacgtaagattgctttgccagtcttcttgatgtcggttggtgcaccaatgtacttgaatctggtgcttttcaaccaaatcaaagccttcttcccaaaggctgactatagtgggaagtatttgattttcggtatcacagccatggctgtgcaactgttggcggttatcatttacctctttatgcaccgcaagtcatttgatgcctcaaaggcggacgagaacttgaagctggttggtgctgaagtctcaacagaagaaattaagatcccatggcctgcctttattgtgccggttgtgccagtctttatgaatttggcgtttaagtgggatgccgtaccatcattgattttagcaaccttgttggcaatgttgctaacgggtaagatgcgccactggcagtcatttattgactttttgaacgataccattcaaacagcgatttcagatattgccggattgatcatgttcttgatggcgctaatcatgttctccggcgcggcccaaatcaatgcggcgcgtttccaaacattgttgacgtcaattttgccatcaaacatttggattttggccttggcacttggaattgccgcaccattggcgttgttccgtggtccgttgcacgtttggggtgctggagctgccacggctgccgttttggcgggagcgcacattttcccagatgccttgttgttgcctttgatgtatgtgccaagtttgatggcggtgtcgactgacttgacgcaatcatggaacgtttgggccttgaagtacatgaaggtcgacagtcgtgaattgttgaagcagggtgtaccggtaatgtggattgtttcaatcattaacgttattttggccgttttgattatcaagtaagagattgaaggattataatcatgagtgaatttttgacgattggtgagccagttgtgacgttcatgtcgaaggacgcggacgctagcttggtcgacaccattaattactttaagttgttgggtggcgcagaattaaacgtggccattggggtacagcgtttgggtcacacaacggaatatgtgagtcgcttaggtgctgatccattaggtggttatgccaagaagcaaatccttgaacatggggttggcacgactttcgtgaccgaagatgcagataactggacgggattccaattgaagcagatggtgacgactggggatccacaaacgtttaactaccggacaggttcagctgcagcgcacttgtcagcagatgtgttggatgacgtgaagttggacgacgtgaaaattgcccacatgtcaggaattttcccagcgttgtcagagacctcaaacaaagccttccgtcacttgatggatcgcttggtcgccgctgacaagttgatcacgtttgaccctaacttgcgtccagccctttggaacgacgatgcccgtatgattcgtgaaattaatgaatttgcgaagtcggcggatatcattttgccaggtagcaatgaaggtaagatcttgatgggtagtgaagatcctaaagatattgcggacttctacttgaatcaaagtgatcggacgaaggttgtcatcgtgaaggttggacctgccggggcatacgtgcaaacacgtgatgcagaaggctttatggtacccggctttaaggtcgcgaaggtagttgatacagtaggtgctggtgacggttttgcccttggtgtgattacggctttgttggaagacaagtcattgcgcgctgccgccatgcgtggaaacgcagttggggccttgcaagtgcaaacaccaggtgacaatgatggttatccaacaccagcgcaattggcagcattttatgccgcagaaggagtaagtgaagactaatgaagttacaagtagcaattgatcgtgtgtcattagcacacgccattgcattggcgaaggaccttgatggttttgctgatgtgattgaactcggtacatctttggtaaaggactatggcttgattgccttgtcagatatcaaggcagaaattaagcattcagaattgttgatggacttgaaggccatcgacgaaggtgtttatgaattcaacaagggttttgaagccaatgctgacattttgacggtcatggggtcagccgacttatcaacgatcagtgccgtatatgaggtgacagaaaacgcgggcaagacaatgttgattgacttgttgaacatgacggatgaggagattgcaccattgatgacgtttgaccacgccatctttggattgcaccactcacacgataatgccgccaacttcgatgcagccgggtcagttaagcacttccatgaacaattcccagctgcaaagcgcattgccgtggctggtgggattgatttggaccaagtgaagaagttgtcagcggatggcattgctgaaattgcaattgttggtggaaagattgctggtgcagctgatccagttgcagccggtcgtgaatttaaggaggcgctataatggctttagtaaatgaggtattgtcagaaattcaagaagtgatgacacaagtagatgacgtccaactggacgctgctgaaaatatcatcacgaaggacaagcgcatcttcgtattgggcgctggccgttcaggcttgatggtgaagggttttgccatgcgtttgatgcacatcggttacacggtgttcgtcattggcgagacgattacgccgtcaattgctgaaggggatgtcttggtggcggtctcaggttctggtacaacgggttcagttgttggccctgcgcaaaaggcagctgacaatggtgtccacgtgattggtgtgacgtcaaacccaacctcaccattggcaactttgggcgaggccacgattgtggtacctggtgctaccaaggctggtgacggagtgaagtcaatccaattgttgagcacgttgtttgatcaaagtgtgcacattacgttggatatcttgacgttgatgattagccgtcgtgaccacgtgtcaaacgacactgccaaggccacacactcaaacatggaatagtattacattaagtttcaaacctttactcaaaaaaatctcactgaaaaaataaagcggctccctggtgatgcggggagccgcttttttgcagaccttaaaaccagtaattaccggataagaggcgtaagattgatatgatatttttgaaatggggttaatgaagatgtatgtgattgaatattatggtgggtatgttggggatgctgtaaatggtcaggtccagacgacatttagtccgtttacggcgaagcagttttggtctgagatagatgcacagaactttatgtatcaacatggcattgcgtttatgggcaagattgtacggatgtagttgggcactaatttcataaaatcgttcgcaagacagctatttagtaaatggttttacaggtataatgataaccatactagattgtggaaggagactgatcgtgatgaaaaaagcgtcgattaaagatgtggcaaatttagcaggtgtgtcaccgacaacggtctcacaagtgctgaataaacgaaatgatcattttccacaggaaacgattgataaagtgcttgctgcacagaaagaactgggctacgtgccaaatcaaagtgcgaagagcttgcgtggtaatgcgaatcccttgattggggtgctggtacccagtttgcggaatccgttcttctcagatttgatgcaaagtatgcaagaacacgcgcatggcatagctgacctagcgtttttttcagcgacggatgacgagattgaccaagctattttgacgttgattgggcgtggcgttaatggcttagtgattgcacgcatgttgccacacgtgcaagatgtgaacacctatctcaacaagcagaagctgccatacgtggttttggaccaaaccaatgatgatagtgatgctgattccgtgaagacgaatgaatatcaaggtggggtgacggttgctgaacatttgctacaattgggccaccgtgatgttgcgctaattttgcctgactacctaacagaaaatttgcgtgagcgtattcaaggctttgaagatacggtcaaccagacggcaaacaccagtattacacgttttgaaacgtcgatgtcgaaacacggcggcttagcaattgcctcacgcgttaagcgagcaaacgtgacagcggcatttgccctaaacgatgaattggccattggcttattacgtggtttgaaaaatgccggcgtggacgtgcccaaaacatttagtgtggttggttatgacaatacggactattcagaatttatggtaccctcagtaaccacggtcacgcagccagtttggcgaatggggcagattgctctggacatggtattagctcggattaacgatccgagcattgccaagcaaacggaaattttagatactcatttaattattagagaatcaacagattcgattaaataacattgatatgatgccaatcaagcattaaaagcgacgcgtttttagtgcttgatttttttatttgggcaaatgtaagggtttacattgtgtttattcggtgtatattaaaacttgtaaaacgatttacaaaaacgatttacatagaaattataacgtttgtttgggggacattcatcatgaagaaggttggaattttgaattctgagctagcttacacggtagcacaaatgggacataaggatacgttggcgattggggatgccggtttgccggtgccagctgggaccaagaagattgacctggccgtgacgttccaaacgccagatttccaaacggtacttgaaaatgttttgacggaaatgcaagttgaagccatcacgttagccgaggaaatcaagacggaaaatccagatcaattagcggcaatcttagcagttttgccaaatgttgatgtgacgtttgtaccgcatgaggaatttaagcaacaattgggggccacacgggcagtggttcgaacgggtgaatcacatccgttcgctaatattattttgcgtagtggcgtggcattttagtcgaaggggataaatcatggaaaacatgggggcgaaggttgtacgaccttttacaaagcatattgatgaattgtcggatgggtatttaacgaagacgccgttgttccaattcattgtggtttcgctaatcttcccaatgtggggagcggcagctagtctgaatgacatcttaatcacgcagtttaagacagtctttcaactgaatgatgcctcaaccgcattcgtgcagtcagcgttttacggtgggtatttcttaattgcgattccggcatcattggttatcaagaaaacatcttataaatttgcgattatgttggggctgattgcttacattattggcgcaggattattcttcccggcttcacgtgttgcaacgtactcaatgttcctatttgccatttttgctatcgcgattgggttgtcattcttggaaacggccagtgatacctatagttcgatgcttggacctaagaagtatgcgaacttgcgtttaaacatctcagccgcattgaccccattgggagatattgctggaattctacttggaaagtacatgatttttagcacaggcggtaatttggcgaccaagatggcgggcatgcacggtgctgaacgaattgcctatggtgaaaagatgttgcaattaaccttgcaaccatacaagtacatcatcggtgtcttgattattatgttgttgatcttggctgtgactaagatgccaagcgctaagccaaaggttgaaacactggctggtgaagaggccactgaaaaagccactttgggtgaaaccatcaagtacttgttgggaaacttccgttataagaaggggatcctcgcccaattcgtttacgttggaatgcaaacaacggtttggtcatttacaattcgtttggccttggatttgaataagcaaattagtgatgcggatgccacaacctttatggtctattcatatgcgatgtggttcgttggtaaagtggttgcaacctggttcttgggccgttataaggtcgcaaccgtgttgagtatctactcagtgttgggaaccattactttactgatcacgacattcggtcaaggcatgattgcggtatacgcagctgtgtttgtgagcttcttctttggtccacaatggccaacgatttacgcccacacattggataatgtcgcagataagaagtataccgaaacggccggtgccattttggtaatggcgattgttggtggtgcagtatggccactattccaagggttggtatctgactggtctggttcaatgcaattgtcattcattgtgccaactatcgcatttatgatcgtgtcatggtacttcatctctgaaatgaagtatgcaaaggaagaaaagtaggtaattgtgatgaataagattgttgtcattggtagtttgaatttagacattattcaaaacatttcgcgtttgccattgcagggtgagacgctgcgagttgattcgcgtggcacgaatttaggtggtaagggtgcgaaccaagctgtcgcagcagcccgtcaaggtgccgacgtgagtttcattggggctattggtcaggatgctgcaggtgtgcaattcaggaatttacttgaagatgaaggcattaacacagctggcctggttgaaaaagaagacgctacaggtaccgcaacgattttgctagaagaagatggccacaatacgattttggtgtatggtggtgcgaacatgaagctgacagcagacgatgtggtgaagtcagaacaacttattgcggaagctgattttgtgattgcgcagtttgaagttgcccaagaggcggttgcgaagggattctatctggctaagaaatacggtgtcacgacagtgcttaacccagcaccggtcttgaattacaaagatattgatccagcaattcttgctgcaacggacattattgtgccaaacgaaacagaagcagcggctttgctaaattgcgaaccatcaactgatttcgatgacttattggatatcagtgatcaatttgcggacctctcaattacgggtacaattgtgactttgggtgaagatggggtttactacaagttagctggccgagatgcacgcacccaaccaatttttaaagtgaaggcggtcgatacaaccgctgcgggtgacacatttattggggcgacgtttgcttacctaaatgctgattgcacgaatattgatgacgcaattcaatatgcatccaaggcgtcgtcaattgcggtttcacattcaggggctattcggtcaatcccaacgaagaaggctgtgttggcatcattaaatttggtacatgcatagttggaggtgatctgatggacacagtagaacaaaagcgcgcggctggaaagtacgctacgacgttaattgaaaatggcatggttgtcggccttggcacaggttcaacggttaagtttttcgtcgaagaactgggacgccgcgtcaatgaagaaggattagacattgtcggggtgacaacatcgacgcgcacagctgaacaggccaggactttaggcattgctttggcagatgtagatgatgttgaccacattgatattaccgtcgatggtgctgatgttgttgatgcacaattgaatgggattaaaggtggtggagcggcgctgttgtacgaaaaggttgtcgctaaaaactctcgccggaatgtttggattgttgatgcgtcaaaggtgcacgaggagctgggtcattttccattgccggttgaagttgtcacttatggtgctgagcagctgtgccgggtctttgataaccatggcttgcacccggtgctacgtcgtacggctgatggggagccggtgaagacggataacgggaatgagattgtagatttgcatttagatacgattccgtttccaagtgaattagcgaattggttagccaatcaagtaggtgtgattgagcatggtttgttcttaaatgttgctgatgaagtgattgttggtggggatgaaattcaggtgctgaagtcgccagctttgatgtattagatggtagaaagtccgttgagatatgctcgacggacttttttgtgaatatagctaaatgatgcaataaatcaaagttataaagcttgttgttaataagttgatccatttaaaaaagtgatcaacaattaagatccaatttgacgagaaagaggatcacgcgcatgcttaaccaaccaaccaaccaaccaaccaaccaaccaaccaaccaaccaaccaaccaaccaaccaaccaaccaaccaaccaaccaaccaaccaaccaaccaaccaaccaactaggtgagatccgtccatttatcaaatgggtcggtggaaaaaggcagcttctgccagaattggctaagtacgttccaaagcaatttgggacgtattttgagccgtttctgggaggaggtgcctttttgttgtctttggaaccccatgatgcggttgtgaatgactttaatccggaattagcaaacgtttggcgcattgtgcgtgatcgaccagatgaactattagaaaaattggtagaacaccaggctaataattcaaaagaatattacttggatttgcgattgactgatcgtgatggtcgtcttgaagaaatgacagaggttgaacgagcagcgcgattcatttatatgattaaggttggttttaacggtttgtggcgtgtaaacagtaaggggcaaaataacgtaccttatgggaaatacaaaaatccaaagattgcagatgagccaacaattcgacgcgtttccgagtatttgaataacgcgaatatagacgttatgactggtgattttgcaaaagcggtcgaaaaggcacagacaggggactttgtgtattttgatccgccctatattccagctagcgagacggctagtttcacaagttactcaagtgaatttggttatgacgaacaagtgcggttacgtgacttgtttaaagagttaaaagatcgtggtgtattcgtacttctatcaaacaatgatgtgccactgcttcatgaactatatgagggaattggtgtaatcgaaacagtagaagcacatcgtttcgttgcagcgaaagcaagtagtcgagccaaagtttctgaagtgcttgtgcggagttgggagtaagatgaatggcaaaagcaagaactagaaagcaagatatcgcttggcgttatttatttgaccgctttgatataccaaaacaaattgagcaaaacggggcgtatgaaataaccagtagtgacattaataaatacgtacgtgaatattatgccgatcggcctgataatgcgcctgacgcccgaaatttattgaagtttgattttagtagtgacttgccagaagtttttaaagattcggtcgataagaatatttttggtaaaagcgcacagtttactctaatgccaaagggacgggacaggtatgtcatttctgattttaagacgttcgagagtttgaagtatgaagtacttgaaccagttcgaatgacctttccaaagtggatttcaggtattcgcccagaaagtccggaaacaattaatagtgaggctgttgcacaatctgtcgctgaaatgagtggcatgctgaaatatgtgatggatgatttaaatgctgatgttgtggcaacgttaagtggtaagaagggaacaggactgattgattttcaaatcagtcattatcgtaacggccaaactaattttgtgattgatggatggcagtctgaaattgatggtgtttatgagtcgccaagtcgtgtcttgattgtcgaatcgaaaaagaaacgacctgaagattttaatattcgtcagttgtatataccaacgcgtatttatcatgatcagatgaagtttcctaaggaaatttattcagcgtactttacatatactgatgatgtattttcatttcacgtttatcagtttacggatattgatgattttaattcgttaaagaaaattcgtgagtatgaatttgtatttgaagaagaatcgcagccagtaacgcgtgaaactttgaaagttttattggcacagcaaaaagtttcggtagagccaagacgtttggatggtgaattagtaccgtttattcaagctaatgatcctgaaaaaatctttgaaataccagttgttcttagtggtaaaccgcttacgagtgaacaaggggatatatttgagataggtacgaaggagtttttcgcggaagcgttcaagtttgatgtgagacaatcagattattatgcaaacgcggccgaatattttagcttagctcagaaagtagatgggagatttaaagtctctcaattaggacgcgtgtttattgatgcagactataatacgaaaattgggctatttgctaaagagttggtgcaacggccaatttttagagcgatgattgaaatttgggtggctacgggacatttacctgataataaaacagtcggtgaattaatcaaactacatcgaccggacattggtggaagcacagttcctcgtcgggcaagttcggtgaatgcggtgatgaattggtttgtgatgagaattgaatagggtgagaagcacgggataactaatttccgtgctttttcgtagcctccttgtaaataatgtgatctaattaaatgtatatattatttacaaaaatgggagtattgaaatggctgaaatgagttttgaacgagtgacgcttggcactttattttctgataataaaaatttagctgtgccaacctatcaacgtggctacgcttggacaaatcaggagtgggaagatttttggaacgatttagtcgaggtcttagatgagaatgaagatgatcattttttaggacaagtcgttactaataagcttgatagcaatgattatgtggttgatgggcagcaacgagtgacgacatcaacaatatttttagccgtcttacgagatagttttaatagtttggattcagaacgagcccgtatgcgtgcgcaagaccttcaaaagaagtctattggtcgccgaggaaactataactttacacaagctgaacaagttgctgatttttttagtcgattgattcaaaatgaagcgttctcttttagcgaggtaaaggggcaagctagccaagacagtgagcgcaattttgtgaaagcttacgattatttgtacaagcgtgtgggtgaacgattaaaggattttaagacggttgacgatagggttgaatttttagaagatttgcaggatgcatttcttgatcacatgtttgttatgaagatttcaacgccagatgaagcaagtgcctttgttatctttgaaacgttgaatgctcgtggtcgtgacttgaatagttccgacctcttgaaaaatcatctattccgcaaagctagtggcgatcccgacatacagcgccattgggaagaaatgatgactccattagatttcaattctgatcgtgctacgaagttcattcgtgcatactggaatggaacacatgacttcgttactgagaagaagttgtatcgtgctttgaatcgaagtgtggagactaagagcgatgcaacgcgattggttcagaagctttcagatttgtcagatgaatttgcctctatgctagatccaaagaaccaaatttcgtttcatgatgaaacattgattaataacttgtatgtacttaatcaattgggagcaaagactttttatccgctaattctagttatggttgaaaaagactttgacgaagcagaaatcacacaagtgttgcataagattatttcgtttacgattagaaactttactattggtggtctagtagccaataagtttgaaaaatcgtttgcaacaattgcgagaaagctaagcgatggcgaaattattactgttaaggatattaatggtttaatttcagaagagatggttgatgatcaaaagtttatgaatgacctggcattagcttcgctttctactgaaaaaacagctaaatatgtgttatccgagttggcgtatcctgatgatgaaagtaaaatcgtcttggctgatgtaaaagtgacctatattaacgaaaatgtggagaacaaggatcgtatcggtaataagctattgataacaaaggaagaggctaagtcgtttaaagattctgcttctagaaagcaggcagttatagatggttcaaagtttgaagatactcgaaagtgggcgaataaattaaatgtaatgacgtcagaagagattgacgaacgacaggcttcttggattcgagctgctttgctgatttgggcgaagtaaaagcaaacaaatggactatttatgacaaagaggctgagacagaatgattttttgatagaaaataattcgtgattcaaagttgtttcagctgaattaattcatatacaaaataaaaaccgaaggaatacgcacgttaaaatgcgagtccttcggtttttgtgtcgattaaaacagttttgtcccagcccctttcttgtgagaaattgacgttagataatctaatttgattggttattatacgaaacgtatccacagagtaaatttttaacgtatagtgtggaagaatttaaggttataataaagtagtgtggggtttagtgtatatttcaccttttacggaggcttttaatgtgtggtacgtaattcttacggattatcagaatgtaggcatgcttgtttgtattaatgggaacatatctaaagttttttcatatagaaatggttggttaaattttaattttttaccgtacatagattcgtcaaatgaagatgttgctgaagagtatcgagaaatagacttcgaagaaaaaaatagattaatcactgaaaaaggaatagttgatgggtctaatgcgtttaattgggcaaatcaataaagaggatgtagaaatgagtattagtaataatgataaagataatgcacgggactttatagagaaaaatcgtgctagtggtgttgaatgggaagaccttaaaatcgtgaattttatgccgtataccaaatatgcacaaaccgaagccgaaaggttcacggttctaacagagtttcagagttttctaaatacggctacttatgcagaatggcaagatttagttgcaagtgagcaggctatgctagatagtgcttctttggaatctgaaaattttggaaataaagacgttgctagtaatgtctttatttctaaggctgaaaccagctcatgggttcaatacacaaaacaattacgtaataaaaattggtcagaaggcgccatcgagggcataaaaaaatccgcttttaacattttaaaacgattgagtacggatacgacagaaactggtccaattaaaggattggtactgggaaatgttcagtctggtaaaactgctaatatggctggactaatggcgatggcagctgataacgggtggaattacgttattgtgttaactggcatgatcgaaaatctgagattacaaaatcagaagcgattactaagtgatcttagcggtaattctgcagcacaatttgaatcgatcgagaatccgagtcttagatctcagagacaaatttcagatcttaacttaacgggtaacaaggtgtacttaacggttggactaaaaaatagtacgcgtttaaaaaatttggttcgctggctatatagcgatatcaatagggcaagacagctaaagctgctgattattgatgacgaggctgatcaggctagtgtaaatgttaagaagattactgatgaggacgacgaacaacaggaaagaacggctgtgaacaaagctatcttggatcttgttcatggggtaaatgacatcaaacccaaggcgtctaattatattgcgtacaccgctaccccgtacgcaaatgtcttaaatgaggcgggagagaacacattatatccctctgactttatctatagtttgacaccttcaccagattacatagggccacagcaattgttcggtacggaagagccagaacaacaggctgcactgaatataattcgagatattaagcaaccagacgaagaaattataaagcagttgaatggcggtgaagcggttgaaataccggattctatgaaaagggctattgattggtttttaattgcaacgagtgctatgcgtgcacgcttcgtacaggggaaaactgcacctagaccggtttctatgttgatccatacaagtcaactggttaatgctcataagtccgttgcactcgctgtacaagagtatttgttacatataaaaaacgatccgctatggttggcaaatgctgagacgttatacagaaatgaaaaaaatgcgtttccacaatccgcgtttattcatgaaatgtctgaatacacggtaccacgtttgaaaatcgcagactatccagagtgggaggatgtcaaggaacaacttgaacactattacttcgtcttagatgatagggagttcctaaattttgctcaattagacgaagacaaagcaatgagttttgttaagggatttacgatggcgattgataatgctgctgtacgtgggagtcaatcggagcatattcgtcttgcgtatccaccttcgccaaatgatataacgcctgttatcgtaatcggtggagcaacactgtcacgaggattaacgttagaaggcctgatttcgacgtattttgttcgaactactaagactgcagatacgttgatgcaaatgggaagatggtttgggttcaggacagggtacgaagtatttccaagaatttggcttacggccgatgcatttcaccgttttgaatttatttctcaaatggatgctgatcttcgagttgaaattcaaaaatatactgcagttctaaagccaagtgagataggacctaaaataaagaactctccaaatcacagatttgtggagataactgccaataataagaagcaaagcgctactgaaacggatttagacttccaaggtatttcaaagcagactacggtgtttgaaaagaacaatgtggatatactaaaaaataacgttgaaataactgaaaagctgattgatggattagacgataacatgatcacgaccaaatcaaaccgaggcaagttgcctgctttggtttggagagatgttgactttgacgtagtgaagccgtttttgactgactataaagctcccgaccgagatttatttttcagtaatttaaatgcgttagtagagtggtatgaagaatcatttttgtctagaggcgaagccacaaagtggaatattattattcctagcgtggaaggtaatagagcacgctggcaagttaaagactatgacttaggaaaggtaaatcgttcacaatacgggcaagatgagaacggagtaatctcaattcacacactacgatcaggcggtgatattgggctggattatggcttggataaaacgcaatcaaaaacctggagtgatgtgttacgtgcacgagaagaagatgggttaggaaataatccgcaactgattatttatcgcattgataaggattcaacgtaccaaggaaacgcattaggttctcggcgtgatttgaatgccgctgatgatttaatcggaattaacatttctatacctggaaatacgtctgaagagtcattgggtaagagtattcaaattaaaattcctaaagacagttattcaattgaggaggactagatgtacttacagatgatgcctcgagaaagaatggggcaagacgggaaggcattactacgaagcttacaaaatgaatcgatatcacttgttgatttgttgattcgtgagtcgtttcagaatagtttggatgccacattgagtgaagtggatgagacgctgatcgatgttgatgtaaaaaatttttctacagaaaaactagcagatgttttgcctggaatcgatgatgggttacggtaccgatacggacaacaactacaaacggcaatcgttatcggcgatcgaaatacaactggattagaaggtagtgtacgagatgatgatggaatcaatcttcgtgacagtaatctatataaactagtgtatggaattgcaatgaatcagagtaaggaaggcgcaggtggttcttggggacttggtaaaacaagttatttccgtgttggacctggcttggtgttctattacacaagagttaagttggataatagctcttatggtgaaagacttgttgcgtccttaattgaaaatccggagaatccagatcggttactcaaaaaaagcgagcgtggaatagcttggtggggaacaaaagattctaaaaatcaatctaactatagtgagcccacttatccagtcactgatgagtctgaaatttcagatatgttatctatctttggattacaaagttatagtggaaatgaaacaggtacaagaatcattattccgtttgtaaatgagcaaaagttgcttccgtacaaacatcaggataatgcccctgtatggcaaaaagaattaagcacagcattggattttgcaattcaacgctggtatgcgcctcggatagaaaattctgaatatcaacaacgttttggtagctttttacgagttcgtttgaatggtgaagagatagatggcaatagtaataacacagtgtttaatgtatttactactttgtataaatctgccttgacgggtaatcctatcggtcggattcaagtcaaagaaattgaacttcggaatgtcacgaagcagggaatagttgggcgtgtagcgttcagagtatatgacctagatgaactgcaagcgatgggaatggtctataaaacaccggagatttatcttacgatgaatgtatctgatactgaagatgaattatcatatgtaaatcgcaaatttttagcttttgcaagacaaccggggatggtagtcaaatatgatctcgatggggaatggacaaaagatatacaagttgaagatggcaagttcctattggcgtttttcgttccaaatagcaaagcgccactgaaggaactttattctgatccgaataatgataagcaatttagaactttggaagattatctcagaggtactgaaaatgcagatcacgctgattgggatgatatcacaattaacggaggtcagatgaccatcgttcgtcgtattaagggcaggattcttaagagcattaatgaagagttgcgtgacgatgagggtaagcaaacttctgttgcatcaagaatgggtaggaagtttggtagcttgttattaccgcagcgttctgctggaaatgctgcacggcccaaggcaaatgataagcctaagtcaggaggttctaatggcgttaagaatcgtcgggcaactctaaatttgatttcaacgagtccaaaatctcaaacgaattatcaaacaatttatgcgatggatacagaggtttatcttgcggcaaacacggtagcaaatgtccaggtacttattcaagctgcaagtcaaaaattcagtgcggcagagtgggaacagcaaacagatttgttatcaccgtttgatattagtaatccagcagtctatggggatgctagtgaaaaaatagaagttgatactcttgcggagtaccttgatcagggcgaatttgctttgaaaaatacgtcaactgaaaatctaacgtttaaattgatgtttgaactaatcgcagagcgtggtcaacatttatcacccattctcgaaataacagataagacaggaaaaaagggtggtgaataatggcaaataagattgcgttatatcgtcaatttaattctgaaatggcgatggaaagttcattgaatatatctgagcctgagttttcttttttgaaggatgggacagttacatccctgaagacagggaacgctgacagaaagaaccaatattatttggatgatgtagatgaaggatgggatgtaacccaagatgaccttagagtagaacgtacagttacattttctgatgtgtctcgtctttttggagcggatgggttgcttggtaccgaaggtgaaatcggtattgcggcacacgtatattcacagacgtcaggttatcaagataacattccctttggaaaatttaatgtaacacaaaagtttggtgaattcagatttagaaaagcatttgagccagcctttttgaagggatctatcaaagtagaaatttatttatacgtaagtaagctagggcaagaagggcctttctttgcagatattattggtgcaaaattgggcatgatttcatcatttgaaattattgtggatggagatggagctgttttcccaattgtagaggttgataagccagggaacccattgtgggcattggttgttgtgccaggggttgattttgctacggaccagttttctgcagataatgcacgattagaattgaataaaaaacaccccatgtttaagcaactcgcagaggcgaaaactagaatagcgaattatttaatgatcgaaattttagcaaacgctatgacgcaacttattttcatggggaaagaagaattggacactttatcttctgaggatcttattcaaggaagcctggcctccgctatcaattattggattgaaacatttgagttggaaattgacaatttttcagagaccaattcgcaacttagattgcaattagaagaaactgtggcaggagagtaacggcaatgctagatattaatacagtgacgtatacgcgggaagctgctgaaaagtcatttgaaaacctacctaatgatttttcgacgttttctgtatcaacgccagatggtaagttattgcgagaacaactgttagaaattgacagccaaaaccagggcaaaagttcttatgattatgatgtttcgtttgcgatagacatgtactcgctctttaaagatgaatatagtattaataatttgacagctgtttcagaagacttttggcgttggttacagttggaaataattccagatattgtgtttaataggcatggaaaaaaggaaaaacagttttattcagagcgacgacgaatttggctgagacagatgtggtggtatatccacctatcgtggcaaggcgattctgagaccacgtcgatagtattaaaaaacaatacgacggatactgttatgagtttagtggaccgtatcggtgtggggtatgatgtgaatgtttatcgggaaataatgaaacaatatgcaccgtttggacctgaacgagatattttcagacgcgtaatggttttgcatgtggcgcagggcgaattgattgcacctgaactagttgaaggtggggttcaagggtatgtatctagattatttggtgaaataaatgccgaatagtttttcatttgaactgatggatagggtgttaattcctaatttaaataaatcgcaaaccttcagaattctttcaggatttgtatctggtaattttttaagcgaaattgtgaaactatatccggaagttaattttgaagtgtatgttggcatggcgaatcaaggaattgccacggaagatttttatatatttaggcgattagccaacgaatcctcagtaaaagtgttttttcaagaaagcgcgccggttacgcatattaaggcgtatgaatggaaattaactgatgatacggttaaacaaatggcaggttcggcaaattttagtaccaacgggttcttgctttttcacgagttactagttgaaacaagttttgacatgaacctacttataaaacagagtggtagatttgttgatgtccttgatccagaagctgaaaaatttgttgggaaaccagtagaagcgtccgaagttaaaggcgaagcgcacgatgtccaaaaacaggtacttgatttttggttagaacaacaaacgtctcggactgcacattctgaatatgtggccacattcaagcgggaaaaacagatcaacaaatttaacaaagcaatagacgttccggttttgtcctattcgaaggatagacacggtgtagaaacattagagtccaaagcaggacgaaccagagatatggaattatttccattggatgatacgtttatggttttgacggatgatgggtacaaaatttcaatgcatcgacaaggccttttcggaaaattgcttacatcggagaactttgaattaggtagttatttaagaaaacggctatcactaaatgacgatgaaggaataacccaggcaagtttagacaaatatggtcgatcgtcgataaaattttacgcgacggacgatgacaaactgtttttattcgatttttcgaagaatgcatagaaaggcactttttgtgcctttttcgtttagtcaatgaaatatattgagaatacggggtatacttataaaagtttaaaaataggttaagggtgattaaattcatgataatttttattttagttatggtcatttttgtagcagttggagttctgttactgactaaatcgtcagaaaaagacgtagaactaaagcccgagagacatgaaagtgaacgcaaaatcgagaattctgtgggttcagagtcaatgggtctaagaaatgaagcggttaatcgttctattgattcatcttcggtagcgcaatcggccactaaatcggcgtctacgtcttctacatataacaaaagagagctgtctttgtttgacaatgaagcaaggtctgcttcgttgtcggtatcggccgtacagtcgttggctagagatgcgtcgatatcagcagaggtacttacttatagcaaagctagtcagaaaagtgcgtcgatttcattagcaaattcgagtgacgataatgttattaaaaagagcataattcaatcaaactcattgtctgcgacgcgtgagtcttctgaggcgggcgaccatgcaacggtctcatcccatgcagtagaatcagcatctatatcagattcgatagcggagtctgagtcgatgtcactatctgtattaaactctcttgcaagatcttcatctattgctatgtcacttgaacgttcaagtgcttggtcagcttctaagtcggcgtcaaaagcagcttctaagtccgcatctatagtagcgtataggtcaacagccagttcaattgcctcagagcgagctgcgtggaagtcggcatcatatgctcgttctgagtcaaaagcggcttcgaagtcggcttccagagcagcgtctatttcgtcggcgcggtcagcttcatcagcgatatcagcgtataagtcggcatctcttgcatcatcagcaaagcggtcaatcgcacgatcgatatcaaatgcagagtcgatggcgcgctcaaaaagttttgaatcctatatgtcatcgctaagtgtggcatcgtcagcttcaattgcgatatccatcgccaaatcaattgaattatcagagtcagtttctgcctctgaatctttttcaaattcagtatcacagtcaatttcgcattctatctctgcatataattcagaaaggtcatcgttgtctgcttcgattgcaacttcgcaatcggtggcctactcggtgtcaaccgcagtgtctttgtcacattcgctatcgaattctattgaattttctaagtctgcatcgatagctgaagaaaaatatctgaatagtgttcacgacacagaaacagcaacatctgttctgagctttcaagatgagcaatttgaaaacggacaatcaatgctaagagaattagctttagaaaagtatgtgtctttcgaagggtttgcaggcgcagtgggaattgcaattgagagacttgaagattttgaaagtggtattgtgcaaccatcaaggctagagtttaagcgaattaataaaactttggagctttctacagaacaagctgctcaattaaagtcttcgatggacttattgagtagaaatgaaaagaagaagctagttcgatctggtgttattccaagttctgagaatgtacaagaagaaaatttgttcaagcgttttagggaacgaacttttgataatttgaaagatatggcgttggctacggaaataagttccctagaattgagagattttcaggcaggttataaaactccttctgttcatgaatataaagttatatctagtgcattgaacttaacttcagatgaggattctgagctaagaaagtatttagggattcaagacctgaatgtacttgacaacgagattcaccccaatataattgcagcgtcagcgtcagcgtcagcgtcagcgtcagcgtcagcgtcagcgtcagcgtcagcgtcagtgatctacaaagcggacgacgggaatcgaacccgcattcccagcttggaaggctggagcactagccattgtactacatccgcatgagcgctttttataactcgttgcctcaacaacataatttataatacacactcttatgcaaaacgtcaacccttttgttcaaataaagttgaaattagtttttcctacttgtgaacaaacatcgcatccccgaatgagaagaaacgatattgctctgcgattgcgtgttggtaggcattcagaatgttttcacgtcctgtaaatgcagcgactaacataaccaatgttgacttaggcaagtggaagttggtaataaacgcatcaacaactgtccacttgtaccctggcttgataaagatgtccgtccaaccagaatcttctcgcaactcaccattgaattttgaaccaattgtttctaaggtacgaattgacgtcgtccctgtcgcaataatacgaccaccgtttgctttaacattgttcaacgtttgtgctgcctcagctgatagttgatagaattctgagtgcatcttgtgatcttcgatattctcttcttcaaccggacggaaagttcctagcccaacgtgcaacgttaactcaacaagcttcacacccttgtcggcagccttttgcaacaattcaggcgtccagtgtaacccagccgttggtgcggccgctgaaccatttacctttgagtaaacagtttggtagcgttccttatcatccaacttttccttaatatatggtggcaaaggcatctcacctagtgattccaaaatttctaggaaaataccatcatacttaaactcgatcatccgaccaccgtgttcaagttcttccgtcaccactgcggtcaattgtccatcaccaaacgtaatttcttgtccaactgggtactttttagcaggcttcacaagtgtttcccatacatccccatgatcttgccgaagtagcaacacttcgacgtgaccaccagtaccgggacgttcgccatacaaacgcgctggcaaaacacgggaattgttcatcaccaaagcatcacctggattaagataatccaaaatgtcatagaaatggcgatcgtgtacttcacccgtaactgcatttaattccagcaggcgtgaaccatcacgacgttccaatggtgtctgagcaattaactcatgtggtaagtcataatcaaaatcttcgagtgtgtaatgttcttcagtcatttatttcaacccttcttttcaatataaggtaaatccaagtgtgcatacgcagcttgcgtcacgacacgtccacgaggagtccgttgcaggaagccgatttgcaataggtacggttcatacattgactcaattgtgtcgacttcttcaccaatgttcgctgcaattgtattcacgccgactggaccaccttgataaaattcaatcatcgtgcgtaaaattttgtgatcgacttcgtctagaccggcttcatcaactttcagcaaatctaatgaaaagttcaccatatcatcgtcaatatagtcacgatccttaaccatcgcaaaatcacgcacccgacgcaacaagcggttagcgacacgcggcgtgccccgtgatcgccgagctaattcaaacgccccgtctggttgaatttccgtatcaaatatatcagctgaacgcttaataatttcagccaactcatccgtattgtaataggccatgtgctcaacaataccaaatcggtcacgcaacggttgcgataacataccagcacgcgttgttgcgccaatcaaggtaaacggtggcaacgggaagtgaatcggccgggctgtcggaccttcgcctgcaatgatatcaacataaaagtcttccattgccgaatacagcatttcctctaccgttttcggcatacgatgaatttcgtcaataaacaagacatcgccgggctgtaattcatttaataatgctaacaaatcacccgatttttcaattgctggtccggaagttgtccgtaacccgacacccatctcatttgcgataaccatcgccaacgtcgtctttccaagtcccggcggtccatagagtagcacatgatccaacggttcttcacgctgacgagctgcttgaatataaacctgtaaccgttgtttcaatggctcttgaccaatgtactgtcgcaacgtactaggacgcaatgatttctcaatcgactcttcgcctaattccgcactggtatcacgcaatatatcatctgccattggataccatcctttctatctcttactgcaacaaacgcaatccagcactaacatactccgccgtggtcatttgcgcttccttagtcaacactttttcaacccgcgtaatgtccttcttcgcatagccgagtgcttccagcgctaataaggcatccgctaattctggattatcgctcgtttgcttttcaggcaaaaccaagttgatttcaatatcattattaaatggcaaatcacccaacttattttgcaagtccaacacaatttgttgggcagtcttcttaccaatacccgggaatttcgttaagaatgtaatatcgttatccgcaatcgcttgaacaagccccgtatggtcggcattcgccaaaattgctaacgctgacttcggcccaatccccgacacatttaacaacttttgaaacaacaacttttcatcggctgtcaaaaagccatacaatgattgttcattttcacgaataatttgttccacataaacccgttctaactcattcattggaaaagcataggggttcgccaccaaaacacggtagccaatgccgccaacttcaacgacaatataatttggtgcaacttctgttataacaccgtttaaatattcgtacattttcgtcgaacctcgcttaatttctatttattagtataccagaaaattaggttatctcgaattccacgccaaaccttatgatgtcttcagaataagaacagaaaattcatatttaattcacaactactgaatatgataactatatcgacttgatattaatcagttgttcaacccacgaacgactgcaagtcgattcgtcacccacatggcgattgattcagcttacccaagcgaatctactcaattaatatctcttatataacctacaacaaaaatggacctcgtcttcgtgacaaggtccatttttgtttagtcagcgttgatatcaataaagtcccacttctcaaaatcaaataacccttgatccgtaattttaagacttggaataacaggtaaggccataaacgatagtgtttgaaaaatatcgaacgacacatcactaatagcggccagacaagtgtgcagtgcctttgtttgggtcacaatcgtcttagctgatgctgacgacatcaccccaccgatatcgagtggcaatgacgtaaccgtaccatcatctgacacgaccaccatgccaccacccatcgcgatcaattcttcagccgctcgcaacatcaagtcatctgtgacccccgcaatcaccatattgtgagaatcgtttgaaaaagtcgttccaaccgcgccgtgacgaagacccaacccccgaataataccgacaccatttcccaaatcatgatatcgttcggcgaccgtaattttagcaaactcggcattcgcaacaaatcggccatgcgcatcacgtggcacctcaagaattgcatgtgtggtgtcgatatgacctggtttcacatcaatcacatgggcacgcccagtgtccagcggtaacgccaagtccgatgcctgcagtgtgaccgtcattaggttctcagcaaatcgattaggtgtaattgggtcatcaaatgattgccacgcaccaccaaccataactgcctgtggcgaaagcgttgtcaaatcggtcgttagaaacaaatccgcctggtacccagcagccaaggcccccacatccattaattggtgagcctgggctgcatataatgttgccaaggtcagcgcttgtgtaagtggcataccatgtgccaccgctacacgtacactatgatcaatcgagccattttcaacaatatcaacacttgtcttatcatccgttgcaaaggagaaacgctgttgattagttgccgtaattgccggcagaatcgcaacttcatcttgttcaaccgtcccttcacgcacaagtacatgcatcccaagattgacccgatcaagcgccgaggcagcatccgttgcttcgtgatctgtcgaaatccccacggcccgataatcagccagttgcgtcgctgtcaagccggccccgtgtccatcgactggtttatgtgctgccaaagcatcggcaatcttttgttgcatgtcagcatcatgattaactaccgccggataatccatcacttcagcaaggccaccgacaaccgcatctgcataaaatggtcgcaagtcacttgcggttaatttagcccccgtgcgttcgaacgccgtggctggaaccgaagacggcaacatcacgtgatagttaaatggcgttcgctttgcttcatcaagcatatattgcacagccgctgcaccagccacattggcaatctcatgcggatcgatgaacgcacgggtcacaccgtgttgtaacaacacggtggccaaggtcgttggtgcaaaggttgtgctttcaacgtgcatatgcgtatcaatcaaccccggaataataaactgaccggcggcatcataagtagttaatgcctcgtaggccgttgtgtcacctcgaaaaacgatccggtcttgcgcaatccaaagcgtttcgggttcaaacgtttgtgaaaatacatttaatacctgaccattaataatttttaaatcgactgtcgtcatcttttcttccttatatacaataaagtgcggtgtcaccaccgcacgtaacgtcacttaatttttagcgtagtttggcgcatctttcgtcaactccacatcgtgtgggtgactctcagctaaaccagctgccgtgatttgcacaaattgcgcttcttcacgtagttgattaattgtcgccgctcctgtgtaacccataccagaacgcaaaccgccagcaatttggaaaagattatctgtcaggtcccccgtcatgatttggtcatcaaccatcgtggcaatcgccccagctgcaatggctttaacaatatcacctgagtaacgaataccagcacccaagatgacggcggcatcaaattcggcggccaattcagcaaatgccagcgttgttgtcactgtatagaccggttggcctggtgtaggcgccacaacaagtgcatcgatgcctgtcgccaatacctggcgggcaatcgcttcatcagcgactggaccgactaaaattgtcaacggcggcacttgttgcgccagtaacttgagtgattcaatagccaaatcaagttgatcatccaattcgtaatagatgacgcttgcgccagccgcatgtaatgtcacggctgtttcaaacgcgtcaggcgcattacggaccgccaccccaattgtcttcgcctcatcggcagctcgtaaatcttgaacatcttgtagttgcgtttcccccgctggcaaaattgccagtgcaccgttttctgaaaattgttgtgcaacttgcttatcagtcatcgccggtgccccaatcactggcaatgccaaggcaacagttggtgacagctgcgttcccaatacaaccgaatttggtaagacgtcagatgcacgaggcaccaacaacacttgatccaaacttaaccctgtcgtaaccgtttctgtcgtcattttgatgttccccctattgttctgccacgatgcgtgcgacttgtggcaaatgcgtgtaatcgatatcagccttatcattgtgaaggtggccggctgttgccgcctgacgaattgaattaacacctgcagcgccaagaccacgtcgaacatcgaccatcacttgatttaggacatccgttagcgcacccttgtatgccgtacgcgcttcaatcccttcaggaaccattttatttgcttcattaacttcgccttggaagtaacgatcttttgaaccgttttccatggcagcaattgaccccatcccacggtatgacttgtattgataaccagtgtgttcatcagtaaacacctcgcctggtgcttcaagcgtgccggccaacattgaccccaacatgaccgcattaccacctgaaataagtgccttcacaatgtcgttggcatctttgataccaccatccgcaataatcgtcttaccatatcgcttggccacttcagctgctgccgcaatggctgaaacttgtgggacacccacgccagcgactacgcgggtcgtgcaaattgagcccggcccgataccaaccttaaccacgtcggctccagcgtcgtacaacgctgctgcgccggctgccgtcgcaatattacctgcaataatgtttaacgatggaaaggcatcgcggacttctcgcactttgcgcagcaccccttcagaatgaccgtgggctgaatcgagcacaatcgcatcagcccccgccgcaaccaacgcacctacacgtttgatcgtatctgaggtcaccccaaccgcaccagcaaccagtaggtgaccattaaaatcaactgctgcttgtgggtaacgagctggatcaacaacggcttgcttaactttttgtacctcagctgcttggtccgcaatgaccatattcttgtgtaccacacccataccaccaagcaaggcaatttgggttgccaaacgcgcttccgtcaccgtatccatcgctgcagacaagactggcatatgcaactgtaatgacggcgttaaattggttgctaacgagacatcgttggcagggacaacctgtgcgttcgtcgttaacacttgcacatcctcaaaggtcaaccccattggaacaaatttgttggttacactaaactgagacataaaaccctccaaaatttttgtaacaaaaaagcatttctggatacagcgatccacaaatgcttgcaaagagagtctcttattcagtcatttgcggattgtcgccactttcggtaggcggtagaaactcgctggccattttccagcaattaaatctgcaagtgcaaaaatgatttttgtgtaaaagttattgttcaatatattacacgtcttatgaaggattgcaagtgctgatgccgaataaaatcatttaacttgcattttaagttcggttaacagttttacattagacaatccgggtgcatcttccgaaaaataagcgtacaattgtctcttggaattaaataactgtggaaaaaggagacttctttatgaccaagaaattagccggtctcccaacttggcaacgtaacctatttgttttatggttcggtgtctttatgaccggtatcggatttagtgaagtcttgccattcttatcactctacgttgatacgcttggtaacttcagtaaaaatcagctcaccttttatagtgggctagcttttgccatcacctttttgatgacagcgattgtgtcacctttctggggtaagttagcagatagcaaaggacgtaagttaatgctcctgcgcgcctcacttggtatggccatcgtgtttctgctcatgggacttgcccaaaacatttggcaattagtgttcctgcgggctttgcaggggttatttggtggtttcgtttcaaacgcgaatgccatgattgcaacgcagaccccgaaggaacgttcagggtacgcccttgggatgttagtgactggggtaaccggtggtcaactacttggcccattcatcggtggtatcttagcatccgtggtaagctatcgcgtttcattttttattactggtattattttcttacttgttttcaccttaacgttaacgctcgttaaagaggagtttacacctattgaacgcggtgcttcaccatcacgcaaagaagttttcaaactactccccttccctaaactgacagttggtttatttaccacaactttcattatccaaacagttaatctgtcaatcagtccaattgttgccctatttgtacgtgagttgaatcacggggctggtagtacaaccttcctagcaggtgttgtcgcagccatgcctggtatcgcaaccatgattgcggcaccgcgatttggtcgtattggggatcgcatcgggacacaccgtatgattatgattggtttcgtcctagcatttatctttatgctcccaaccggatttgtcacaaccgtctggcaacttgccatcatgcgtttcatgattggaatctctgatgccaccatgttaccagcggttcaaaccatgttgacgaaatcaacgccgcgtgaaattacatcacgtattttcgcttataaccagtcattccagtcattaggggccgttgctggaccaatgcttggtacggtgattgcaagtgtgctggattataacgggatttttattttcagcgccttcttaattgtgctgaacgccatcctattctttatccgtacgcgtttcctacgcgccggtggcagtctagatgactaagttaaccaaaaaagccgctcgagtttttgctcgagcggctttttgcataactcacatttttcgtaagacgtgatacatcagcaaaatagccaactgtaacgcaccaaatgacactacgaagaccagactatgcatggtaaacgcctgggcaacctgcgttaggacaccatgcatatccgtgactaactcccaagaatttaatcgtaggaaacgacccaaataaataccaaaggccgatagcaaggacaaacctgcataaaaagccaacgtctgtaatgatttcttctcaccaaaatacgcaattgccaccgcgtgagctgacgacatgccaaacagcatccccatcaaaacaccactagccaggattgcatagttaaaaaattgggtttccgtcattaaaccagtcccaattgatgacaagtgactaaaatcagtcaccatgtacatcgtattcgggaagaaaaccaaccacgccgccgtcaatccccatttcagccaacgtgttgattttgttgcgcgaatccgtaacgccaaatcaaacggcacaatggccaaaaagacgttccaaattagaaaattaaagtttgtcggaaaataccaaacaaccagcatgaaagccagtaccagcacatggatttccaaaatattccgcttcaacacgttcaccacctcatgaattacctcatgaaaattattatacgtcagctagcttaaatgcgatatagggaattagtcgcttacttcaacgaagacgtttgcgccgtcacccgtttatcgtatggcacttcgaacaaatcaatttcaccaacggttaggtccgcttgtcccgccaacaaatcttgcactgacgtctcaaatgcgtccgtcgcgtcatcagccactggcacagtcactgttaccccggtatcgtactgcgtatccaggattgtaaactcatgctgttcaagccaatacttgagcgactcgtaattcttatagtcgacccgaattgacattttgtggcgttgaatgcgttccacgagtcccaattcggcaatgccgccagccaccgtaccggcatacgcgcggacaagaccaccagcccctaatttgatgccaccgaaatagcgggtcacgaccgccacaatatcatgcacctcgttatttttaaatacttcaagcatcggcaccccagccgtaccagctggctcaccatcatcagagtagcgttgtacttggtcgcgctcccccaacatatacgaccaaacattgtgtgtggccttattatgctctttgttaatgcgatcaataaacgcacgggcatccgcttccgtttcaacacgagccatgttaacaatgaagcgcgactttttaattgtttgttcccacgtatattctgacgcggcaatggtaatgtattgatccgtattcacaatatgttcagtctgatttcctgccataatgattacctcgttattaaacaataaaaagccagatgccggcatctggctttttacttatcttactcttcgaattcgaactggaagtccaagatttgaacagtgtcaccaccacgggcaccagcatcacgcaatgcctcatcaacacccataaagcgcaattgacgagcaaaacgcatcattgattccgtgtagttggtattcgtacgcttgaacaagcgctcgatttcatcaccgtaaagtacccaaacaccatcttcatcacgatcgatttcgaatggtgtccgttcctcagagaactcgtacaaagctgacgccgtatcatcgggctccatgcccttaggaataaaggctggcgtctcgtccaacaagtcggctgttcgttgcatgagtggctccaatccttggcgcgtcaatgatgaaattggcataatttcagcatcgtctggcacgtttggatccgcagctaacttctctttgaatgtcgccaatgtttcttcggcatcaggcatatccatcttcgttgggacgataatctgtggtcgttccaacaaagctggatcatactctgccaattcattgttgatcttcaagaagttctcgtaaggatcctcttctggatcgatacctgacatgtcgatcatatgcaaaataacacgcgtacgctcaacgtgacgtaggaattgaattcccaaaccgacaccttgtgacgcaccctcaatcaacccaggcaagtcagccataacaaagtcacgaccatcttccaaacgaaccatccccaagttagggaccaacgtcgtaaagtggtacgctgcaacctttggcttcgcagccgttacaactgacaacaacgttgactttccaacagatgggaacccaactagaccaacatcagctagcaccttcaattcaagggcgatatccaattcttcaccaggctcaccgttttcggcgatttcaggcgctggatttgttgacgaggcaaaacgcatgttaccacgaccgccacgaccaccttgggcaactaccaaacgttgaccttgctcagtcaagtcgccaatgacacgacctgtttcagcttcagtaatcgtcgttccttggggtaccttaataatcaaatcatcagatgacttacccgtcatccccttagtggcaccgttaccaccaggtgttgccttaaagtggcgcttgtaacggaaatccatcaacgtacgcaacccttcatcaacttccattacaactgatccaccgtgaccaccgtcaccaccaaatggaccacccatattaatatacttttcgtgacggaaagaaacggcaccatcgccacccttaccggctttcacaaaaattttaacttggtcgacaaacgccatggtttatgacctcactttcttttttaagctcttactctataatagaccagctcacccgaccgattcacgcgaacaggacaagctggcacgccaagcacaaattccgttgtaacaggcgtattttgtcgcttatcattttacagtaattgcgcgggtttgaccacctttaatcatcagcatgctgaattgcttgcaacgaaattttgattgcattagccactttttcagagacacccacttctcgcaggtccgctatcgaggcgttcgcaatcttatttaatgagccaaacttagccaataacttctgacgtgtctttggaccaacgccggcaatttcatccaattttgaacccaaagaacttttagaccgtaattgtcggtggaacgtaatcacaaaccggtgcacttcatcctgaatccgttgcaacaagaaaaagccttgtgactttggatccaagttcacgtggggctcaccctcttcacgcaacaagtccgctgttttgtgctgatcgtttttcaccatggctgcaaccggaatatcaagacccaattcgtcctcaatgacttcccgggctgcgttcaactgaatgacaccaccgtccatcaaaatcaaatctggcatctcagcgtgttccttcaacaaacgggtataccgacgccgaatgacttccatcgtttcagcccgttcatccgcatgctcgactgtcttgtttttgtacttacggtacttatttttattagggacaccatcctcaaagacgaccatcgcagataccatttcggccccttgcgtgtgtgagtgatcaaatgcctcaatgcggtgaatttcaggaatccccaatgcatccgcaatttcttgcatagcaccacttgtcttagattcattcatttccatcaaacggaacttttcatccaacacaatctttgcattcttctcagccaaatctagcaaatcacgtttttcgccacgttgcggcgtccgtactggcacgtgcaacacatccgaaatcattgctttatcaaccccggccggcaccaagatttcttttggcaacaccgcatttttccgattatagaactgcaaaataaaactggtcatttcttcttcagctgactccacaattgcaaacgtccgcttctcacgtttcatcagtcgcgcttgacgtacgaagaagacctgaacagacaaccaccccttatccatatagaaattaaacaagtctcgtggtgtaccgtccttggaaataatcttttgtttctcaaccgtcgtttcgataaacttcaactgatcgcgtaaatcagccgcccgttcgaattccaaattctccgaagctgtgttcatcttctcatttaggaccttcgtcacttcttttgtatcgccatccaagaagtgttggatctttttaatttggtccaaatactctgtaaatgggacctgacgatagcaggcacccaagcattgtcccatgttagcgtacaagcaagggcgcccttgataaccattacaacgccggagtgggtacaccttttgcaagaagtgtaacgtttcctgggcagcgtagacgtttggatacggaccaaagtactgcgcaccatcctccttaacatcgtttgccaactccaattttggatcggcctcatgggtaattttaatgtaagggtaccccgtcccacgcttcaaacgaatgttgtaataaggttggtacttttgaatcaaggtgatttcaaggagcaaggactctttttcagagcttgtcacaataaaatcaaaatccgcgatattctcaaccaactgcgccgttttaccagtgtgttcgctcttaaaatacgaccgtacacgattttttagattcttcgccttaccaacgtaaatgattttgccgttgatatctttcatttgatatgaacccggcaaatctggtaacaaggctaacttttgttcaatatgttctgacgccattcgcttttcctttcgacaaatattcctttcttattatacgccgacattcggtttaatttaaccccagacatttggacaaaaaaacgcacatccttggttaggacgtgcgattaagtcattattttgttcggtaaacgtaaacgctgattgcagcaaccgtcagtaaaacaccagccatggcaattaacatatctgtgttgcttggcgtgggcattgcagcagtgcttgcggcaaacccttgttccgtcaatccccacacgccagcaatcgtcgcgaccatcattagtgccatcttttgtacagccttcattatgttgttagtccttttcttatataatcatcacttgcaagaacttatcttacagggcgagtatgattgaattatgaatttgtaaccgttatcatttttgtgaaaagtcgttatttggcatccataaagtcccaattaagttaacgtgttatactagaggtaatattttaaccgggggtgctactatgccattgcaaacaaagcgaactgatgaactaagcaagcaatttgatgatttattcgtcatgcctgatgtcaaagacgacaacaaggatcgttttttgggtaagaaggacgaagaacaactaaagcgttaacaaaaaaggaagtacgtcaatattgacgcacttccttttttgtttaatccttcgttttgacaaacaatcccttcaagctgcttaaagccgccttagtgatattaccatcactgtaagtcagcacgttgcgcttataaacacgcaaaccgaaccggcttaggaaaatcaaaacaattaattctaataccaatgcaatggcagcatcccccatcgttgcatattgcagtcccaaccgagctggcatcaaggtttgagaaataaatggtacgaatgacaagacgttcaagaacgtattgtgcggttgacctgacaacgtaaacgtcaagacgtacccaatcatggcgacgtaagtcattggcgcaacagcttgttgcacctgactctggtcattaaccattgccgccagaatcgccgtcaaaaccatgtacatgaagatggctaccagagcaagcaacaacgacataatggcgaagcccatatcaacaccggccagtaggctcttaaccctctttaaatacttataatgtggcgcaaacacgttcacaactaaccctgctaccacgtacaaggccgcatgagtaatcgctaacaaagcaatgccggttagcttaccgaaaaactgcaccgctggtgacgttgcggatagcaagatttccataatgcgtgatgatttttcattcgctatttcttgtgcaatcatgctgacgtatgacgtcaagaacacgaaaatcaaaatccccaaagctgaggccaaggcataattagctgtatctgctgcggcaccgccacgtgtttcacccttgtcactttgaactttcgtggtcaaagttggtggcgtcatcaatgtctgcagttcagttggtgacaacttcattgccgacgctttcgccagcatcgtgtacgtattcagtgacgccttcatttttgtttcagagacagattgcccatctgcagaattcactaattcatacttttgatcggcagttgctaaataggcatccagctttccttttgtcaattctcgctttgcctgtttctcgtcagtcacatttttaactttgatgtcaaaggcatcatctttttttaagtatgtcgctaaggctggttcattcactacccccacaacaggtgtcttatgactctgagtggcggtaataataaacgaaataccagcaatcactaacaaaattagcattggtgctaagaccaatgaccaaaagccgaccgacttaatccgcgttttatacgtctgacgggcgactaacattaactgcttggctgtcattatgcttgccctccttgtacttcgcgacggaaaatttcgtccaatgtcggtggttgttgcgcaaagactggcacatacccatcttgggcaaccaactgaaagacttcgcggccaaccgctgcgtcagttaattgcagatgacggccaggtccctgtggcgtaatacttttcacgccggcaatctcacgcaactcagcatccgtaaccggcgactccaaataaatctcagttcgcccaaacgattcgcggattgcattggtgtcaccgtgcaacaccgtctcaccatgacggagcatcgtcagttgatcagacaatttttcgacaccgctcatattgtgtgaactaaaaataatcatggccccctcatgcttcaggcgcataatttcttgcatcatcaactccgtattgaccgggtccaaccccgtaaacggttcgtctaaaatcaaaaaatccggttcgaaaatgactgtcgcaatcaattgtactttttgtgcattacccttcgataatttttgcaccttatcacttggcttacccaccacatcaagccgcttcatccaatcgactaaggctgatttggcatcagaccgtttcatcccatgtaactcggcaaaatacataacttgttcttcaatcgtcaatttctgatacaagccacgctcttcaggtaaaaaaccaatgcgctgcttgtctgtcgcggtaatggcatgaccatcccaggtcaccgcacccgacgtcggctcaataaaatccaaaatcatgcgaaaagtcgtcgtcttaccagccccgttttggccaataagccccatgacttcaccaggattcagacgcatattcatatcctgaaccgcaattttatcaccaaactgcttgttcagatgtgttaattcaatcatcactgtccccatcctatattctgttactgacattgtacctaatttttatcgcatatgggccgttcttaatatttagttgagattttccgaatttcgccaacaaaaaaacgtccactgtcatcacacagtagacgtttcaagtttaaccccagttaatttcgtcacgttggacaagttggaaatcaatatccgccatgcgcccgcgaccggttgggttttgaccatgcacttgcaagtagaaacgggcatcatcatcagcgcgcatttccgtagctggcacaaccacatcgtgatcgtagtgcaattggaacccattcaactcaggaataaaagtatataaacgaccgacatcaacgtcgaaatccttgcggtacattgcaacaagctctgtgccctgcaatggcgctgttaaatcatagcgaatcattggattgccccctgattaattttctttagcgctattatcacgcgtttttacggaatcggtcaagcatttcgggtgtaaaacgcaattcacgtggcttagaaccatttgctggtccaaccagcccacgatcttccaacgcatccacgatccgaccagcacgattgtaccccatgccaaagtgacgctgaattgatgaagttgaggcaccgccggcacgaaggataaattcgagtacttcgtcccatttttcatccaaatcgtcggcaccatcgccaccattttcaagtgctttcacttcttcatcggaaaccgtcatgctgtcatcgtactgtgcttcaccttgattcttaataaagtccgtcaacgcttccacgtcttcatccgtcaagaacgcgccttgcacacgttgtggtccgttcgaaccaattggcgcgaacagcatatcaccacgacctaacaacttttcagccccgttactatccaaaatcgtccgtgaatcaaccccggatgacacggcaaacgccatacgtgatggtacgttcgctttgatcaaaccagtaatgatatcaacggatggccgttgcgttgcgacaatcatatggattcccgctgcacgcccaagttgcgcaatacgcacaattgcattttcgacatcgccagacaccgttgatgtcatcatcaaatcagccaattcatcgatgatgacaaccaaataaggcatcttttgtaacactgtacttgggtcgctcgtattttgcttttcaacaaaccgattatacccatcaatattacgaacaccttcttcggctaacagtttgaaacgacggtccatttcagcaaccactttcttcaaaccgagtgacgccttcttcggatccgaaatcactggtgtaatcaagtggggaatatcattatagactgacaactcaaccttcttggggtccaccagcatcaagcgtacctgtgacggctttgcttgtagcaaaattgacgccaagataccgttaatcgccactgacttacctgatccagttgaaccggcgatcagcaagtgtggcatcttcgtcaagtccaacttcacgacaccacttgtgacgccacgaccaattggtacaaccaatggtttctccgtatcgacaccagcttcttcaaccatgtcccggaaaccaaccgttgcctgttggtcattcgccacttcaataccaacgacgtttttacctggaattggtgcctcaatacgcagtgacttggccgctaaggcgagcgccaaatcgtcggctaagttttgaatcttcgacaccttcacaccaactgctggtttaatttcatattgggttaccgttggtcccaacacaaccttttcaactgtggcattgatattaaagctcttcaatgtttcatgtaaaatacgcgccttttcatttagcgcatcacgttcagcagattggtcggttgacccaatgtgttgcaacaattcagtggtcggcaagacgtaatccttatcatcaatcaccgtacccaatcctgacgcatcaacatctgccttgggttctgtgattgttgatggttcaacgtgaccgacaccggcttgatgcgcttgtgtctttggtgatgttgcttgattgctgtgacccaagatatctgcgtgcgtcaatggcgtttcttgtcccggtagtaagtcgtcatccggtaagtccgcaccaaagacaaccggtgcaatttcttcatgttctgactgaatgaccgcattcggatcgaaatcagggtcaaaactcattgacgccgctggtgcatcatcaagcgatggtataggcacttgggtcaaatcaggttcaggcgctggcgcagttgcactaggcgtaactggcgccggtaccgttggtgtcgtttcatgatgtggcataggggccacaatttctggcatcttgaactctgtcgccgtcgcttcagcctcagcagcatccgccaacacatcttgtggtgactttgctttcgtcgttgccaatttaacgggttgactagcatccgcttccggcacaacaccagctaacttggctgctttatcactctccgacgcaaacgggtcatcattgaagaaatcattcatcgccgtacgctgtcgatcgcggaacccttcaattgattccgtaaccttttcatgtgctgtcgtcgcctgcgtttgcacaaagtcacctgtaccttcagctaacttaaagaagttatcaaagacctcgcgcaatggtaagttaaacatcaccactaagccgataattaacaacacaatggcaattaaccatgaaccaaaattagacgatgctatgtaagttgcgctgtacaacaccgccccaattaagccaccaccaacgggtgtcgtgacagcatgattattgagatcttgattaatcaatgtctgaataacctgcgtatagttgttgtggacgttcatcttgttgaacaacaaaattgatccgaccaacatgatacctagataaaataggccaaagccaacatagtgttgccacttaaaacgtcgtggccactggccatatgcaagcaccacgagaaatggcacgagcaagaccagtagcaaaaattggtatgagccaccaacaatcaggcgcaccatattggcaataaacttacccaccaaaccaactttggcaattgcaaggacggccaacagactagcaaacaagcctaagaattggggcccacgatccttcaaccaggtcatggtatcattactagccttttttcgaggggccggctttttgcggggccgtgcttttgccttggaggcgggacgtcttttagtcgtcgctgccatcgcagcctcctttcttaagtaaataattattcatttattactttaacttgtcgtaatcatattcgtgcgtcaaatcaagatttgggaaaccttgttggcgcaacgtttcatagataataatggcagccgtgttcgacaagttcaatgaccgaatatgttcgtcattttgtggaatacgcaaggccttctcaggatgttgcttcatgaatggctctggcaaaccggtcgtttccttaccaaacaagaagtaataatcgtgatcaggatttgtgtaatctgcctcgtgataagcccgtggcgcaaacttagaaatcaagaacaactcatccgtgtccttaagcgttgccataaaggctggcaaattctcgtggactgtaatgtcaactgtatcccagtagtccaacccggcacgcttaacgtgcttatcatccaacttaaatcccaatggttcaatcaggtgtaatttcgtgttcgttcccgttgccgtacgggcgatgtttccagtatttgctggcatcaatggctcaaacaatacaatatgattcgtgctcatgataatctccttttctagggcgggtcctcccctcccccaatgcgttattgcatacaaaaataagtatagcacggacaaaacctcgaccgcgctatacttaaaaaaccttattaatgtctttactggttggtttcatctcgaaacagacctgagttcaattgccaccacttatacaagcggtaaatcagtactttagcaatcgcatagcccggaataccaaaaaccaccccggccagtccaaaaatattacccgccgatagcaagataaccacaaccgttactggatgaactttgagcgagttaccaagcaactttggcgcaatcactttcccttccaatgtttgctcaatcataaagacgatgaacacataaaccaacatcattggcgaaacgaacagtcctacaactaccgccgggaccatcgctagaaacgatcccagaaacggaattaagttcaacaaaccagcactaatggcgattagccagccgtacggcaagccgataatggtatagccaattgcgaacatgaccatcactgcgaacgccactgacaattgcccccgaatgtaattcgaaatttgcttgttaatctcaccaatggtatccaaaaatgagccccgtgcttttggtggtaaaaacttagccatgtagtttggcatctggtggccatcctttagcaaataaaacaaaatcaacgggaacgtcacaattgtgataatggctgaagtcagtgtcccaacaactgagctcacaccatgaatgccttttttcgcatattcagctgagtaattttggacccattttgaaatatcactattcgtctgattaaaccacttattcacatcagcaaagcgcttgtcagccgttaactgatcaatcattttgaccaaagctcgccaatattctggccaatgattgatcaaaccaacgatttggtcgctcagccacggaataaagacagctaagccccatacaatcaagaccaacaataccaaaaactgcaccgtaatggtcgcaacacgcgacattttataccggcgttccgcccaatccacaatcggattcaggagataataaaacacgcctgcaatgatgatcggcgccccgaccgcactgaacagtgccacaatcggttcaaatataaaattaactttatcaaacatgtaaataatcgctaacaacagcaatataattagcatacttgagatgattttattatttaataaccatcgttgaaagacagattgtttcgtctcgcgatttgtcatcttttatcccccatatataaaaaaccagtaccccgactggtactggttttattgtatcaagcttagatgaacaatacacgcactgattcaggaatttcgaagtccttttgtgacaacgttagctcgcctgttacagcatcccgacggtataccgtaacattatccgtgttttggttagccgcaaccaaaaaggcgtcatctgggctcaaggcgaaatcacgtgggaaatctccttcagttgaaatccattggatatgtgcaacagaggcgccattatccttcactgcaaagaccgcgattgaattgtgaccacggtttgatgtgtagacaaacttaccgtcgtttgacaagtaaatcgccgcaccaccattgtgctccgtccaatcggccggaatcgttgccacagtttgcaaatgcgtgaatgagccatccgcattgtacttcaaaactgaaagttgtgatgacagttcacctaacaagtaggcatattgaccatcaggactgaaacgcaagtgacgtgggccaaaaccagcctccgtctcatacgtcgcaactaacgtcaacttaccggcatcagagacgtcaaacgtcaacaccttgtcagcacccaaatcaacgacagcgacacgattgtccggcgttagattattccagtgcacgtgtgatgagccttgttctgggcgaggacctgacccttcagattgaaaactatccgtcaacgtcaatgagccatcagcggcaatcgcaaagacttctaacgttcccttgtggtagttacctgagtacaacaattgacgtgcctcatcaaccgccacataagcaggtgacgcaccttctgccaaaacttcctgggtcaacgttgccgtatcatccgcgaagttaaggaccgccaacccaccttgatcaccgtttttatcaaccgcatacaatgtgttagccttactcaaagccaagtaagttggtgatccaacttcagcaaccaacttggcatcttgcaactcaccagtctccgtgttcaatgcagcttcgtaaattccttttgaaacacgtcgcgtataagtaccaaataaaatcttttccaatgccatggttgatctcgctttcattcattaataatcttttagtaaacgctttcattgtaacacaaaagcgaccacaccaacagatgcagtcgcttaattctcttacttatttattggcaatgacttcaatttcaatacgtgccgctttgggtaacgttgccaccgcaactgctgaacgcgctggtaacacgtcaacgtcctgaaagaaacgcgcataaatatcattcaccatcgcaaagtctgccatgtcgactaggtaaacgttcaccttaacaatatcatcccgtgtcaacgcagctgcctctaataacccatcaatattagcaaaaacctggttagcttggtcaatcgttgacgcacccgcaaattcaccagtacttggtaccaaaccgatttgacccgatgcatacagcgtaccgttgcttaaaacagcttgtgagtatggtccaattgcagccggtgcctgcgttgtcgtaatgattcgttttgtcatcttcatttccccaatcttgttaatagcgtcagtatacgcgctgtcgaccatcagccaataaaaaaaggacctgtctttaacacagatcctttatcagggttatgctttgaactttcgacgttcttggacacgtgagacaattactgaggcaacaattgataacgttaacaaaccaataatcaccgataatgacaccacgtttgaaatgtggaaatgccagtccaacgccttggcagtctcgttcaagaccatcttgaccccaataaaggccaaaataacagccagcgcatacttaatgtatcggaacattggcagaattcctgacaaagcaaagtacaatgaacgcaatcccatgatagcaaagatgtttgacgtgaccacgatgaacgtgtcttgtgtcaccgcaaggacagccggaattgagtcaaccgcaaacaataagtcggaagcttcaataaacaacaacgctaacaagaattgggtagcataacgtttaccattttcttttaccaagaaatgtggttccgcaacatcttccttcaaaggtagaattttacgcaatcccttaataataaaactatcattcaagtcttgcgcttcttccttttcgaacagcatcttcaccccggtgacaatcaagaaggctccaaagatgtacatcaaccacgcgaagtgatgtagcaaggcagccccaccgaagataaaaatcacacgcatcactaaggcaccgaaaacaccccagaatagcaaacggtgttgatacttcaattcaatcccaaagaaaccaaagaccaagatgaagataaacaagttatcaatactcaacgacttttccagcaagtatgccgtcacaaagtctagggcatgatcaccacccgtaaagaaccagagaccaccggcaaaaataaaggccaaaccgatccaaaaggcgctccaaagcagtgactccttcatggttggtgccgcgttcgttttgtggaagactcccaaatcaagggctaacatgaccaaaacaaaggcgaagaaaccaatccaataacctatactaacttccatttatttctcaactttctgatatctagcgacgtcacgggtcaacaatttgacccgcaatgactataagtttattttagctgaattctcatcgaattactattaccaacattttgggaaaatattgcaaataagactgacagctatcagtttattaaggtatgatgagccctagttaaccaaaaggagtttgttcatgaagtcaagcaaaatcacaaagcgcctactcatgctcttaggtgctgtcctcatcctattagccggttctgtcgcttacatgcaagtatttggcctttaccgcgctaccccaaccgcgcaacgcgcagcccattcagccaccgaaacggcggactattgggccttcaaacctaaagctaatactggacaaaaagatacggccattattttttatcccggggcgtttgtccaaagtgacgcctatgccatctgggccaaggacgttgcacaagccggctaccccgtttacgtgttgaaaacaccgttatctttttcattaatcgcccaaaacaaagcagacattgctattaaaaatagtcatgcccaccactttgtaattggtggccattccttgggtggcgtggttgccaacggttacgtagccaagcatccgaaggctcacatcactggtctattattacttgccagttatccacaagaaaaaaaccatttggccaatcgaaccaatcttgctgttttgtcactgactgctagtcaagatcaggtattgaagcaagcaaattatcgcgcagctaaagcctggttgccaaaagacactcagtatcaaacaattcgtggtggcaatcacggtggattcggcagctatgggccccaaaaacatgatggtcaggcgacaatttcaaacgcccaacaacagacagctattgctgatcgcattgttaattggctaaatagaccctaaattaaaaacgccctggattgtattaatccagggcgttttgagattagtcattagttagacttaacatccaattcaaggaagttagccacctttgttgcttcatcagcaaccgcgtgtagtgtcgccaaacgattgttcttaaccgcttcgtcttcgaccataaccatcgtctcttcgaagtaagcagccacggcaggttgtaagttcaacaatgccgcaagcttcgcatccgtgtcatcaacagttgcaactggggcaactgcttcaaacaacgccttttcagctgcattctcgaacagagcagcgtcaacagtcgcatccgttgcattcttcgttgtcaaacgcatcacacgagtcaacgcttcaacaccctcacggaagttggcatcgttaacgtgggcagccaagacttgcgctgattcaaacatttgcgtcgtatcagcaaagttgttcttcgtcacagcgttgataatgtcacgacgaacaccatcatcttgcaatgccttcacaacacggtccgtcaagaagttaacgaccgcagccacattattttgcaactcagccatcacttcttctggcaaaccaaacttaactgcatcggcgttaatgtcagcaatcaagtctgacaaaataccatcaatatccaaatcccacttgttgtcagccaagatgttcacaacacctgaagcggcacgacgcaaagcatatgggtcatttgaacctgatggcaccataccacccgcaaagaatgacaacaagctatccaacttatcagccaaggccaataccttacccaaatctgacgcaggcaattcaccatcagcagagattggcatgtagtgctcacggattgcttgggccacggcagcgtcttcaccaaacaagttagcgtacttctcacccatgataccttgcaattcatcaaactcaccgaccataccagtcatcaagtcaaacttgtagatttcaccggcacgcgccaacttggcttgttgatcatcagtaaaggccaaacgaccagcaatgatggcagccaaagccttggcgcgacgtgtgtgggcggcaactgaacccaacttagcgtggaatgataccacttccaacttgttgttgtagaagtcgatatcgtgcttttgatcttcgtggtagaagaacttagcgtcttccaaacgcgcaaccagcaccttttcgttaccggcaatcacattatcgatgtgttcagcgtttccgttacgaacagagataaagtgtggcaacaaagcgccgtttgcatcaacaacgtggaagaaacgttggtgttccttcattgacgtaatcaatacttcatcaggcacttccaagtaaccttcatcgaagccaccagcaaaggctgtcggatattcaacaatgttgttaacttcttcaagcaaatcttcgtcaacgacaacggtccagttgttatcactagcaatcgtttcgacttgtgtgcggatgttttgcttacgtgcttcggcatctgcttgtacaaagactgacgtcaaggcctcttcgtactggtcagctgatgcaatttcaacatcatgacccaagaaacggtgtccacgtgatgaacgacccgttgcaactcccaagatatcaaatgggacaacttcatcatccaacaatgcgaccatccaacgaattggacggacgtattcaaacgtgtgacgaccccacttcatcgttgttgagaacgtcatcgcctcaataacttgcttgaagcccgtcaaaacttcagccgctggctttccagcctcaaactttgtaacgtagatgtactcgttaccgttaaattccttaaacgtaatgtcatcagtcgtcaacccttgaccgcggacaaatccttgggctgcctttgaatagttaccctcagcatcaagtgcgaccttcttagcaggccccttaacttcttcttggaagtcttcagccttttcagcaacatcagaaatcaacactgctaaacgacgtggcgtagagaaaggcttaattgccccgtatgccaaacgctcgtcggccataaagttttcggcacgctcaaccaattggttaattgcgggcgtcaccaagtgggccggaacttcttccaaaccaatttctagcaaaaagttagccatcttagttttcctcctcatctgcaggcaagtacttcgcacgcaaagcttcgtccttcaacaatgggaaaccaagcttcttacgctcatcaatgaaggcacgcgcaactgaacgggccatgttacggatacgtgatagatattttgcacgttctgtaactgacactgtgccacgggcatccaataagttaaacgtgtgtgatgacttcaaaatgtagtcgtaagctgggtgaaccaagcccttttccaaagccttcttagcttcagcttcgtactcgttaaagtgacgcaacaacatttcttggtctgattcttcaaatgagtaaactgagtgttcgtactctggctccttaaagatgtcaccgtacaaaacgccgttaccccattccaaatcgtacaccgttgggacgtcttggatgtatgaagccaaacgctccaaaccatacgtgatttccgatgttacggcatcaacttggataccaccaacttgttggaagtacgtaaattgcgtgacttccataccgtccaaccagatttcccaaccgataccagcggcacccattgatgggttttcccagttatcttcaacgaaacgaatatcgtgttccaatggatcaatgcccaaggccttcaaagaatccaagtacaattcttgaatgttgtcgggtgatggcttcataaccacttggaattggtggtgttggtacaaacggtttgggttatcaccgtaacggccatcggcaggacgacgtgatggctccacgtaagccgcgttccatggctcaggaccattggcacgtaggaacgtgtaagggctcatcgtacccgcacccttttctgtatcgtaagcttccatcagcattgcgccttggtcagcccagaacttttgcaacgtcaaaataatgtcttgcacactcatttttgcgctcatattgacaaattcctttctcgtggttggcttcgagcaaataaaaagccctacaccaatcaccataaaaaatgattgatgtagggacgataattcgcggttccaccctacttctaggaaaactcctagcagcttcattggattaaattgtgctccagcagtgccccttacgctaatcagatcaccctcacatcaccggtgacttgctggactgatttcacggaattcttctgctttcatcgcttattacaactaataagtttatcactcagccgttgaatgtcaacgaaattaatctcaatattcagttgtctttgaccacaagtacatgccataaaatgcattgaacgttttcacaatcatcaaaacaaacatccctaatgcgcctgacccaccggcctggatttgattccaccataataacaggccaaccgcatcaactaacaaccagacaacccactgcgagaggtagccatacgttgccaaaatttgtgccaacatccccagcggtaattgtgaggagtcgaggtagacttgattaccatgtgccgttttggcaacggctagaacgacaccataaaccacaactgcccctgcgacaaggcatcccatcattttagggccgatacgcttcgcttgcatctgactactgtcttgttgttgggctagctgcttgtaccaggcaaccatccccacaaactgcatcacaaaaaagaagccttgattgagaatgtcaccgaccaaatggttgtgaatggacattaataaccagatgccattggtcaggagcccccagaaaaagttcgttaaccggccactcgctaacatgattaagtaaaaagccaataccaacccggtaattaaactcgtccatcctgatgatgaataatcacctgtatagacgaaggcccaaatcgtaacagccataataatgaccatatacacccgttgaaaccgattcatcaaggctaaatcacgcttaatattggttggtgacgtcgcttcacgcaaagcttgtttaagatactgcatttctctactccctcgttaaacactaacgaatagattaacacattaacattcgcttgtgcgctatgtcacgtacttgtaaatatcgggcataataaaaagcgatatcccccaaaagggacatcgctttctaactgattcataccgtacttacttgccaaggaatcctgacaacttatccttaacgtcatccatatcaacgttatctaagatgtccgccttgtcgcctagcaagtcaccggccttttccttcaattcgttcaagtcagcgccttccaaaagatcaccagcttggtccttcaacttatccaaatcaaaatccatgtcaattctccgttcgcttctttactatacacttattataagtgatattagcgctacctgtcatctattttgactcgtcaattggcttttgttggccgcgttgggcgagacgttgtgaccagccgtctagttgttgaataaaacttttggcacgtaaatgcacgccgacttggtcatcataaatcttatccatcacgcgtgccatatcatgcttagtctcttcttttagcgacaacgaacctaactgttttaggtcaattttgttaagttgtgatagcacacgcacagaacgtggattagcattcatacgttgttcatcttgatcccagtgcaactggcacagtgtcccgtttagcttctcggagaaatcaagtggtaaatcacgtcgaccacaaacaacacattcaccccaagtcggttcaagaccgaatgccggcaacaatttgatttcaaaaaaattggcaatgccttgtggatccagaccactctcaattttttcaatcgccaagcgggcccattcataccacttaccaatcggctgattatcgacaaatgccgcgtcaatcaaccctaagatgtaagtcatgtaggcattctttgtgacgtccatcatcaattcacgtgattggtggctctctttaacagcgttaataaaactcaaaccggttggatttaaagttccttcaaacgtggcgaccgttaacggttggacatccgctgcgaattggtaccgctttgacttgccatttttaatgtaaaacatccgcttgccaccctgcttggtcagcatcttaaccatcagatccttttccttgcggtcttgctggtacatcacaattgcatcaaatacttctgccatacccatcccctagtaaaaaagagactaggtagtctctttctcgccaaattaaatatctgaatcttccttgtaaccgtaagtttgaagtgcttgtggcttatcacgccaacgttcttcaaccttaacccatgtctccaagaaaatcttatcaccaagcaaacgttcgatatccttacgtgcccgcacaccgatttccttgatcattgccccttgcttaccaatgacaatgttcttttgcgttggtcgttcaacaacaatcgtcgcttgcacatgcaagtgattttcatcttgacgctcaattttatcaatcaccaccgcaactgagtgtggcacttcttgacgcgtcaattgtaagaccttttcacgaatcaactcactcatgataaatcgttctgggtgatccgtgatttgatcagctgggtaatattgtggaccttctgccatcttatccatcgcaaaatccaacaattcaggcacgccatcccccttcaaagctgaaattgggaagatttcggcaaactccatttgttggcggtaatcatcaataatcgtcaacaaatctgctgggttcaccaagtcaatcttattaatgatcaaataaactggcgtctttgtgtcctttaagcgattaataatgaaatcatccccggccccacgtggttcgtcggcattcaccaagaaccaaaccatgtctgcttcacgtaaagctgacatggctgtcttcaccataaaatcacctagtgagttatgaggcttatggatacctggtgtatccataaagacgatttgaccctcatcggtggtgtaaattccttggatcttgttacgggttgtttgtgccttaggtgacatgatggcaatcttttcaccaatcatcttgttcaaaagcgttgacttaccaacgtttggacgaccaaccaaggccacgaaacctgacttaaatccttgttcactcatgtataaaatctctgttctttctgtataatccacgtgttaccacgcacaactttatcccagcaacatctgcaaattcggcaagatgtaaggctggaaaatcaacacacccacgacaattgcgaaggcaacggctgccaaaacagccccggaagccacatcttttgcgactttcgccaatgggtggtaactttcaccgacaatcaaatcaacgattgcttccaccattgtattaacgaactcggccataatcacagtaaaaacagccaccgtaatccacagccagtccgaccgtcctagcttaacatatatcccgacaagtaagacgacaattgccgcaaaaatatgaaagcgcatatttcgttcgcgaacaagtaactggccaattccttcgagggcatggcctagcgcttgtagaaagtgcgtattcttttcaatttgtggcgccggttcggtcgcctttttcttatcgtgtaagtccatagctatccaaaatctcgcgttgtaaatcaaacataatcttttcgtcttcatcactacgcatgtgatcataaccgtttaagtgcaagaaaccatgaacgaccaaaaagccaagctcacgttcgtatgagtgctccaagtattcggcttgttcaccaatcttatccacagatacgataatatcaccgatatttttggccaaatcttcagccatatcctcatccatcatcagtggcatatcctcaccgtcttcttcaattgcaaaagaaatgacgtctgttggcttatcaagcccgcgatactcacggttataacgttgaatctcatcattgttaacaaaagtgactgacatctctgtatcatctggcaacttcatatacttaccagcgtaatctagcaccttttcaacaagttcaatttgctctgccggtactccgggctttgattggtcaataatcgccaaatccataatctttaatccttcttctctgtttgcttattttttgcggcatcaaatgcgtcataggcgttaatgatcgccccaacgactgggtgacgtacaacgtcatccgcggcaaattcaataaatgtaatatgtgagacatttgccaacacttgcttggcttgaatcaggcctgaccgtacctttgttggcaagtcaatctgtgacacgtcaccattcacaatcatatgcgagccaaaaccaagtcgggtcaaaaacatcttcatttgctgtggtgttgtgttctgtgcctcatctaaaataataaaggcgttgtccaaggtacgaccacgcatgtaggcaagtggtgcaatttcaatcgtcccacgatccatcagacgttctgtatgttccgcgccaataatggcatgcagcgcatcataaattggtcgcaagtaaggatcgaccttttctttcaaatcaccgggcaagaaccctaagttttcaccagcttcaacggcaggacgtgtgataatgattttctcaacatccccacgcttcagtgctgccactgccatgacgacggccaaatacgtcttgccagttccggcaggtccgataccaaacgtaatgtcgttattacgaatcgcttgaatgtaacggcgctgaccgtaattcttcacacgaaccgggtgccccttcgcatctcggatcaaagtctcagtgtacatatcgccaaagtgttctagcgtaccacgttcagacatcttcatcgctgaaacgatgtcagttgcgtttagcttaacaccttttttgattaaattcgtcaattcaacaacgattgcctcagctgcatcaacggactctgcttcacctttgatggtcaactgatcaccaaagactgacaaagacaccccaacgccctcttcaatcaacttcaaattgctgtcttgtggtccaaccaagccaatttcttgctcggcattttcaaaacgataaattttttcaacttgtgctgccaaaaatggattccctctaattcgcaatattttttattacagtactattataccgcaaacatatatgtatcggggcatcaccccgcattgtgacataattagcccaacaatgattgcaccgttgtgttaaccaacttaccgtcagccttacccttaaccttaggcatcaaggcacccatcaccttacccaagtccgcctttgatgacgcaccaacttcagcaatcgtttccttaacaatggcaacgacttcttcctcagacatttgtgcaggcatgtagcgcttcaacacatcgatttgaccttggatttcttcagccaagtctgcccgatcagcatccttgtatgattccatctcttcgacacgttgcttcatttcgcgtgacaaaactgccaattcttcatcagccgtcaaatcgtgacccaacttgatttgttcatttgatacagacgccttaaccatacggacaacaccaagcgttaccttatccttggccttcatcgcttccttcatatctgacgtcaattgttctagcaaactcatgattattttcctccaaataatgttgtttgacttattttatgattataaaacaaaaccggaccaccaataaggtagcccggcaagagtcgaattaacggctcttcttgttcttgcgcttacgagcggcctcagccttcaacttacgttgtactgatggcttgatgtagaactcacgcttacggtactcttgcaaggtaccatcctttgatacaccacgcttgaagcgacggagagcatcatcaagagactcattcttacgaacaacagtctttgccataatgtttaccctcccttcccgtgtgaagtttccaacttttatatatgtcgcacacttttgttctttaatagtttaccagaataggcgctgttgtcaacgctttgtcgataattagattttttaaccaattgtttacaattttggctcgtaaaaacggccaaacgtgcggtcgatacgccacaatgatgcccaagcttgtgggtcgacatcataaattgcatcgcgtaggtcatactgttcatacattgaaatgactgtaaacaaaacttccttatggtggtgattatagccaccttcggcatggtggacaatggtgatgccgcgacgaatatctcgctgaatcgcttcaatcaccaaatcaggcttttccgttacaatcataacctgcattttttgttgacgtgtgtagaccaaatcgataacgcgcgcgttaaccactaggccgatcccggtatacaatgcatattgtggaccaaataagaaacctgacgccaacagaataaagaagttaaaggtcaaattgaccgcgcccatcttcatgccagttttgcgacgaaccaaaatcccgatgatatccagaccacccgttgataagccattacgcaaagctaagccagttccaaacccattaacggccccaccaaagattgccattacaagtgggtcatgcgtccacaattgttctggctgactcaccaagcgcatcgcgacggccgccaaaaccagtgcaacggccgtaaacatcgcaaaacgcttaccaattttacgataagccgtaatcatcagtggcacattaatcagcaacaacaacacaccgacaggcaccttccagccgacgaatcgttctaagagggtatttaataactgggctaaaccagtaaatccggatgaataaatatgacccggcgtccagaaaaaattaagggctacggctgacgcaacggcatataccattgcgctaccaatccgacttgaatactgatgacgattaaaatactgttctatctggtccattttctcgcttctttcgatttgtactttatgattttatcacttaattgcaaatctgcgccggataaacaaaaaaacttatgaaccaattggtccataagttccgtctgctttaccgtattttcttaaacaaaatcatgcctgctagcgaaatcagcatgcctaacccaacgactgtcaagattgcctgacgcttcatcccagtctcaggcaaggttgctgcttgattcgacagcgcatcagtcacagttgttgctggggtgtcagtccccaaattttgagtcgtttcatcagcaacgggaatactgtcaccagactgagccgtttctgacttgtcatcagtttgtgctaccggttgttccggcccaacagtcgtctcattgtccgtagttggtccaaccttagcatcgtccccatctgaatcggttactggtggctgttgcgttgcatcagtctcttcatcatcagcttgtttaggcaatgatgtagccggctgtgtatcaggttggctgccatccgtctgaccattaactgtgatgtccccctgtatctggtgttgacggtgcgctaatgtcgcccgtatctgtgccggatggtgcactaatatcacccgtatctgtgcctgacggcgcactgatgtctcccgtgtctacgccagatggcgcgctaatgtcacccgtatctgtgccagatggtgcactaatgtcgcctgtgtctgtgccagatggcgcgctgatcgcacctgtatctgtgcctgtcggtgcactaatatcacctgtgtccgtgtctgacggtggcgcaattaggcccacatcaggaatttgaatagcatccgccggcaaaacttccggcgttgcgattggatcagccggcaagacatgcggtggttctggctgactcggcgccggcgtatcagtgtgctggatgccaacccacaaactcgagttagaataccaagattccgtttgattcgcattcgtaccgttgacaaataacaccgcaaattgcatgttatacgcggaattcgcgccctgaccaaaacgcacatacagcattgtggttgccaccgtcgttaaatcacgtgatgacttaaataacacatacccatcatactgttcatgatttggcccagtaattgtaccgggatgccaatcggcctcgcccgccacacgaccattaagcgcaaagttagcttttgaaacgacctctgctcgcaacgtggcgtctcccatatccaacttaccgacgtcttcattggtaaacaaaggcgtattccagcttacgtcaacctcttgtttaccattcacccacagtggttgtgtatgcgtctctgtctgacttgttgtaaataattgatcagcggatgcggttatgctgcctgccagtagcaaacctagcgtaacccccgctaaagcgattaaatgtcgccatttaaacataataaacaccccaaatttttctctgtttcgtgaggctaacctcctcaccacttattaaagtatagtttcattttgtgaataaaatatgaaagtctgatttttttgtatcccatttttgaaacaaaaaaacgcccagaacgaaaagtcccgagcgttttgtgtcgtcattattcttcagacatgttaggtgcttcaatgtctgcgtaaacaggtgccgtcaagccaagatcatcaacgatttgggcttgtgcaaccggtgttggcgcctcagtcattggttcagtggcctttgagttcttagggaacgcaatgacttcacgaatattgtcacgaccagccaatagcatggcgagacggtcaagccccaaggcgataccacccattggtgggaagccatattccattccttcaagcaagaagccaaaggcatcgtgggccgcttccttggtgaagccaagggctgacaacatcttctcctgaatgtccatacggtgaatacgaattgaacctgaacccaattcataaccattcaacacaagatcgtatgattgcgcgtgtgcttggtgcgcaccatctgtcgtctccaacaatggcaaatcttcttcatttggcattgtgaatgggtggtgagctgcaatccagcgatcttcttcggcttggtgctcgaacaacggccagttaacaacccacgcaaaggcccacttggtgtcatcaatcaagcccatttccttagcagtcatgcgacgcaaagcatccaatgttgctgaaacaacatttgctgaatctgcagcgaacaaaatcaaatcacccgcctgcgcctcagtttgtgctaacaacgcatcgcccttggccgtcaagaacttggcgattgggcccgtaatgccttcatcagtaatcttcaaccaagccaatcccttcgcaccgaaacgttcgatgtattgggccatcttgtcgatatccttacgtgagtagttgtcggccccgccaggcacaacaattgccttaacttgaccaccattcttgaccgcgtttgcaaagacgccaaattctgagtcagccatcaggtctgacaaatcttgcaattccatgccaaaacgcatgtcaggcttgtcagttccgaaacgggccatggcatgagcatagtccaatactggaatttcagttgtgttcaactcgacatcaaccgtcttcttcatgattgcggcaacccattcgttaaccaaagccatgatttcgtcttgcgtcataaatgacgtttcaacgtcaagttgggtaaattctggttgacggtcaccacgcaagtcctcatcacggaaggcacgcgcaacttgatagtaacggtcgaaacctgcgcccatcaacaattgcttaaacaattgtggtgattgtggcaaagcatagaatgaaccaggatacacacgtgaaggtaccaggtaatcacgcgcaccttctggcgttgacttggccaaatatggcgtttcaatatcgatgaacccattggcatccaagaattcgtgcgtggccgccgtaatctttgagcggatacgcaagttcttttgcatctcaggacgacgcaaatccaagtaacgatacttcaaacgcaattcgtcggaaacgttgatgtcatcttcaatatagaatggtgttgtcttcgcttcagacaaaatggttgccttggccacttgaacttcaatcttacctgacttcaagtggtcgttaacagcgccttctgcacgtgaacgaaccaccccttcaatttcaatcacaaactctgaacgcatcttttcggcaaccgccaatgcatcagcgttaatctcttctgaaaaggccaattgtacgattccttcgcggtcacgtaaatcaacgaaaatcaagccacccaaatcacggcgcttctgcacccatccttgcaacgtgacggtttgatcaaggtaagcttcatcaatcaagcctgcatagtttgtacgcttcatatctcttaatcctcttctgtaacttcttcgtcttcaataaattctggcaaaccagtgtataattcggccaatttcaccgtaatttccttaccagtcgtcatgttcttcaaattagctgattgttcagccaactcacgctcaccaatcgtaatcataaagcgggcaccaagtcgatcagccgacttgaattggccctttaacttacgatcttggtagtcacgctcagcactgtagccaaatgaccgaaccgcttggaccatttgcatggcaaccacatcagtcccgtcacccgtgttggcaacgtacacatcaagcggtgcttgttcaggcaacgttgccccttctgattcaagcagcaacatcaaacgttccaaaccgattccgaagccgacccctggcatctctggtccgccgaactcttcgaccaatccgttgtaacgaccaccaccggtaatcgttgtccaaccatgacccaatgcttcagattgtgtcatcacttcgaaaatcgtgtggttgtaataatccaagccacggaccacgttggcatccacttcataatcaattcccattgcctcaaggtatgtttgcaccttatcccagtgggcttgggctgattctgtcaaataatccaaaatcgatggggcgtccgcaacaattgcttgatccttggcatccttagaatccaatacacgcaaagggttcttctccaaacgcgtttgtgaatcagcagaaagctcatcaaaatgaggcgtcaagaaattgatcaacgcttggcgatagttctcacgagacgctttatcacccaatgagttaatcttaaccttcaagttcgtcacacccaacgtttggaagaaatcaacggccattgcaatcacttcagcatctagtgctggtgagtctgaccccaatgcttccactccaatctggtggaattgacgcatgcgacctgcctgtggacgttcataacggaacattggtccgatataaaacatcttgtatggcttttgatgttcaggtccaaataacttattttcaacaaacgcccgcacaacacccgcggttccttccggacgcaaggcaacgtgacgatcacccttgtcgtggaaatcatacatttccttcgtcaccacgtcagatgtatcgccagctgaacgtgcaaagacatcaaaactttcaaaaattggtgttcgtacttctgaatattggtagtcaccaaacaacacacgcgctgtttcttcaacgtagtgccacttaagtgattcaccgggcaacaaatctgctgttccctttggcttttggaatgattgcttagccatatcgtaattcctctcaattaatccgatggtgcaaaaacggaaaaggcgccctcgacgacacactagtatcgtcaagggcgccttttaagcgcggtaccaccttgaatttggtctcatgccgtaacgtggcaacacgcgcattgctgcgacctaaaaagtgtccccttatcctaacaatgacaggctctcaccacaccctgctcgctaaacatgtccaaaataagtttgctttctcatcggttctatctatgaaaaacattatcttatagaaagtagtcaacgtcaagttactgggcatttttcgcccgttgatcaagataattttccaacccgattggaattgccttggcaattttttcctgcgtttttaccgacttaatctgtttgaagtccgtgtctgagttaatgtacccattttcaagcaataccgcgggtactgtattatctcgaataaccaagaaatcaccaaagtcaacacccttattagtgagcggcatagtcggcgccatagctttattcaaggctgtcgcaagttgcttagagccatttgttttatggtaataataagctgtgtacccgctcgcttcgttcgcttctggggatgaatcaaagtggaatgaaataaataaatcagcatgattcttttcagccacttgcggaatttttgacagatacacaattttatccgaatcacgcgtcataatcacccgtgcccccgattggcgcaatgtcttagctacccgccgtgccaattggagcgtataggtcttctcaaatttgccagtatttgatatcgcaccagaatccgatccaccgtgaccagggtccaaaacaattgttgattctgataacggcgtaatcttatccaagggctcattccgttctaacagccagccagctacccaaccggtcgactcatcttcacgacgcacctcgtaccaaccatcatccttagccaaaatttgtaaatgttcaccttgcttcaacactgatatcggcgtaccggcaacccctttcttttctcgaatcgtaatgttcggaatttgtactgtaatttgctgtttgtagagcatcactgtggtaactgcgactgcgacaccaagcatccccacagtaatggctagtggaatccaaaatttcacgagccacgccaacaacaaccggccaatttttcgcatgcgacaacaccctttcaagttctgtttcgtatctgtttagtttagcacagcggtaataagttcaatggctactgcaagaaaaaaacggcccccactttgcggtgagtgccgttaatcactggtaagcttaaccaaattagaaagtcttaccttcccattcgttcgctggcaaggcatcgaagtcgtatgttgcaacatctgcaacgtctgtaataacagcgtgagcaggaactgacatcatcaagttgatgcccccatccttctctttcactaaaattacgggcttctttgccgcttctgagtaaccaatctcccaggcagtacctggatcaacgtgttcaccctcgtagtcgattaccgcaatgacaacttcggctggatcaagatgatccttgtcgcccttgtaaattgcttttgcccattcctttgaaccaaattcaaattcatcgtgttgttcagttcgtggactgaagaattcagaaaccgttggatttgctgcaagtgctttttccatccgttcaatacgatcaatttggtcatcgtcaaaaaatggaccggctaagtaaacgcgcttcataattttccctcttaactaattacagatttttttgtgttacccaattagtttaaccgacaaatgccgaacaatcaacctttcatcgacggtaaatcctgcttattcatgaacggttgcaaagctgtcttggcaactcgttgttgcgtatgaagcaatgcggcattttcacgagtcaattccggaataaacaaaacttccatttcataatcggttgcgtcacagcgaatcactttaccaataaacggacagttaatcgctgctgaagcatcacaatgggctatatcaccaatctgtagttcatgtcgctgcataggcactccccctgactagtcgtttgcgattagtgtacccagtgcgtttgatgaaccctcgcacaattattgattttttcgcgttattagtgtgctaaatacacgcgttgttgatctttcaagccagccaatacaaacttggccggatccttggtgatatcaaattcacgatcagttgcgccgtgcaaaccggccatgaagttttcctcatagtctggaatcgtcatgtattcacgtgaatcaaacaattgatccatttggccggtcactaacccatcacggaagttaggttgcaattcaactgaataaaactcaccttctgcaccagaaccgtaagagaagatgcccaaacgatcacccgccgttaaagtcgttgaattttctaacagtgaatacaaactcaagtaaactgaacccgtatataagttaccaatgcgcttattgtaaacacgactggcttcaaactccgtcaacaataatgcttgttttgcttcatctgcttcaggtaagatatcgcgcaaggcctttaaccccatcttagtgaatggcaagtggaatgcaaatgccttgaagtcatcgatagctaaacctgtcttttccttataacgagcccataaatcacggaagaattcacggtaaacttcagctgaatatttaccatcaaccaatgcttcttcggcgtaaactgggcgccagaagtccatcacatcacgcgacatgaattggttgtctcgattaatcgttaaaatacgtggattctcagtcaccaacatggcaactgcgccagccccttgggtgacttcacctggggtgtggaggccgtaacgggcaatatctgatgccatgaccagcaccttagcacctgggtgcaaggcaacataatcccgtgcttgcatcaaaccgtaagtaccggcatagcacgcttgcttcatttcaatcgtgcgggcgtatggactcaatcctaacaatcgttgtgcataaaccgctgccgactttgagttgtcaatgcctgattcagtcgcaaaaataatggtgtcaatttcttcacgttcagcaggtgtcaagatttggtctgctgcattgactgccatcgtcacgacgtcttgcgttggtggcacaaccgcttgttgcgtctgaccaattccaatcaagtacttaccaggttcttcattacgagcgtttgccaactcagtcatatcaatatattgatgtggtgagaagaagctcatcttatcaattccaatttgtgccattttttaatcctttactgattctgtcacacgtcgcataatttcacgagccactgcaattttcgtttgcaaaggcaaggtctctggttgtgcatctcgtgtcaaaatcgtcacttgattcgtatcataaccaaaaccaacttcggcctttgagacatcatttgcaatcagcatatccgcgttcttttttgttagcttttgttgcgcataattaattaaatcctgtgtctcagcggcaaacccaaccaagtactgatgggttttattcgcaccaagcgtcgctagaatgtccgggttttcaaccaactccaaggtcaaccccggattggccgcatcttttttcatcttctgatcagccggcgttgccacgcgataatccgagaccgctgccgccataatgacagcatccgctgcctcaaatcgttcagtcatcgccgctaataattcacgggcagactgaatgtgtaccgtttgcacgcctgctggagccggcaaatcggatgacgtcaccagcgtcacgttagccccttgctcggctgcggcttgtgcaatcgcataccccatcttccctgacgaccgattcgtaataaagcgaaccggatcaattggttcaacggtcccacctgctgagacaatgatttgcttgcccgttagttgacctgttcgttggtacagcgccaattctgctaaggctaatatctcatccggttctggcaaacgccccttaccggcataaccttctgctagaagtccttcagctggttccagtacaatcaccccatcgtcacgcaacgttgctaaattacgttgggttgccggattttcatacatgttgacattcatcgccggcgccacaataactggggtatgccgagctaacagaactgacgttgcggcatcgtcaccaatgccagccgccatttttgccaaaatattagccgtcgcagggaccacgaaaatataatcagcccaatctgccaaactcacatgcgcaatgacgctgtcattgtgcgcatcgaacaagtcggtcacaaccggctgctgcgtcaaggcttcaaacgtctttggcgtcacaaattcagttgcggcctgtgtcatcacaacgcgaacgaccgcccccgccttcatcaacaagcgggcaaaaatcgctgacttataggctgcgacaccaccgctgacaattaacacaatctttttattggtaaacatgccgtgctgctccttctagcgttttgcttaaaaataaccacattaagtttaccatgaatagaaatcttacgaactatataagtagaaaacgaggactatcgtctccgacagtcctcgtttcacttctcaattaattttcctcaacctcacgcttacggcgcgctgcgaacaacataaacagattacttgcaaacaagaagaccccgatggcggttaagtaactcatcgtgtctagaccagtgtccggtagcacccggttagccgtaccggcagccaacgttcgaccggtagctgtatatggcaacacacctgcccccgtatatggcaagtaaccactcgggatagccgtgtagcctgcctggaccgctgcaggtaacgtggtcatcgtcggttgatacgtcgcccccagcgtggccagttcagcattttgttgcgcttggcgcgcctgcggaccactcacaatcccattgttttgaccgatagcatcggccagcgccttagtcgctgcaacaacatcagcggtcgttgcttcgccacgagacgctttcgcttgcacatccgccaagtgattccaagcatccttaatcgtgtcggccatatcagccggcacgctattctttaaggccgtcgcatcctggttagccgtgtcacgggctgcctgcgcattcttaaacgcggtctgcaaatcttgcatggcgttcaaaatgtcctgggttaatgctttgggatcatcctgatctgccgcagccataaccgcttgcagtcgttgcatcatttcttgcaccgccggttcattgcgtaccggactattttgcacctgtgttagcaaatcagttgcttgactttgggcttgttgacgagctggcttcgccttatccaaagccgtttgtaatgcttgcatggcgctcttaatgtcgccttcagccgcattaccggccaataagactcgcaattgcttacttgcatcagctacggcaccttcatgcgacaccggcttcgtttgccctaataaagtatccgcagccgtccgcacatcatcaacggcttgcatcgccacctttaaggcatccgtcgctgccttaatatcagcagttaacgcatcctgattatcagtggccgctaattgctgcaaattggcaagctttgtcactgcggcttggacggccggatcattctgaccagtctttgttgccgcctggcgcatcgcatccgccgcttgattagctgcgtcacgatctgctttggctacttgtgttgccgtctttacagcgttaactgccttcgccaaatcagccgttgacgtttctggatcggccaacgcctgctgcaagtgtttgattgccgctgccactgccgattcgtatgaaactggtttagcttgtgctatcgcgtcgttagccgcatcacgggcactgttcaccgcgtctaacgcttgctgtaatgcttgcgtcgcggccacaatatcctgagtcaacgcctctggcgaatccgtcgccgcggctgcttgaactttttgcaacttggccaacgcggcgaccaccgccggatcaccactacccgccgactgttgtgcctgatcggccaacttgtcagccgcttggttagccgcatcacgggcagtattcgcatcagcgaccgcttggttcagcgcctttgtggcgtcctcaatggccgtctttgttgccgtcgaattggccaacaaactctgcagcttgtctgcggtgtccttgactgccgtttcatttgaaactggtgctgttttacttagtgcatcctcagcggccgttttcgcatctgttaaggcagctgcagcatcagcaaatgtggcccgcaagctatccatcgcagcgtgcttttcagcagcggttgcatctggatcggccagcgttgtctgcattgtcgcaagcgctgattcaaccgtcgcattatcactgtatggtgttgccgcttcagtcaacgcttttccgccagcctcgaacacagcatccatggctgttttaatatcggcgtatggtgtatctggattatttaacgcgtcattcaaggctgtcactgcgtcagtcaacgcagtctgcgtatcctcggaaacagctttactgtctgcaatctccggatgaacggttgtcccctccgttgtggtcgcctgctgcgcttcagcagcgtcagcccgggcgtcagcttggtattgggcaacatcggtcattgcctgacgcaacgcatccgttgctgcgataatatcagccgtcaaactagcacttgaatcagccgccgcccgttcacgaatcgcatttaaattcgcaatcgcattctcaatttgcggttcgttctgcaatgaactattctcggcgtccgcaatcgctgtcgccgcgtcgtcatttgctgtatttcgcgtgccagtatctgtctgaactgcactttgtaatgccgtgacagcggccgtaatatcagcggccgtggccttcggatcttgcagaacgttctgtaacgcgttgatttccgacgcaaccgccctttcatttgaaactggggccgtctctgacaatgccgtagcagccgcggcccgtgccgtttcttgggccgcatcttcatccgcgaccgcttgctgcaaggcggccgttgcggtcgcaatatcagcggttaaggcatctggcgaatcactcgccgccgtcgccatcacatccttcaaattttgaatggcggtttgaaccgctggcgctgctgactggtcgccattcgtagctgttgtaatcgccttgttcgcctcattgtttgtcgtcgtccggtcagtctttgctgccgttaccgctgtcgctaactcagtcatcgcattctttaaatcttgttccgtcgaagttggatcatcaattaatgtttgcaaattggtacgagccgtcgcgacatctgcctcattcgtcactgggccagtttgttgcaaggctgctgttgccagatcagccgcttctgctcgtgacttagccgcatcaacctgagcttgcttgaccgcactaatggctgcttcaatatccgcagtcaacgcatccggcgaatcactggcggccgtagccatcacttgttgtagattctggatggctgtcactacacgttcatccccactttgatcagagttttgcgcgctcgtgacggcatccgctcccgccgtcatcgcatcatcacgaaccgcacgcgtcgccgtcgctgtgtcacggtactgatcaatcgccgtctgtaaatcggcggccgtggcgagtggattatcaatcacttgttgcaaggcaaccttggcatctgccgtggcttgctcataggtcactggctgcgtttcactgtcatctgccaaaattgcggtcgcttcggaacgtttcgtttcttgtgcttgctccgccgctgttaccgcagctttcaaatctgaaatacgatccaaaatatcctgcgtcacggcatctggcgaatcactcgccgccgttttcacggcgtcctgcaacgcttgaacagcatcacgcacagtagcatcattagccgctgttgaattttgcgcactcgctatttcactcgctgccgccgtatttgccgccgtacggaccttcgtatcatccgataccgcttgtgacagcgccttggtagccgcttgaatatcggccgttgtcgcacgatcatccgctaacaaggtttgcagttttgtcatcgcatcctgtgtggcagattcatgcgaaactggtttcgtctgtgcaagggcattgtccgctgccaaacgtgcttcctgttggtcacccgcagcatccgtcacggcatcttgcaaggccgtaatcgcatccaaaatgtcttgtgtcagcgcaccagcatcatctgttgccgcttgattttgcaaggcggttaagttagcaatggcagcttgtacacccggttcatttgcttgcgctgttccagccgccgttaatttcgcactatccgccttggtgttggcggcttcacgatcactgttggccgcgtcgaccgcgttttccaacgcgttggtggcatcttcaatttccttaaccgtcgcaccagtatcagctagcaccttgtcgagtgctgtctgtgccgctttcacaccactttcatttgaaactggcgccgtgtcaaccgctgcagctgcatcacgagcggtctgttgatctgccttggcttgtgcaatcgcatccgttaacgctttcgtagcatcggcaatttcagccgttgtgcccgcgtcattcgctgcatttgcttgagcttgttgtagcgcattttgcgccgcaatcactgctggttcgtcagcttggtcagaatttgacgccgtcgtcaacgcatcattagctgcctcattcgtggtatcacgttttgctttttcgtcattaactgcatcttccaaagcttgttgggcagcattaatttcagccactgtggcggttggatcaccaactaccttggccaactcgctcttggcatcgaccacactctgctctgacgaaactggtgccgtatcaaccgcattcgcggcatcacgggcatcttgttgggcctgcgtggcatcttgtaccgcttgcttaaccgccgctgtcgccgcaataatatcagctgtcagcgcattcggatcatcattagctgcctgggtgagcaaatcttgcaaatgcgaaatcgctgccgtgacgcctggttcttcggcctgatttgtcgcttgcgcatctgtaatcgctgtttgagcagcatcattcgcatcatcacgctcactatcagcagctgcaacagcctccgtaattgcctggccagcagcgacaatgtcagccgtcgagacgtcaccaccatctgctgcctctgcaaccaaatccgccaacttttgagtcgctgcgacaacctcgggttcattcgtgacaggattagtggcaatcgcttgcgcatctgcaattgcttggtcttgcgtacttttagcagccgccaacgcattttctagtgccgtttgcgcggccgtaatatcagctgacgtcgcaccatcggccgctgcttgatcacgaacatcttgcaagtcttgcatggcttgttgcacagcctgttcatcggcataaccagaatttgtggcagccgttaatgcatcgacggcagcctcatccacgacttgtcgatcgtctcgcacatcatcaattgcatttttaaagtcattaatcgcatcggtgatatcagcagcggttgccgtcggatcatcaaggaccgcttgtaaggtcgccttggcggatgcggtgtcatcttccaagctcaccggtgtggtattgtctgctgtcattgcatcagttgcttgttccaccgccgccgcacgatcactctgagcctgactaatcgcatcagctaacttggtcatcgcatccgcaatatcctgcgtcaaggcaatatgccctaaatcagtattcgttgcttcattagttgcatcggatacaacctgctgtatcgtcgcgattgcgtctttaaccccttggtcattggcgttgtcgccggcttctgcggctgtaaccgcattattcgcggctgtcacttgtgtatcacgtgcctctttggccgaatcaacagcatccgtcaaagccgttgtttttgcttcgatttcagcggccgtggcattttcattgtccaaaatctctttcagtgacttggcagccgctaatacattcgcttcatttgacacaggtgtcatagcagccaaggcagcagtggcagcagctctagctgtttcttgggccttctcagccgttgtcaccgccgtgttcaactcagccacagcatctaaaatcgcctgcgttgtccctgaattcccgtcggccgcggcaatcgcttgcgccaacttatcttgcgcgtcaatgaccgcctgatcttgcgcagccgctgaagtggccgcggcattattcgccgtagcagccgtatccttggcggcgtctcgatccgtcacggcgtctgccaccgcctgtttcaatgcatcacgcgcggtggcaatctcggctgctgtcgcgtctgggttactcaacaccgtatccaagtcactttgggccgtcttgacgtctggttcttgactcactggattagttacaattgcttgggctgaagccaccgcaaccgctttctctagggccgttgtggcatcaacaattgcctgcgttgtgcccgtgttcgccgcggcattcgcttgggcggtttgcacagccgtaatggcctgggcaacggcatcatctgtcgccacatcctgagtcgttgcatttgtaattgctgccgccgcgttgctatttgctgtctcacgcgcggtttttgcatcagccaacgcttgatttaacgcgtcttgggcagcttgcacatcggccgacgttttcgtcgcatcacgtgatgttgactcaagcgctgccgcagcggatgccaccgctgattcttggtcatacggtgacgtttcagtcaccacgaccgtcacctgcttggtcgtttgaagcccggacgcatccgttgccgtaatcgtaaccgtataagtccccggttcatccttaacaactgagtcataattcgacgtcaccttaacatcaccagccatttgattatcactggtttgcgcattcacaccagccaagaaatcagccgccgtgacacccgcaccggttgtgacattaaaggtgtctttaccagttgtgatggctggtgcctgggtatcggtatacgaaaccgtaaatatctgaggtgccccatcagtatccgatgcatttgttgtatcataattcggatttgcctttaaagctgcatccaatgtgtcgtaaacttgaccgtttggcccagtcaccttataagtgtaaccagttttcgccaacgaactatcagttgcactaaacgcaatcgctgagtttgagccacccgtcttcgtttcaaccgtcgactttgtgccgttgaccacttgatcaatttgcgcggtctgtgtcaatggtgcaaacacaatcgtagatttttgattcgtcgccgtatccgtatcaaagttaccataaatcgtcgccgaacgttgatcggttgccatgctgagtgataccccgcttgccaacgttgtcgcgcccgtgtcgattttatatcctgccggcgcgtacaacgccgtattagcgattgcgccgtcagatgttcccgtcaaagttgttggcgacccactctgtggcgttgccccagtatacgtaaactcggccgtctgcggttgtgccgtatagacaaccttaaaggcttgttgttggctatccgtcgtcgccgtgctggcattatctgttgcgtcatacttaccattagtccccgctgctaaggcagctgccattgtgtcgtacgtttgcccgtctggcgctgtgaccttgtacgtgtaacccgccttgatcaaactactgtctgaaatgctaattgtgccaccagttgtccccttatacgtcgtcgtcccgttcccactagcactgttaccgactaatcctgacgttgtcaccgttgcttcttgtaaggccggtgcgtagaccaaattcaaactcggcgttgtgcccgatccgaccttaaccgtaatatcatttgctgaactgatgttatacccagtaatcttcggcgcatcatagctataagtatcacttgaggcctttggtgacgcattgttgattcccaccgactgaccgtctccaaccgctaaagtcgtccccgtcttaaggacgttaccagccgtatctttatacgtcactggcactgtcatcgaagccttcgtaccggaaacttgagcaaccgatgacgtcatttcagttgatttatcacccgccgaaccaatcaaagcaaatgacaaatagggcatcgtggtcgtattaattgtcattgttttcgtgaccttaccacccaaactaaatgtcaacgttttgttactagctgtgtatttaatcgtccaggcggcaccatcaccactaccgattccgctaggggcattagacgcgggcacacttgatacaccactacccgaggtcaaactcgaatcactggttgcttgtgttaaattaccggatgagtccgtcgtacgaataccaaccatcgggtacgtcccactcgcatctttgtaggttgacccgttgttatacatgtcgattccaaatgaaatggcgttcttaatcccggtgattccaagtccaccaccaccagttccactacccaatgaatctggcaaaatagatgacaataaaataccgttataatccgccgcaccagagccataattggccatataaaaggcaccactggccgtgaaatctttcgacgtatccaacgccgtattataaacaaccaacccggtttgattttgaccattcgacaatccataccatgttgtctttccagatgaattattcgactggtagtaggcacttcctttaactaggtaatccgctgttttatccccggaagacgttgttgttcggcttggcacttctttggcattatcaatcgtgacgccagaaaccgttgcggcctcagcaggtgcgattgccatctgcaaaacagattgcaccaaatcatcgacccgttcagtcaccgtgtccgtttgtggcgccgcggcaatgccacctaacatcgccagcgtcgccgccccgcgaattaaccatttcttacccccaccatcttcagccatctttcgcagacgtgcatctgccacaatattttctttcataattttatccccatcacattagttcttgcgctataccgccagtataaaaaacgtttgtgcgcttactcggacaaagtaacgatagatatggtagctttcaccgaatgaattgtgacaattgttacaaaatttagaaatctttcccaaacattctatttgggaattgtgacttttgttgttaaaatataagtgttcaaatatggacatcaggcagtgcgaataaaggttaaaaacccacgaacttttttccagttcgtgggtttttaatcatttcttattgttgcttcgtttgcttttgacgtcgtattaacaaccacagaagccaaccaatgaatgcaagcaggccaccgataatgatcaaagcaagctttaaccaaattgaccaatgattcacggcatctttctgactcgtaattgctgccatcgcgttcacccgaacccggttggtgaacgtccaccgccctttgtctgttgtcacctgtgtttcgacgcgataacgccctggttgcaactgtcccaccgacgtgcgatggtcgtagcgactactaggggcaaattgcaagtcgcgtcgggtctcactcatcactaactgtttgccccgataaatgcgggtttggattgtcattccttggtggaaaattggcgattgattacgtattcgtaggactaaatccgtttgaccatcacgccgtttcatcgtcatcccgtccgcacgcatatgggccgcaacatgtttttcattatttcgtaccagcaaagcaaccgtgtatgagtattcttgcttgatttgcatccccgccggattcctttgctgatcattcgctaactcataaaacgtcaagccgccagccttcacacctggaaaagccgtacccggcatctcaatggcaattgaaacaaattgcgaactctttggttgtagtgtaacggcatctgctacctgaaccaagcgtgcccattgttcatcctgactcgtctcataatccacaacgccattggcattcgtagtcgccgtcgctgtgcgaacccctacttttactcgccgatcagttgggttcgttagttggacccgaacctgcgtcttttgacgaggcgctaaaatcaaatcaaaatagccagccgtcgcatgtcgttgatactcagacgtttcgatttgtacaccaaacgacaattcattcgctgacattttttcacttgcactaaatacaacaccgataatcagtgcaatgacgacctggaaccattttaatttgtgcatctttattctcctgttggtgctgctaacaacttatacacaatcgtgctgttataatttcctgacaatttcttcatctgacctggcacgtgcaatgacacctcacccaatgaaattgcggtcgtgccataaccatctcctggttttgcatatgccaaacgcataaacgcttgattcaaagccattttttctttggctgtcaaaacagttgtatcggttaccgcactcttactagtcacgcggtcaatttggagtttagcgcctttcaattcagcccccttttcatggacaaagggggtcttttggcgaacttgcaagtcccagccatccaattggcctcgttggtcagttacctgaacgtgatttgctaccgctcggccagcaaaaacatcttgtttggccgtataggttcgatcgaccaggctcattttttgcgtatcaaattgccaccgtgacgcataatctaacgttagtggcattggtgttgcccctaaattcgctggggcgtgcggatctgtttcgcgaggcgcttccgggtcaacgtggccaattgcccccggtgtttctgtccccgcaaaaccaaccaacgcttgcgtttcaacctcaatattttccgctgcaaaaccaacacccgcagttgttagccctgtacaaatagccaaaattcccaaaccaagttgtttcttcatctttttgctccttttaatttgttggtcccgcgaccaaatttaatgacacctgtgcttgatacgatcccactcgtactaagtcataagcctcaaattgtaatgttgcccctaaatcttgcatgccagtaccacgacctaacaacacgttttgataatcccctgtcaaaatgacctcattaaagcgcaacgcggttggtaattgatgcccggtaccaatgtgtgtcaacggctgctttaaacgtgcctgcacaacccaagatttcaagttactccccagtagcgtgataattcctgagcgtggttgtgcggcgattgctaaagtttcaccgtatattttttgatggtcgttcccaaaatttgcagcttcaaccatcattttgactggttcaggtgctgattttggtgaactggccgttaattctatctctgatatttgtgctagccaatcgctagccggccgcccaatttgtgcatcagtgatccctttaccacgacctttaatgcggaattgcgagacgtcggtgtgctgaaattccccaatttcaataccacgacctcgtaaattgatttgttgtaaatcaatcatcgctagtccccgttggaaaattggttggccagcgcgattggtcaattgcaccgttgccggccgtacaaatttcaataaggttggtttttggagcgcaatcagggacggtccctgaccgctcacgtaaaaattactgtctggcataacctgaaccccgccccggccagtcccatcggctgccttttcaagcaccggaatttgcccagtactcgtcaatcgaagcgtcccttgatccgttatccgccacatcgcgtcatcaccagcaccccaatagatgcctggcccgattgtattcacgtcaacatgaccgccctggatggttatccgtttaaaattactcgcaatcggcgcacaaatacgattcgtcgctgtgcgattcatgaccgaaatggccaaaacggcctctggcgcaactaagacttcaccctgttgactagtcgtccggaatacatgggcgttcaattgaccaaacgcttcaacgaacgcccccgtcgccagtacaatgcggttggccgtaaacatatcaccacccatcccgtgcaacgctaactgaccctgaattaaaacgtcgttagcttcgaacattgtgccattctggcccggcgtaatcgatacattgctgtccgctgttgtgacaatttgatcagcccgcacaagcggttggtcaccaggccccgtcagccaaaaatcatgactcagcgtaaccgttgccgtactatgcaacatcttccgttgctgcgtctggccaattggcgtcaatgataattcatgtccgtcgccaacaatagtgaccgactgtcgccgcgtggcaagtgccgtcgtcgtatcattaagcacatcgccatctagccgaataacttgattcggtctatcttgattccatgccgtttcaaattcacgcatggttgcaacgccaccttcatctgctgccacatactgcacaactgacagcacactccatattgttatcaccaccttatatagccaatttaaagtcattctcacgtccccctcgtttgcgtttggtttcgttgacatgcttaactttatcggatgttaattgtccgctccacgtcatatttttcagaaacgtttaaaaaaatctcgcttacgagcggtagccttagcggttactgaaagtacgcacaaaaataaaatgccaacttaatgacagttagtatgaaccctgtcatcaagttggcattaagtaggctaatctgtcgccgtcatccggtggacagttaagtcggttgctttttcaataaatttattaaattcgttttcatctggataatgcgaccaaataaacggtgttgcatttttcaaaccagcgatttcaatatctgagatataaaaatcagcctgtggcacggcttcgtgactaacgacaatattcaccaatggggtctgctccagccgactaacaattaacgcctccaaactcgggagattattcatatcaacaatcaccttaattttcggcaacaatttcttagtcgctactgtttgaatcatagccgttaaatactcttcaaacaaaacattcagtaacgcttgttcaggaatgccaagtaccacggctagcttagcaacgaccgttagaattatttgggtctggattgggaatcggtgtttcgcccgaacgacatctggcatcggtcgaaatcctaaatgactaaaatacaataaccgtacatgcgtcggtgagagtaacgccatcatttggcttaacgtctcagaatcaagcgcctggtgcatgaccgttttaaattctcgttgcattgttgtcgtgaagggctgcaatttccgtgtcgccgtctcagtcagcaaagcatccggaatcgggcctaaaaaaccagcaacatacatcgaggcaatggcgtactctgcttctcgtgctaacaccgcatctggtaaatcaacaaaatggcgcatcatcataaccaatcccgcatggatctgatgatgctgttcatcccagtttataagtggcacaaagagcggtggcatttcggttgccataatggcgtggtgattaaccagccgtgagtaccaaatagcgaactgcattcgaatggcttgtttcgtcgtttcccgttctggcaattggtataacgctaaaatttcagtgactgctgcttccgctctaatccgcatctccgtcggaaacggaatctcctgatcaacgtacgcttcccgcatgagaccaaagaagaatacgcgaatagtcgtttcgtcaccaatcaacgcattgtggcgggttaatgtaattcccacccgtgccaaaaccaccgcaatttgtttcttgatcgccctggcaattggcacggttgtgtgatgtgtttcagcaaacacttcatatgaaacaaatgtttcagcaaaaatttcacctaacaacgcccaaattatcgattgctgtcgatactcatgcgttaatcgtttaacatcaagcagtacgcgatgatcaacttggaccccgcgacgtgacgcatctaacgcaaaagcaggtggttgctccggccataactttttcaaatcttgttctagccccgccaaagcttggccaaaccgataacgggtccatcccatttcggctaaaagatgtcgaatcgtcacaaagtctgccacttgacttgttaaaaattgacacagtcgtaatttatcctgatcttgcttctctaatacccaacttgcagtcatcataccccagtcccccagtctatgtatcagtgtacggaaaggggcaggccctcgcaaggggagagacttattgttcgaaaatgaattaatttcgactttttttgaaattgggtgttgcacgttattttgtcatctggtatattattatctgttgttaaaagcagtacgcgtttaacgaagttcatggctcattggtcaagcggttaagactccggtttttcacaccggcatccagggttcgactccctgatgagctattgcttttatcattaagcattcaacaatttcatggctcattggtcaagcggttaagactccggtttttcacaccggcatccagggttcgactccctgatgagctattgctttcatcgttaagcattcaacaattttatggctcattggtcaagcggttaagactccggtttttcacaccggcatccagggttcgactccctgatgagctatttgccttcatcgattaggcattcaacaatttcatggctcattggtcaagcggttaagactccggtttttcacaccggcatccagggttcgactccctgatgagctatttcgaaagacatccagttttgggtgtctttttttgtacccgacaacaactatgaccaagtaaacctatactggcatcacacaaacgtgcggcggttactttttcacaatattttttgttagaatgaaaacgaagaatcgtagcacatcaagtaaccttaacaaatgtagccattatagccaaacgaacttggagggcctatgaagattaaagtcgttattgccggcggtaccggatttgtcggtcaaggtattattcaattactatctcccgaaaaatttgaaatacatagcctttcaagacacaactatgtgtcacttccaaccgataaaacaatttaccacagggttgatctgtccaactcatcggaattgcaacatatcattgcagacgccgactgggtcatagatgccgtgggaatcttactgcccaatcctatcaaagggatcacttatagaaatagtagctatgcacccgccaaacacttaatcaatcaattaatcagacaaacaaatactaattttttatttgtttccgcaaatagtggccccttttttatgaaaccctatctaaacgcaaagagagcggtggaaagactcatgaagcaatcattgccagggcgtgcgtacattgtctatccgggtattatttatgataaaacacgattaagttcttttattcccggcatccttttgtcacatctggtaaaagtgccttactttaaaaaattacgtccaatcagcagacagtcattttcactagaaattcagcgcatccttaatgggcaacacagtcatttagaagaaaaaatatgattagtcagtacaatactgacagcgttactattaatcacatctaaacgaaccaacgcccgccgaaatcactcctatctattgtcaaaatgagcgcattaaaaaaatggtcggaagaaattcggtgtcataccgaaatctttccgaccagttagccattttaaacgaagctctgcaagcatcagcagttgtctgtatgcctgtttaacttatttaaataaaaaggagacaacgggatttgaacccgtgcaccggctctacaccggctcggcggatttcgagtccgctgcattaccactctgccatgtctccataacaatgatatattatagcgttgattcaggattgtttcaagtcatattaacaaagtccccgcccccaactgtgttatcgcaaaaaagcgccagagttagatcatgactgacctatctctgacgcttttttgcaatctactcgaatcttatctctatctaatgtatcagattttcatgaattgtgcgaacttttcttgaaaatactgcaaccaattattttacacgacgcccatgaaccaagaagtaccaaatcaatgcaatcacggtcactagaatcatcaactggtaaagtccagcaaatccaatacttggttcgattaaccctaacaaatatgggccaacaccaaacgccaagtcaaagaaaataaaataggttgaagttgcataagacatgcgctcgggtggcacaatttttgaaatcgtcgcttgtgcagctgattggaaattaccaaagcccaaaccgataaagattgctgccaaaacgaaaacaaccacattatgaacattgctcaacaaaataaagccaattgctaacaacaccaacgctggataaataatgaagttctcatttttactatcagccaagcgaccagtaaatggccgactgatgaagataaccgcggcgtaaatcaagaagaagtattcagtgacttggctcatatgttgggtcttcataaagaaggacaaataactctgaatcgctgaatacgtcaacgttgcaatgaataaagccatagccaacggaatagctttgggctccataaaacggtgtaacccggtcggtgcatccgttgtggcggtcttcgtcgctgtatgcgccttaatgtcaaccgctgacttgtgaataaataatgttgccaagaatgccaatccagcgattcccgtttcaacattgaataagaaactataactcacaccactcaacgccaaccccaagaaaggtcctaaggccgtcgcgataaccgtacttagtgagaaatatgaaattccttcactgcgacgttctgccgggacaacaaagacgactgctgtatttgtcaccgtcccaattaacccaatcatcataccttggataaatcgaatcaatagcaacacaatcattgatgtcgcaaaatgataggcaaccattgttggaatcaacacgaaggcaccaatcaacatcattgtctttgtcgaaattttcgccaaaatggcgcccgacatcatgcgcatcactagcgaaccaataacaacaatcccaactaatagtccactaaccgctgtcgacaaatgcaagacatcaacagcatacggcccaatcgccacaatcaaactatagaacgtgattaaaactaggaaattaatcagcgcaatctcaaggaaagactggttaaatatcttggcttttccagaattcatagtaacctctactttctcaacaataaataactgcaattactgcaccgtttccgtgcaaaaaaatgtcgcccaaaaaagacgacttatctatgttacgcttattttcagaaagtatcaaatatcacccagcattttcagcaaataacacaccaataatttctgcgcgtgttgtggtcgagtgtgttatgctaaagctactaactaataagagaatcgagattgcaaatggcaacttacaacctaactgacatcatggacttactcaaactctggggtgttgactatccaaacaagcaaaagaatcgcgttaaattcgatgcattcaagaaggacttgcgcaagaaaatcgaagagacgttcgaaaccgaagcggctgccttacaagccgtttcacctgaattaattgcaccagtcaagccgaacccggttactggccaaacaaccacctacacggcgcgccatgtcttgtggttgttggatcaacctgtattcttagtttgggtaattaagcatgccgctcgccaagacgccttgctaccacacttgcaggtgatgaagaacacgccttggacaaacgatacagaagaacacgccgagacaatcattgacaattggcattaaaaagagagtgagacgaaaggtgttatattaagggttcagcctttcggaacacgtttaaaagccgcaaatctcccgattcaattcggaggatttgcggctttttagttaactaatcaataattcgtaattcctttgacgaatgcgtaaatgaatcagcacccgtttccgtcatcacgacagaatcttcaatgcgaatgcctaggtcccctggaatataaattcccggctcaattgagaaggccatgcctggttgcaataccagctcattacccgtcgcaatttgaattgactcgtgcacagatgacccgataccatgtcccaaacggtggacaaagtactcaccatagccagccttggtgataatatcacgggcaatcgcatccaactcgcccgcggtcatccccggcttagcttgagactgcgctgccaattgggcttccaaaaccacgttgtacacatctcgctggtgatctgaaaccgtttggaaggcaactgttcgggttgcatctgacacatacccttcataaatcgtacccaaatcaaacaacgccaaatcaccacgttgcaaacgtgtcgaaccagtatcaccgtgaggctcagccgcgtgtgcgccgaattgaaccaaggtttcaaacgacatgccaacaaccccggctgacttcaaatcatattcaagcttcgccatcacttgtaactctgacacaccggcttgcatcgcagcaaaagcaaattcgaatgctcggtctgcatcatcaccagccttgtgcatcttagcaatttcatccggtgtcttgattaggtgcatctcaaccatcaccggtgacaagtcacccacaaactttgcatcaggtactgccgtttgcaaagctgccgctcggtccaatgtcatttgtcccttttcaacggcccatgtcgtcgcatgttgcgtgtgtgcatgcagatgttgcgcaatcaattggtatggttgctcgtgatcttgatacccgtaaacagggtgtgtccaaccagcccccttaaccgcttccacttccaacgctggcgcaaaaatgaatggttcatcttgtgggaaaacaaccagcgctagtacacgctcgattggatccgattcaaagccagttaaatatgaaattgagtggaaatctgaaaaataggcgacatccaattgattttcattcagccaattttgaatctttgctaacttatcagtcatattaaagaatcctcgtttttcacgtttcttttcattgtacgctcattttcagaaaatgcgcaactcctcactattgtgtgctagaatataacattgtgtgaattgattgtttttatgaaaacaacgtatgaaaacatggtacaatcacattgtaaccgtttgcagttatgcaaaggtacgagcttaaaaaacaagctatgaaaataacatgattgtttaaagacagatacaagacccaaaggagaatcgacatggaaaagcagaccatcacgatttacgacgtggcccgcgaagcaaaagtttcaatggctacagtttcacgtgttgttaacggcaacgccaacgttaagcaagaaacaaaagaaaaggttgaggcggtgattgaacgccttggttaccgtcctaacgcagttgcccgcggccttgcctcacgtcgcacaacgacaattggtgttgtgattccagatgtcactgaccactacttcgctgagctagcacgtggtattgatgacgtggctgcaatgtaccactaccaaattatcctagcgaactctgatgagtccgacacaaaggaactgcaagtgcttgaaaatcttttgagcaagcaggttgatgggattgtcttcatgggaaacttgattgacgacggtattcgcaaggaatttgctcgcgctgatgtgccaattgtgttggctggatcagttgaccacgtttcagaacaaccttctgtcaacatcgactacacaaccgcaatcggcgaagcgaccactaagttgctaaagaacggccacaaacgcgttgcctttgtaacgggtagcctagatcatggcattaaccgtgaatttaagcttaagggatacatgaatgccctggccgttgctggggttgactatgatgaaagtctggtcttgcaaggtgactatgattaccaatctggttatcaaattgctgccctggtccaagatgccaaggcaactgcggccgttgttgtgaacgatgaaatggctgccggcttgttaaatggtctaactgacgccggtgtcaacgtgccggatgattttgagttgattacaaacaataactcaaaaatcgcggtgatgacccggccacaaatgtcatcaatcacgcagccaatctacgaccttggcgcggttgccatgcgtatgctgactaaattaatgaatcacgaagaattggcagtaaagaacattatcttgccacacggttacattgaccgcgattctacaaagtaataataaccaaaatgaaaagcgtatcacggcaaatgtgatacgcttttcattttggttattaaagctctgacaagcccttcttacctgattctgacaaaccttgtgttggttccaaaacttcaggcgtaatcgtctttgcttcttcaaccgcaacaggttcttctaaatcatcgaatgcttctgacaaagatggtgctgttggatccaacacaatgtcaatgtcttcatcagctaactctggtgcaaccttgcttcggacttgatccttaacctctgacgcctttgacttcgcttggtcagctaaatcttgtgcttgggccttcaaatcatccgccttagcgcgtaggccggccgtcttttcagacgcttgcgacttcaaatcagcaactttaccgtccaatcccttctcagccacaagttcatcggcacgatcccgaactgaagcaacggcatctgttgcagcatacgtataatctactgccttgtcgcgcacatccacaacaacgtcatcaacctttgccttcaacttgctttgctcctcagctgacaagctcttgtagtaggcgtacccagctgcggcagctaccccactaaacaacaatcctgctagaaatcccttacccttagacatgcgtttaccctccaattatttacttgatgatgcttgagacttacgtgctttacggaatccgttaactgcggttaccgctgatgcaacactggcaccccgtgatgaagctgttttcttcaccttgccagtcaaatcgtgggttgcagcgttcaattctgaaaccgatgtgcctaaatcagccaccgcttggaaagcggggtcgatcgtggcgaccttgccatttacgtcattcaataaagtattcgcgtttgccataatatcattcgcttcacgcgcaataatatcgacatcacgggtaattacacccaatgtgcgcgtcaaacgcacaaggaacaaaccgataaatagcaccaataacaaaaccgcgactgcgattataattaatgcaatttgacctggtgtcatagttctgcctccaaacatatttgatatctttaattttacctgtttattgaaagcgtttcaatgaaagtgaatctaatattattagtctgttgtgtgtatggattatccattcgggtaaactaagcctgggatactttcacagtcacttcgtatcatgtgcatatttttacaaacttgttaaaaacccttaaaattccttgttataacagcaaatatttgataaattggtaagcgttcgtgtgtgcgcagaaatgcgacataatttgttttggttaaacatgtcactttttatttttttggaggaattatggaccactcattagtagtgcgcttgttcgctgaattttttggaacagcatttttggttttattgggtaacggagccgttgccaacacagaattgaagaacacaaagggagaagaaactggttggctgaacatcgccgttggttacggtgctggtgtggctatcccagcaatggcatttggtgctttctctgctcaaattaacccagcgttcacgttggccttggccgttgtgggcgacttcccatggtcagaagttttgccatacattatcgcccaagttttgggtgctatgtttggtcaaatgttggttgtggctgcatacaagccatactttgatttgacaacaaacgttgacgccgttttcgcaccattctcaacgactgatgctgctaactcacgaatgaatggttttatcaacgaattcgttggtacattcgtcttggtgttcggcgctttgggtattacgtcatctgaagcttataagggtatcgctggtctagcacttggtgtcttggttgcaacattggttacgtcattaggtggtgcaactggacctggtttgaaccccgcccgtgactttgggccacgattggtccacgccctattaccattgaagttcaagggatcatcacactgggagtacgcttgggttgccatcttggctccaatcgctggtgcaatcgtcgcttcaactttgtactgggcattgtttaagtaaaacacgaaaagaatggcgttaacgccgttctaccaaacgtaaaaagcacaatctcgatgagattgtgcttttttaatgctcactagttattcagcagctaattctgccaccaacgcttcaaattcgttcaagcgctcttcgaacactttgaatgtgtcacgcaagtaatccggcttagtcatatcaagcccagccttcttcatcacatcgattgggaatgcagatgatccagccttcaagtattccttataagccgccacagccggtgccccttcagtcaaaatcttgtccgccattgccgtcgcagcagcaaaaccagtactgtattggaacacgtagaagttgtagtagaagtgtggaatacgctcccactcgtgcgcaatttcatcatcaaacgtcaaggctgggccgtagtaacgtcggttaagctcaccataggcctcatccaaaacatcagcagtcaatggcacgccttgcgcatccataacgtgcatccattgctcaaactctgcaaattgggtttgacggaagaccgttcccttcacgccatccaagtactgattcaagatatatgcacgcaacttcttatccgtcaccgtcttaagcaagtaatccgtcaacaagttttcgttcgtcgttgacgcaatttcagccaagaagattgggtaatcgccgtagtggtatggttgattttgacgagtcaaatacgagtgcactgagtgacccatttcgtgaactaaagtgctcaaattgttcaagttatcgacccagttcagcaaaatgaatggatttgtatcgtatgacccacccgagtaagctcctgaacgcttgcccttattctcaatgacatcaatccaacgattatcaaaggctgtattgacaacttccagataatcttcccccaatggtgccaacgcctttaatgcctcagcctgagcagattcgtaatcaatcgtaaagtcaggttcacccaaaattggggtatacaaatcgtatgagtgcaattcgtccaagcccaacaattgctttcggagggcaacgtaacgatgcaacaatggcaacgcttcatttacttccgccaccaatgtatcgtataccacttctggcacatggttaccagctaaagcagcttcacgcgcattatcatagttgtgaaccgccgccataaagttatggcccttcacgtgactggcaatcaaagatgcaaaggtattttcaagtgagacatatgacttgtagaacgtttggaaagcatttcgacgtacttccgggtcagtcgactccaataaacgtgaatagacaccgtttgacaacgtctccagttcaccatcttcgttggcaacagcttcaaacttaatatcggcattatccaacacaccaaatgtccgttctgacgccccaaaaacatccccagcagcagctaacaatgcttcttggtctggcgttaagacgtgaccttgttgcgtcaagatgctctcgaagtaatgcttgtacgcccccagcttaggttctgcttcaaaaaaggccgttaattcagcttctgaaagtgacaaaacagctggatcaaagaatgcaatggccgccgaaacacgtgctgccaaggcttcagctcgattgctcaacccttgataataagcgttggctgtatcttggtctgacttcattgaagcatagacatacagcttttctaagtcacgcatcacacccaaaccgtattgcaacgcattgtacaaatctgtaccagacgtcgttgctgattgggcgaagaaatccgctgactctaaccgatcggccaattcttcaaaggcatcttcccacgcttcatcagaagcaaaaatcgtctgcaaattccaagtcattgactcaggcaatgcatctcgtaatggtaattctttggccattgctcgccacctcatttcaaaaatattagctttattctatcacttactgccaacagtatgcacgtgagaacgtaattctcgacatttttgattgaaatctgcaaaccactgtacatttgtgaccagacgccagcggtcatttgttacttgcacaactcccatcgactgccacaacaccaacaactgcgttaaccacagcttcgcaacagcgctagcaggggtggccccaaaagcgaaccattcagcccgttcaatcaccgttagtagttgttcagcaggacatggtgccttctcgagtattgtgattagctgcgtggccaaaatccaatgaggcgtctttaaaccgcccggtagtggctgcctgatatgacaacaaattggaatcccggtgactgtccgattttgctgataaagttgtttttgcagttgcctgatgcgccggtcacgacgcacaacctgttgctgaattttcgccaattgccgaatcggatcggaataatcctcctggccaacatgcgtccggccatccactgtccaccattcccgccattgaatcccctgtttgccacgccatagcgctacttggagtgtatcgtggcgaatgcgtgcaaacttcgccagtgtcacctgttgtaattttcgctgctggtaggttggccctagtacccacacaacatctaacccaagcttagcaaaaccagcggtacggtgctgcacccgttccacactgattggcgcacattgaaattcaatcgccacttgtcgattgtcaaacgttacgagcaagtccggcctttgttgaatctcaggtagccaaggctccaacaccactcggccaccaatactttcgaagaagtcaaccatcgctaatttacctagcaaatgaactgctgattcaccttcagctaatgcctgacatttttgtaagcttgtatgcgcgaagtgagcttgtttaaggcggccttttttgactgtcaccggagtctgacaccctggacaaacataattgcattgtttatcagccttatccgccgtcattagcccggttgtgccaagcgtttgtgcaatgtacatttcatcacctccaacaaagatagacgcatgtgaccgacatttgtccaaaataaagaaaaaagcaccactcagaacgagtgatactcttatcaaggttaaatttagttagctgggttttcttccaacttttcaatatcagcggctgatggttgtgcatcaccttgttcttcagcaagtaataccttgtcgtacttgcgggcgaatgggtaatacatgaatcctgtcatcacaagcataaccgcttgccacaacgcaccttgccaaccaccgacaatcaaacctgacacaattgcgggcgtcgtccatggtacatacataccattaaatggtggaataatacccattgcaatcacggcatacgtcgcgaaacctgaaaccaatggcgtcaaaatgaatgggatagccaacaatgggttcaaaaccaatggcaatccgaacaagattggttcattgatgttgaacaaagctgggacaatttccaactttccaagcgtcttcatttgtactgacttggcacgaaccaacataaagataaccaatccgattgtcatacctgaaccagtcaccgtaatgaattgatccatgaaggcttgcgtcacaatgtgcgccccgttatccaaagtcaacttaccagccttatacaaagccaagttatcagcattgtttgccaatagcaatggcgtcatgataccacccacgattgtggcaccgtgaacaccgaagaaccacaagaacactggcaagaaggcgacaacgacaacacccaacggtccatcggttgcgtgttgcaatggtgtttgaatcgtggcataaatccactcaaccatcgttgtattaaagccaagcttgaagataccataaatggctgttgcgaccgtaacaattgcagcacctggaatcaaagccgtaaatgacgccgcaacgttagcaggcacttgttctggcaacttgatggtaaagcccttcttcatgaaccatgaataagaccaaccaaccaacaatccaacgatgatggccacgatcatacccttaccaccaagccatgccttatcaatcacacctgacacttgccaagccgttgagacacgttctgggttcgcgatgctagtgaccgacttaactgtatccggttgcaaaatgatgtcaaccacaatggccaacataccggcaggcaccgcatcgtgcccctcatcacgcacccatgagtacgcaataccgaatacggcaaacaatgccataataccaaatgacgcgttgttagcttgcatgaaaattgggcctaagccaatttcatttaaataatcttggaccccttgaattgggaattgccccaaaatcaagaagaccgcgccaataacaatgaatggaattgggtaaagcattccattcttaattgccgtaaccgccttcgtgttaacgaatttcataaccggcggcaacaacttttcattgatgaaattattcatgttgttttcctctacttatttcgtatcgttacttgcatgtcatcaccaattctcaatttgattaacctaccccaaatcctctccatttgaggcaatcacttgttgataccacttaaacgaatccttacgatagcgcgcgcccgatcctcgacccatgtcatccaggtcgacataaatgaagccataacgcttcaacatttcacctgttgaggccgacacaatgtcaattcctgaccatggtagatagccaattagcggaatgccatctaaggcaacggcccgctccatcgcttggatatgcccttggaaataggcaatgcgataatcatcgtgcacttcatgttctggggtcaattcgtcataggcgccaaagccgttttcgacgataaacattggcttatgccaacgatcccacatccagttcatcgcccaacggacgccaactggatcaatttgccagccccaatctgacttctgcaagaatgggttgtcaccgtgattcgcttcctcatcatattccaaccaatcatcgccagtatcggatactgtccaagacatatagtatgaaaaggcgacataatccacggtattctcagccaaaattttttcatcagccggtgtaatatcgattttgaaacctttgtgtgcccagaacttttttagccagtttggatactgacccgttgcatggacatcaccccagaaatatcgcgactgcatcgcccgttctgccatcaaaatgtcttctggctttgaggaagctggataaactggattcatggcaatcatatcaccgaccaataattcgcatcccatctcacgtgcgatttcatgggcccgctttgtcaccaatgcggaggccaataactcatagtgtgacgcttgatacatcagttcttgcgcttcgtctgcctgataatcaagcaatcctgagttttgcagcattggatgcggatccatccaagacgtttgattattaatttcattgaaggtcatccaatacttgacgcgatccccataacgtagcatcaccgtatcggcaaacttcaagaagaaatcaatgacttgacggttacggaacccaccgtacttcttaaccagatgcaacggcatctcgaagtggcttaacgtgatgactggcacgatgtcattttcaatcatcgcatcaatcatcttgtcatagtaagccaagccggcttcatttggcgtttcttcatccccattcgggaaaatacgcgtccatgcaattgacgtgcggaaagcctttaagcccagttccttcatcaacttaaagtcttgtggatatgactcgtaaaaattaatgctccggtggttcggatagttaccatccggtaaaacttcatccgttacttcacggggcaccccatttttgccggccaacatcacatcagcaatcgacacgcccttgccatcaacatcccaagcgccttcaagttgatgcgcagcaacggcagctccccataagaacccctcaggcatttggtatcctttaaccattacaattacccctccaacttttgcacacgcttcatcaactcaatgagttcaatagccatgtcgcggaacgtaatggcattcatcaaatgatcttggccgtgaaccatatagagatcaacttctgtgtgctcaccttgggcttccttagttagcatatccgtttgcacatcgtgcgtcgctttcaactcttcgtttgcgagcttcaaagcaccctcagcttcatcaaacttgccttccttcgcaaattgaatcgcttggaaagcctggccctttgcgttaccgccgtgcataatcaatcccataacaacttccatacgtgcgtcatccatggctatatccccccgttgttcgctatttagtatcgtctgatgtgattacatcatggcctcggctgttgccaaaaccttatcacccttcatcatgccgtaatccatcatgttgataacatccattggaatgccggcttcatcagtcttcttcttaacttcattcttcatgtattgcacttgtggcccaagcaacaacacatctggcttttcagctgaagctaattcactgtcaatatctgccgttgacttcgcgaaaatcttgtagtccttaccggctgcctttgctgcatcttgcatccgttgtaccaacattgacgttgacatacctgcggcgcacgctaacataattaccttatctgccatgtttaaatcctctacttttctttatagtgtcacaccttgtgaggtgatgacttgcttataccactcaaaagaatccttgcgtaaacgttcgccggaaccttcacccatatcatctaaatcaacatacacgtagccgtaacgcttactcatttcaccggttcccgctgaaacaatatcaattggtccccacgacaagtagccaatgactgggattccatcgttaacaattgccttttccatttcagcaatatgggccttcaaataatcaatccgatattgatcatgtacctggccatcaaccacttcgtcataggccccaaaaccattttcgacaatcatcaacggcagacctgggtacaaatcattcagctcgttcaacgtgtaacgcaagccttgtggatcaatcgcccaaccccaatctgagacctgcacctcaggatttggcacaatttcaaagccgtgcgtctcttcaaattccgtatcacaagctgacgttgctttaacaacgaacgagttatagtacgaaattgccagataatcaactgtaccaacttgtaagacagcccgatcctcgtcagtaatgtccggtcggaagcctgttcgatctgcaaaggcttcaaattcggccggatatgcgccacggacgtgcacgtctgagaaccagtcgcgtgcttgccgggctttttggaccgccaaattatcggctggctttggtgacgctgggtatagcggcgccacattcaacatgcccccaatcataaattctgggttaatcgcatgtccaattgcgacggcctttgcactcgcaacgagctcatagtgcccagcttgcaccattgcggcaagcttttcttccgttggtgtgccctctggaaaacgcaaccctgaattggtccaaatcatgaactcgctcatcgcttcatcgaccaaattcgcctgatttgaaatctcattatgcgtcatccaatatttcaccttatcctgataacggttaaagactgtctccgcatacgtcacaaagaaatcaatcacacgccgatctgaccagcccccataagcttcaaccagatgatatggcatctcaaagtgatttaacgtcaccaccggttcaatcccaagtcgattcatttcgtcaaacaaatcatcgtagaattgtagcccctcttcatttggttgcgcatcatcaccattcggaaaaatacgcgtccaagcaatcgatgttcgaaaggccttaaagcccatttctgccatcaacgccaaatctgttttgtacgactcataaaagtagatcccgtgatgatttggataattcaatccggcaatcacgccgtcagtaatttgacgtggctggttatgtgccccagcagttaaaatatctgcaattgacacgcccttgccaccgacattccaggctccttcggcttggtgcgcagcaatggcaccaccccacaagaagtcactatctaatttaagtcccatgttatcccccgtacgccgtttttagatcaacaaagccggctgtcagaatagtgcgtatcgcctgcttcgttgtaacaactatattacagttatattttgtaaaagtttcgaataatgagaactatatgtgaaagtggcgggttctagtctgtgaataaggtgggagtatttacaaaaatcaggcttttcacttgggcaatgaaagcgttttcttctgctagcaattttaattatcattgcacgaaaaaagccgaaccgacatttctgtcgatccggcttttattaaaaacactattacttaaagaatgacaaaacttgcgttaaaccattctcaccaaaaattgtgcgaccatgttcagcaagtacttcagctgccactggcgtaacatcaccgtattcgcgagccacagccgtaatatcttggacgcctgcctgtgaaactgactcatcaaatgacaactcaacataatagtccttgttgtattcaatgacctttgagtcaccgacttcttcttgcatcatctttgcaaattggataattgcttcaaagtctttaaacttcaaaataacttgacgacgaccctgcttatcacgcgccaattcgcgtgcagcattatccatctggtcggcagcccgtgactcagctgcggcacgttgctggcgtgcttgtggctttttcttagccccgtcaccgtcattatctaacaattgctctaataagctatcagaaacatcatcgtttacatcaccagcatcacgattgccaaacattgagttgataacaccatccatcatggccttatccccaatattcttagagatgaacaactccaagccgttacggtttggcaatacttggaaggtaaccgcctcattattttcgaaatcatgctcgacatcaacttcttccaagatattgtagaagaaacgttcaatttcttcttggttgcccagcaagtcaatcactgaaatactgcgctcagcgagatcatcgttggtcaccaccactcgaattgtatcctcgttaatgcgttccatttccattatgggcacccctttccttcccagtccgcgggaatctagctttgcttactattataccaaatttccgaaataatagtcgatatattagcattaaccacgtgcgttctaggtgtgctaacccacccgttacgtttcctaccgcaccccagtataaacgaacgtgacatgatggggtaaaaaaagaccatcggaatggcccttttatgtatggtggatatgtttactttacagatcagccaaagctgttgctcgggccaactcagcttgtcgcacctcgtgtggcaagaatcgacgaatttcgtcttcattatacccaacctgcatccgcttctcatcaatcatcaagggacgcttcaataaggctggttgcttttgaatcatttcaattagttcacccaacgataagtcgtccaatgaaatatctaattcagaaaaaagttttgaccgggttgagataatttcttcggtaccatcttccgtcatgcgcaagatgttcttaatctcatctcgtgtcaatggctctttgaaaacattacgctctttatagggaattgcgtttgcttctagccatgcacgtgctttgcggcatgatgtacaactaggtgatgtatataacgtgaccatatttgccccctttcggctactacggtgttactgctacctatggctacaattatagccgtctagttgtgaacatgtaacccctatttttacgaaaaattgcgaataaattacagtgctatgacagtcacaatgtgctgtccttgaccatttattaaaaaatgattaagaaaaattcgtaccaggcctgctagcttttatagtaagttgttacgatctatgtaggcattgatatgcagattatatcgtgtcaaatgttttgcttatacaacctaggtatcaaaagattttatgaatagcctatgaaaaaagctggccgattgtcatattcggtcagcttttttattaattcacattcttgcgtggtaccgattcgtcggccattgccagcagtttctgctttaattccgtttccatctcctgcatcttcacttctgcatcggcccgcttttgacggccatcacgctgaatttgcatggtttcttcaatggtttcaatcagattagcttgggtattttgtaaggtttcaatatcaataaccccacgttcattttcctttgcagtctcaacagcactttgtttcaacatctcggaattcgcttggagcaattgattagtcgtatctgctaccgcgcgttgggccgctacagcattcttttgcttcaacaaagttaacgcaatggcaacttggttcttccataatggaatagctgttgaaatcgacgattgaatcttttcggccaatacttgattggttgattgaatcagacgaatttgcggtgcttgttgcaaggcaacttgacgcgttaacttcaaatcattgctgcgcttctctaaacgttgttcaaactgcaccaagtcctgcaccttttgggcatctaattgatcacctgacgcttgcgcaacttcccgggcagcgggtaattcgcgattacgaacatcacttaacttcatttcagcacctgcaatataaacattaagttgcttgaagaaatctaagttttgttggaacaaaccgtcaagcattttgttatcagctaacaaagtctctttatggcgatcaagtcgtgccgcaacattatcaacctgggcaccaatcttctgatatttggcagtgacttcataaattgacttctgaacccgcttaaagacgcgtgcaaagaagccttgtttctctggaatcaattcattgggattcgcttcactcaaattccccatcaattccgtcagtgcatccccaattggaccaacatcttgattttgcacccgatccaaaacgccctgtgaaaaatccgttaaattcttttgggcatcagagccataagtcaaaacagaatctgtggcagacatatcaagggtttgtgccaactgtaacgccttggctttttcgtcagacgtcaacgtatctgttaactcgggggtcgttgcttcaggtgtttttactaactcttccgtcatgtttatttcctcattgttcgttttgcagtatccaattgatcttgcaaagatgtaatatcatcacgcgtgatacggcgataatcttgctggatttgatcggccaattggcgcaacacatctcgggcagctgctaattgttgtttatcagattcatcaatcatttcatggctaataatgtcatgatacgtcatcaaaatcttttccatattaggtaaatgtgtataaacaaaatcgtctgcgtccgtcagctgcgttggatcatctgcgagttccttcaccacaccacgggcgtaccgaatcacttcggtttcggtcgcaatcttgcgtagcccattcgtttcagtcagtagctgttcaacatgcgtcacactgtcgtttgtgcgattaaacacggctttaaataccgttaaatcccgtttgttcaacccttgaccgttaatttttaatttggtctgagtcgttaatttagttggcgctttaacatggcccactagcacttggcgcgcaccaatcacggccaccgtcagcacaatttgtagtaaccagctcacccctgaaaaagaccaggtcgctgcaattaatgcgagtggcaaaatccagcgcaagaccgtttttggtgcgacaaaaattgctaccagcagtccagccgttaaggccgaactagctgctgattggacgggcgaaattgcaccgacaccaataaacagcgccagaatggtcagccacttgccacgccgtaattccttttttgatagtttttctaaatcaaacatctttattcccctcgtcggttctagattttattatacggctattaatatcgctctgtatagcatttttacatcgcacccgtgatatcacaaaaagcccttagcgacgcacatcgctaagggctactcgttgactatttaactttaacattattcgtaacggtttgatgcactgtcttgctagtaaaccgtgtcgtcacctgatagtcacccggttgatacgtgtgttgatccagcgtcatagctgccgtgacattaggcgccaattgcttaccctgtaccgctgcctgatgtaccacgtgtcccctggcatctttcacggtttgcgtcactttcacctgattgacaaactggttcgccttattattgataccaataccaatttgatgacccatcgtccgtgcttgtagattaaccttcgccactttttttacgtaacccgtgtgcagcacaactcctaagacataggcatagcgatttgctaacatttgctgttggctacgttgccgttgcgccgtcacttcttgaaagtggagaccaccagcgattacaccgttccccattgtctttggcaaccggaccttgacggtcaagtaacgggtctgaccagcagataatttcattttctgggtacctgtcgctaatttttcaaaccctagtcgcgggttaattgcctgaccaacagtgcgatcatagacaacatcaccaagcggatttgtccgcgccggttcgggaatcatgcgaaccgttttcgtcgtctgcgttaaatttttaacctgcattttcaggacaaccacttgtcccgggtgcgtcttcaaatcgtagtaatgcgccgttttatcaagttgtgctttcattggttgtggtgtcaccgcgaatggcaacccatctgccgaaaccgaaggggcgaaaagccctaatgttaggaccaagcctaacaaaattcgtcgttttttcatcttacttattcccaaccgtatctaaaacggtccacgttaaatctgccgtgtagtcaccttgttgcgcactaccacctggaatagccagcttgacggcctgatccacatcccgaccgtcagtttgacctaaatcagattggccaccaaaaaccgccaaccaagtaccgggtatgtttgcttggtttgttgtcataatcgttgcgctttgaccaaatgccaccgtttgcttgtcaacaacgttccccgtcaactttcctggcgtagtggccattttagcattttcaaacgataatgatgccccctgcaacggcttgcccgtggtcttgtttttcaacgctgacgtcgccaattggagcgtccagccacccgcttgtgcccgcaagtcagatacttgcgcgtaaacaggtgcaatcaatgtactgtgtgcatcatcagcaaacttttgtgcactcgcagcatacgttgtcgcttgccctgaaattttttgctttccaaaatccaaagtcgaggcatagtcgaccgtcaagatgcctgattgttccttccccactggcgtatccgtccctggaatcaacggatttaccggcttggcataatcgggatcaaatggattcaatggtttgttaaccaacggtgcataggtcacgataacggtatctttatcacccaacttaccagtgaccgttgcgatatctggcttatagcccacaatatccggtgaggtcacactataatcatccccgtcatatcccgactttgtgaccgagtcaaaataggtccccagctgcgtggcatattgatacttaatcgtcaccttgtttttcttttcatacgttaaatcaaagtgattcgtatcatcatcactgttggcaatcgtaaactgttgataatttttgcggttatcacccgtaaaatcgtagccagccactttaggtgcaacatacacgaaattaggatcaaatttggtcgtcttgcttgccgcatcaacatcagcatcactttgcaccaccgtaaccgtatttcccaccaccgctggcttctgggctggattaaagactggcgctttaaaatcgctcgcatcaaccgtcgttttggcggcgacaccgttaaaggttgcttggacggttccatacttcacgctaaacgtcttcatattgacggacatggttgaggtttcattacccgttgaaccaaagacagagaaccccatgttgcgggccaccgtcactgtttgtgtccaagtcttgccgtatccagttatcgtgatattaccaaccacttgacaaccgtcacttgaaactgacacgggtgcccaagcaaagccgacatcatcaccaccacgacttagactgacgttttgcgcttgatcgttgctaccgatggtttgtagtttacccgcactgtcagtgtgtcggaatgacgcatattgcttcgaattaacacctagcgacgttccgatgttcgaatcacccatatccgagttgtagtaaaaatcaattccccagaatatcgcatttgagaatccggttgtcccgttcttaccaattcctaagtacttattaggcgtaccatttcccatttgcgatgggtcatacggtgctaaaatcatccccaacgcatcaccggcttgaccaaaaatactattaccaccagaactcgttttaaaaccgcctttgaaattaaacgatgatgtcatatcaatctgatacttaaaactcgctgacccatattgattagaacccccgttggtcagttgcgcccaaccattcgtaaagccagaactcgtcccacctggcaagaaagcgttcgtcatttcatcgacaccagcgtaattggcagccggctcaccaattttagttgccgtttgtaaatcttggacggtgacagttgccgccaacgctggtgccgcataacttgtcagcgagaccgccagcgttgccaacatgattttgattagtccctttctcattagttttgctcactttcttcctcatcatcacgacggcgcttccatagaatgaaccagaacactgtaatcaagactgctagtagtacagctaacaaactccaccaattaaaggcatcctttgtaaccgtaaagtccgctttgttgtattgcgttgcctctgatcccgtaatcgtgaatgtcttttcaaaatgccagcggtgggcaaactttgtcgtcttagcggcatccgtaaattgatagccaccttgatcatctttttgaccatatgctgttaaatctaggacatacttgcctggcttcatcgcagcgccgttagcatacgcgattgccaggtcaaaatttgaatttggcgccatttgctgatccgtattcgtttgtgataacaccgtcttatcactgtcagcctttttaatgatcgcgaccgttgtaaagtcgttaatatactttgccaatggattttgcaaattagccttaatcacattacgggcgttcacttgaccagcagccactgtatgcaactgcaaaccagaccgttgaatttgattaaatgtaaacggtgtgtctttttgttgtcgcatcagaacggcgatttggaaggcatagacatttttcactgccatgccggcacttgctgcctgggcatgttgttgtgaatccttgtcgcggaaagtgaaagcgcccgacgaaatacctgttagcccggcttgcggtactgtgacatgcgctgttacctccttggtttcacgtgccgctagcgtcacatcttgtggtaccgtaatcatgtcctgggtcttggctgttagcgttgggtctagtttcttttgatccccctcataatcaacttcaccaccaccattcgttgttgccgttgtcacatcagcattcactgtgacggcgtgatccgtattatttgtatacttaagttttaaatcctgggtcgcacctggattaaccatcaaatcaaaatagcccgccttttttgcaagctggttctctggtaattccggtaccactgaaaaggtgtagacgcttgcctctgtcgtctgactaccaccaacaagtagaccaagtgttgccaacactgttaggcctaaaattttaccaattttcattttctctgtttcccctcttgatatgtaaaatcccacaaacgtcatcgtttgtgggactaatgtctttttcgccaaaacgacgattcaaatatgtgattttactagtcaacgctaccggctggacgttctgccaacgtccattccaatgttgacgtgtatgctgcggcacgctttgtcgtcgcacctggcaccgccaatgagattgatgaatctgctgacttatcatccccaaatcggtcaacccacgttccttgaccttggttagctgctgcatcaacaattgactttgatacaccaggtgtcaacgtgaactttggtgacaacttacctggtgttcccgccgttgtgctcgagttggcaaccaagttagcattgttaaatgtcatcgtcgccccagtcaaatcattcttgccgtcgttaaactgtcccaattgcttaactgacaaattccagccggcatcagttccacggttatctgttacttgaacatagttagaacccgtgtgtccatctgcaaacttttgtgcagcagctgtataagtttgatcagttgatgcgatcttttgtgtcccaaaatctaggcttgaggcaaaatcgattgaaagtggtccagccgtaccaggatttggatccgttccatcaggattctcaggctttgaaggcgctgggttatctggattgtcagggtcgattggtgccgttggatccgtagttgcttcaaatgttacctttgcgttacttgagtatacggctgagtcagcaaatgctgaaggtgccaatacactcaatgccaatgtagccgtcaaaagtgttgttactgtcttctttgtcattcttctttccccattcttcgtgacaagtactgtgttgaaaacgtcctcctgttttcgacacctttatcataaccggtggggtctaattacaaaatgtaataatttttctcaaaaaagaaaaagcgtgcaaatgcacgctatgactgactattcagcaattccaagttgcttgaaccgggtcgcaaacttctgtgctttcagttcagaaagtcgcgtccgcaattgttcaagttctttgacatttggtaaatgttgccaatcaaatcgataacgactatccacatcggtcaacatggcatctgaaatcaccaagtcaacgtcgtcttcgaagcgattggtaaacacaatattaaactccgccattcccgcaatcatccgcttcaaaatgacttctaatgccgggcgataggtaatatcgatatcgactttaatcggcggaaaaatgacggcaggctcaaaatgagccacaaacgctgtaaagagataactaaaaaataactcttctgcgtcacgaaccggttgtttaacaagcggcgctatctcacgactcacattgagtgccatctcaaccaagactggatacatccggtaggcctcacgtaaatcaaaccggcggcgatgaccactatcacgggcatacaattcgaacgtcaggaccggtgcaaataaatcacgtttgattttttctgcacttgctgccgacattgacgcattaaaatattgttcatggtactgcccaatcacaccaacaatggcggttagtcgttgttgtaacgtcggtgtcaaattgccgaaccaatcagtttctccaacaatatttaacgcatacaaataaaatagggtttcacgggcctcgtcgatagcctgagcctcattaatcgtatcgtgcgttaatgaatcagcaaccatcttttgaatcaacgcctgcgttaacgcatccatttgatcatttgggcgtaagacattatccaaattgtgtggatcgacgaaatgccccgtacgcacacgtaatgccgcaatcgtatagtaaaagcgcaatgcaattcgctttgaatcacgaatatatgacttcggcataatcgcagccgctaaccgatcaatcccagcatctgcttggattttcaggtcctcaccatacggaaactcacgatctccaaaaaagcgtagcgcgagtcgataaaaaaagacccggatggccgattcgtcgcccgtaaagcggtactcatcatcaatcccaataccaagtggcgccagatgtttcaccacatagcgcttaatattgcgggttgtgctgaccgttgtcaaaaaacgttccgcaaaatcttcgtatgacgtaattgtttcaaaaaacacttctttaataaacgtccaataaagtgattcacgtaaataaaccaacatcacagcgtccgtattaacgtgacgcgacatcggcatgtgcaacattttatcgtcctgttgtactgacaacaacggttcttcttcatcatcgtaaattgtcattaaatcttcagctaactggtgtgcaactgtgatggttaaatactttgaccaccccagcgcttcgcccaccgttttaactgaaatatcggctgtcagttgctctctcaaaaacgctaacagctcgattttttcattctctttcttctccagcatccactgcattacttggcatcctcccttaaaatgcctcataccacaccttttattatatggggttaagtaattatccgcgtgcttattttttaccatttttgcgatttagaaaaaaacagtcgttgatgcattgttgtagcaaatttgtagtaaatggattggtatttgtagtaaatttacggtaaatcacggtaaaaacagcctaaacaaaaacaaagaaaaaccccgtcatatcagcgcttaagccggtaaaacggggtttttaaatattaataagaatgccgctgacaggagtcgaacctgcacgggattgctcccacaccgacctgaacggtgcgcgtctgcctgttccgccacaacggcatatcaataacagtaataactataccagattattagccattattgaatacttttattaaaagacctgctttgagaaggctgcaaaactatattgtttgcgcatcaaaccgtatagtgaattactgctctcgtattggcgtagcgggaaatcttcctttgcttgccaattttcccaatcagtcttcatgttccacgtcgacaacatcacaatttgatgtgaattatcgtttcgttgcaacaaataagaactaataaagcccggctctgtcatgccttcttcatacgcttggtaacgtcgaataaaattatcacgctccatatcatttaacgtgataaacgtgaaattcatccaaccacgcaagtcgctggtatcaccacgttcagccagaatttcatacgtggttggcatcgcaaaaattgacttcttattagtggtcttttcaagcaactggtagcgttccttgtcttcttcatctactgttagcagtaatttgtgatcaaggtgttggttgcggacgtcttgtaaaacagttcgagacccaaacgttacatgtaaatactctgtcatatttttatcctccatgatcgttcccctagtatagttactattatagtcacttatcatgaagaatgcgctgacaaactattgttttttagtggatttcaggtccattttgatttgcatcgtatgccgcaatatcaacggacgttgcatccttaattgccacactctcaaccaagcgtccttgttccactgaatccaatgccaaaccaccgaagttattcttcttgcgtaattgcatcttatcagcaagcaacgacttagacgttgccttgatataccaggtacctgcattcgtctcaaccggcatgtcaaaccatcgttgatatggggcatcgttgttaacaatattaattgtgaaactcgtttccattgtaatgtccaacggatcattgtaaggactgataccatcttcagctgctagtaaaaccacttgtgtcttgggatcaaaattattcatcaaacgattcatcgcataatcatctagttcaatatacatcacatttacctcgactttctattgtcatcatagaatatttatcagcttaactgtgaaaaaaagggccggccaacaatggccagcccaatttcattagttgttaccttcagcttgttgacgggcaatgtagccacgtgaagttgtttgtgcgaaaggtccatttaccatttgcatacgcatacgcaagttttgttgcacgttttggttaatcgtttgtgcgaccaatggtgtgacatcagcaggcacttctgagtctaccttcgtacggatttgacgaatcaattggtagaagtccttacccttacgcatcaccaattcattttcagcagcttcgaaagcgaagtgtgcgtcatccgtgttcttgttgtacacaaagtccatgaattgtgatgtcacagcgtcgttctcgtagttatcttcttcaccttgccaaaggcttgccgtctccgtcaagtatgcttcaacgtcagctggatcgatgtaaacttccttcaaattaaccatgaatgccatgtgcaaaatcctctttcgtccgtttttatattaaatctacttactctttacaagtattagtttatctaattgtaccgcttcttgcactgagaaagggagtgccaaagacaccttttgtgttgcattttcgaaacaccaggtatatgcaaaaaacggcatcgaaatgccgttttaccttaatgatgcaaagccatactaattaagctaatggccgcaacactattatttagcatatgtgtcagcatcgaatactgaatctgcttggtcttcttgtacacaaccgccaacgcaacccccataagtgaatactggatcattggtaaaaattggaattgttgaaagacgtgaaagtacccaaaaaggacaccagaaagcaccacattcagccaccacggtccatctttaaaaaaataatttaagacgacaccacggaaaataagttcctcgaccaacggtgctacgacaacagccaacagaatgacaaatagcagcgaggcaccaccagccttagccattgattctaacgcggcctgattcgtcgccgtcacccgaccacctgtaaatacatattgcagcaggcctgacacagccccagcgcctaaaatcatcaggtaacccttaccgacccaaccaattttttcacttctaaatggatgaaaacccgttttaggcgctttttttcgcaccgcaaacagcatcactaacaccgtaattgtcgtaaatacagccacaaagaacagcatcaacaggattggtaagatactatttttggacacgtggagcatacttgcagcaccacggttagcaaacatgcccgacacttgaatggcaaaatccaggatgataccgaccacaatccaaatcaaaccgttaccgatattgcgaagtgtttcctttttcatgctaatcgtcatcctcctttttcgggcgcaaggccattgttaaaagtgtcatcaacaccgtcactgccacaaaggccaaaatgaaaacgatgattgacagccaaagtggccacataaacgttttcgctacgtacgctaacccgatgaacagcaccatgacaacggcactggcaccaacctgaatcgctaatcccatttttacttaaagtccttcagtacgtatttttcaagaatttctgcaattgcaccttcgttatttgtacgctcagtaacaaccgcagcggcctcttgcaccgccggaataccattggcaacactaacccccaagccaaccgctgtcaacattttgaggtcattattattatccccagctgcgataatctcatcacgctgaatacccagtttttcaccaagcaacaacgaagctgaccccttatcaacacccttcgtattaaattcaacatatcgtgaagatgaaaacgttgcttcaacagcatccgcaccaaccgtagctaagacagcatcccgaatctgttcacgcaccgcttgatcaggatgttcaaagataactttcataacgggctgttcgttcgccaagaaagccaaatcatcgcttgtcatcaattcgtaaggcaccccacgttcagccatatattgtttatcagttggtgaaatattgtaaataaacaatgtgtcaaccgtataaatatgaacgtcgacctggtcattaaccaaacctgcccggaaaatttgtgcagctaattcgcggtccatgccccgtgtcaaaagcacttgattgtccttattttcaacaatcgctgccccattatatgaaattacgtactggcccgcttggtcatacaaccccaacgtcttcagcaacgcttgtaccgagttaaaggaacgaccggtgtttggcacgaacttaaaaccatgagccacagccgtcttgattgccgccaaattgtccgcgtgtaccgtaccgtcatcatttaatagcgtttcatctaaatcagaaaccaacattttgtaaaccattttaaagaccccctattattccaatagtcattgtatcaaagaacgactgcaattcggtcgttttattagaaatatgtctttttctcaaaattttgtttatgtggttaaacgttattacttgctgtcccaaatacggtacaggtataattagcttaccaaaggaacataggagagtatattatgcgtagttttatgaacgaattccgtgactttattatgcgcggaaatgtgatggatttggcagttgcctttattatgggagctgctttccaaactgttgttaagtcagttgttgatgatttgattatgccacttgttggtatcgtgactggatcaatttcattttctgctatcgtttggcacatcgggtcagccgacatcaagattggggcctttatctcaactttgattacgttcttgttgacaagttttgcagtcttcctcatcttgaagggtgttcgtaaggcacaagctttgacaagcaaggaagttgaagaagaagaggaaacggttcttgaaactgaattgggcgttttgcaagaaatccgtgatgctttggcaacaaagaaggactaattccgaacgttgaatttcgtcacacaatagacacatacatttaactttaaaacaaacgcctgtctaccgcggttttagccggtatggcagacgttttttatttgtcaagccgttgatataatttcaaaatttggctaagatagttaacagcaaatcaaacacaattgcgtggtttgataatataaagatacaaaattctgaaggaagaaggactaccatggtgattatcacggcaggtatgattggtgttggtaagacgacattgactgatttgattgcaaagcatttggggacgcaagcattctttgaacccgttggggaaaacccagtgttaccactttactacgctgatccaaagcaatatggattcctattgcaaatttacttcttgaacaagcgctttgcgatgattaagaaggccttgaccgacgacaacaatgtccttgatcgttcaatttacgaagatgccctcttcacacaagaaaaccaccgcgaaggaaatatctctgatgctgagttggatgtctatatgaccttgttaaacaacatgatgtctgaaatccaaactatgcaaaagggacgtcctgatttgatggtattcgccgacgctgactttgatacgattttgtaccgtattaagaagcgtggtcgtgattatgaacaatttgaagataacgacgagcttcgtagttactacttcaagatgtggagcgcttaccaaaagtggtacgaagagtacgatgcttcacctaagattaaaattgacttgcaacaatatgacttggaagaagctgacaaccgccaagctgtcttagacatcattgacgcacgtcttgctgaacttgacgcaactgttaagtaatcgctaaaaacgcacccacgtggctgataacagccatgtgggtgcgtttttagttagatgttgtatgagccgatgaagttcggcataaagttgacttcatcaaccgtttcaatttggacgttcttacctggtgcgggcgctgccacatattgaccgcccccaatgtaaatcgcaacgtgccatgaagccccatgaccaccccagaataataaatcacccggttgtgcaactgccattacgtcagccttggttcgaacatcagttgttgccacgtaagattcttccgaaactgtgtaagaaggcaatgataagccagcatcttggtatacccaggcagctaagccagagcaatcaaaaccggctggtgttttaccaccccaaacgtaaggaataccctgcccggcgtacttcaaggcggctgtcacaatcgtttggcgctgggtagccgttaaactaccgctaactacgtctggattaactggcaacacggcagttggcgttgtacttggcaccgtgttatccaccgtcgtgtcagccggtgtcgttggtgcaactgaactagcggctgcagatgatcccgctgcagacgatgacgctgcaactgaagttgacgtcgccgtgtctgtcgcgctcgaaaccacaatcgttggcgctgacgatggcattgacggtgtctccacgacaatatcctcacccatggcatctgcaacttccgcagctaaggccgtctgataatcgtcagctgtcacttctgatacagatgttgcggcatctgaagcaatcgtaaccggcgatgtcacttcagacaccggcgccgtgtcgcgtgggacgaaaataatttgaccgacttgcaacatcgttaaatcaacgtctggattaagcgcgataattgtctcgaccggtacaccgattgttgttgcaatgttccctaatgtatcaccgtcttgaactgtatagcgtgttgcatcagccggactggcagttgccctggttgcttctgaaaccacagcctgctcggccggcgtggctggtgcacttgataccatggtgctagtttcagaggcacttggtgccgtgtaaacatatgatgcagtcaccggcgccgttgactgcaaaacgtcatctgccacagacaatgacgttggcgtatctacctcgctagttgctgcaatctctgcatgactgttggtttcaagtactggtgccaatgatggttcaaccggaagttcatctgccacagcttcaaattgtggcgtagttgacgttgactgtgccctaacaatatctgacttcttcgtaacgcctcggtgcgccgactttaatttttcagcatcattggctgtcgacacccgcttaacgtgcttggtgtcctgcgtcatattagctagttgatcaacggctgcttgaaccatcggtacttgtgtcgtcgcaaccacacctaaggcgcccgcgacccctgcgataattgcttttgttggtgtttgtcccatacaaacaactcctcccgtgaaaaatgactttatttacttactaaaaataaaataattaagaaactcttaaataatttttgtacgtatctatcataccgtatttcaagcgccatttttacgaacaaacgttctattcgggaactcttcacattttcaccaaccagccttatcaggatgcaatttatattggttagttgactctacagtacgtaacatctgtcacacccagttgcgctcattgctacaataaaaaagcgtctacccaagcaaacctgtcacaggatcacttacatggagacgcttagcaatataccaactacatattagttaacatatttttggttattaacaatttacaaaaaaatcactttttaaagactaattcgttactgcaaagggaacatacgtgcggcttttaccgcacgatgccacccttggtaagctgatttcatttccgtttgacgatcagccattggttgcttgatatcagatgccgtaacatctggcaattgtgccaaattctcccagaagccaaccccaagtccagccaaataagcagcaccaagggccgttgtttcaagttgttctggacgtcgcaccggcacgttaattaaatctgcttggaattgatgcaaataatcattagctgcagcgccaccatcaatcaccaaattagcaaccttcaagttcgtgtcttgctccatggcttctaacacatcacgcgtttgataagctaaggactcgagtgtggcgcggacaacatcccccttgcttgtggcacgtgtcaaaccaaacatggccccacgtgtattttggtcccagtaaggcgcaccaaggcccgtgaaggccggcactaagaaaattggttctggatgttgctcacgtgctaacgtcgctaagtcagccgtttccttggcgctgttaatcaattctaggccatcacgtaaccactgaatcgccgccccggcaataaagacagacccttctaatgcataggtaacttctccattcaagctgtagccaatggttgtcaacaaaccatgctgcgacgttgaaatgtccgtgccagtgttcatcacaataaatgaacccgtcccaaaggtattcttcacatcccctggtgtaaacgccttatgaccaaagagcgctgcttgttggtcaccggcaataccagcgattggcacttgaataccgaaaaaggcataatcagccgtatacccaaacaatcccgaagagtctttcacatctggcaacatgcttgctggaatattaaacttctctaacaactccgtatcccatgatagggtgtggatgttaaacagcatcgtgcgtgaggcatttgaatagtccgttgcatgcacagccccattcgtcagcttatacaatagccaagaatcgattgtcccaaacaacaaatcgcctgcttcagctcggtcgcgagcacccggcacattgtcgagcaaccacataattttcgtggctgagaaataggcgtcaatccacaagcctgtcttctcataaacaaaatcagttaatccggctgcttttaacgattcagcaatcgcatcactttgctttgattgccacacaacggctggtgcaattggttcacccgtaaatcgatcccaaataaccgttgtttcacgttggtttgttagaccgataccggcaactttataaggtggcacattggcctgaatcaccacttcagccatcacttgacgcgcatggtcccaaataatctccgcatcgtgttcaacccagcctggttgcttaaaaatttgtggcaactctttttgtgctgttgccacggccttaccatctgcgtcaaacaaaatcgcgcgagtacttgtcgtcccttgatccaacgccataatatattgatcagccatacatagctcctaattatcgttttatatctaacatattcccaacaatatgcgaaaaaagaggagtggtatttaaataccactcctcttattgtacgcaattacttttcagaacgcaaagtaccaccgtccataaaacggtctgcacgcatttcgttcacaatcaccttgatcgcctcacgtggggcaccagtgttcttttcaactgctgccgtaatatcagccatcattccctttagttgctcatctgagcgaccttcaaccagttctacgtgtacaaaaggcattaatctttcctcgtctcttctttattacttatttaatagcttatcagcctcggcatccaaattcaatgcatccgtaatttgtgcctgtgcggctaaccgttcacgcctgatttggctttgcaaatcttcgttccagaaattgttcgatacgttaaccgtgttaacaatattaataaaggcgtctgggtctactgacttcgtcaaacgttccatttcagtcaactcataccgtgacaataccatcatcagcgttgagtttggctcacgcgtgtaggcaccaacagatggcagaatcgtaataccgcgaatcaaatcttcttgcaaggccttggtcacttcgtcggctcgacgggtgacgataaaggccgtcagcttttggtgacgggtgtgaatcgaatcaacagccactgacgtcgcgtagataccaatgattgtgtacatggcattttgccaaccaatgaatgaacccgcaataaccacgacaaacccattaataaagagattgataaatccaatcgactttccggttgtcttctgtacaatcatggcaacaatatccataccaccagttgagaagcccaacttaaaagtgataccaattgccacacccaatagcaatccaccaaacaagccagccagaattggctcatgtgccactaacgtctgtttcggtaagacaatctgcataaacgacgcgaagaaattattcaaaaatgataggatcgtaaattcgcgtcctgcataaatccatccggcaattgcaagcggaatattaaccgccatgataatcgcaccaacttcaacatgaatgccgaaaactgctttaaagaataaactaagcagttgtgcaactccattaaatccaccagagaagatgttatttggaatgaagaaattattcattgaaatcgccaccaatactgatgccgttacaaatacaatggccttcaaaccatactcacgtacacgtgctaatgtcacaagtgccgcctccttttatgtcttttcaaagcggccgttggatacccaaatttccactttatttcgtccctatattatcacacacattttacacttacaccacagcaaatgtcaggttttctcactagttacgcgcaacaagaaagcaacccctaatcaaccaaaaaactcccctctatccagtcataaaaccaaacagaggggagcttattatttaatcatttaatgacgctaagtagcgaatactcttttcctcatcaaagtccttttcagactttgaaataacgattgatgcagctgaattaccaacaacgttaacaaccgttcggcccatatcaaccaatcggtcaataccagcaatgaatgccaagccttgcaccggcacgccaatcgttgacaccgtggccagcaagacaacgaatgaggcacctggtacaccagccattccctttgaggtaatcatcaagacaaccagcaaagtcaactgatgttcaatcgtcaagtgaatgccataagcctgtgccatgaataatgcacccagcgcttgataaatagccgatccatctaggttaaacgtgtaccccgttggcacaacgaatgatacaacaccctggctaaccccgaacttttccatctttgacacaatacgtggcaacgttgcttctgatgaggccgttgtaaaagccaagataatctcttcttttaataccttaatcaaggtaaagacgttgacaccaaagatgtgcaacaccgcacccaaaacaaccaaaataaagaaaatcatcgttgcataggcaataaagataaagaagcctaatgatccaagtgagctaacccccatctgagctaccgtcgccccaatcaatgcaccgacaccaattggtgcaacttgcatgacccagtttgtgactttaaacatcacttcagcaaccgcatccaagaagtcgataatgatttgtccctttggtccaatggcagccgttcctagtccaaagaaaacagagaagaaaataacctgcaacatcttatcattggccaacgatccgaagaagttcgttggaataatgtccataactgtcgaccagacaccatggtcacccgccgctttggccgtcgacaagtacgaactgatgttagatgcttgcaaattatgaatatccacatgcgcccccggttggaacacatttccggcaatcataccaattaaaatcgccaccgttgataacaattcaaagtagataattgttttaccaccgatgcggcctaatttatgcatgtcacccatcttcgcaattccggcggtcaaacttgtcaaaacaattggtaacacaaccatttgaattagaccgatgaacatcgtcccgatattttgcatcgcggtaatcgccgtcttattttgatagaagataacacccaaaataataccaacgacaaggccaaacaagatgcgccaaccgagaccaacactatgcttttctttcttggtctttttttcaaccatgaatactctacctatccctaacttttaaaaataacacttgttctagtttacactatttcataataaaaaaaagacttatttatgagtcgaacgctcataaattaatcattatctaatgaaacgttttacccaaataacagaaaaaggctgattccaaatggaatcagccttttcgaagcttaatgacgaaatgtcattaggcacggcgtgcttcgcggatacgagcagccttaccgtgcaatgcacgcaagtagtacaacttagcgcgacgtacacgaccgtgacgagtcacttcaatcttatcaacacgtggtgagtgcaatgggaaagtacgctcaacaccaacaccgttagaaatcttacgaacagtgtaagtagcttggataccagtacccttacgcttgataacaacaccttcaaacaattgcacacgctcacgtgaaccttcaacgattcgagcgtatacacgaactgaatcaccggcacggaactcaggaatgtccgtacgcaattgatcagcaaccaacttttctagcaaagcgttttgacgcatatcaaatctcctagtcgataatcgatacaccacccggccagcggattatcgggtttatttttggtgaataaaacaccagaaataataatatcatctctggtgtttataaacaagtctttatatttcgtttgcttcttccgctttgatttcctttaataactgacgctcttctttagtgaagtcataatcagttagcaaatcaggccggcgcaagtatgtccgccgcaacgcttccttgcgcttccatgtcgcaatgttggcgtggtgtcctgacatcaaaacatctggcaccttcatcccccggaaatcagccggccgcgtatactgtgggtactccaataagcccgttgaaaacgaatcatcaacggctgacatttggtcacccaaagcctcatcaagcaagcgcaccgtcgcatcaatcacgaccatcgcccccagttcaccaccagtaagcacaaagtcacccaacgaaatttcatcagtcacaagattacgaattcgttcatcatagccttcatagtgcccagcaataaaagtcaagtgctcttcttgggctaattcttcagccatcgcttgattgaaggttttaccagccggatccattagaatcacacgcccacgtgaaccagcttccgcctcaatcgcatccattgcatcaaagattggctgtggcatcagcaacatgccttggccaccaccgtaaatttcatcatcaaccttgttgtgcttattgtcagtataatcgcgaaagtcagttacctgaaagtcaactaggccccgttcaatcgttttaccaataattgattcacgcatcggcgtaaacatatttgggaatagacttaatacatcaatacgcatggttaaatttcctctaacatatcaaccttggctaccccagcatccaagtcgatttccgtgacaacattttcaatatatggaatgaacaaatcatcctggcccttagccctaaccacccacacatcattggcaggcaattccataatttcagcaaccttgcccaaaacttgaccagttgcattatcaatgacatctaagcccacaatttcatggtagtaaaattcatcttctgctaaatcttgtagtgcctcttcaggcaccatcaaatcgtgcgtcttgtattgctcaaccaaattgatattttgcaaatccttaaatgacaacaacacaaattgcttgtgattacgcaccgttgcaatctcaacttcaacaggtgacttgccatcaataatcaacttatttccctttgcaaaacgctcttctggaaagtcagtcgtggcgatgacacggacttcaccacgaatgccgtgggtgttcacaattgtgcctactttatacaaagccatattttttgtatcctcttaagtttattcagtttcacgcgtatcgtgaaaaatttcagttaatttgctaacttctagtataccgtaaatattgtcccaactaaacaagaattatctgagtaactttgatacacttaaggcatcaagattgggggataaaaacatgagtattactgtctatatggttcgacacgggcaaacctatttaaacaaatatcgacgcatgcaaggctggacaaatgcaccgctaaccgaaaaaggaatcgcggatggccaggcagccggcgaacggttacgctatgtgcattttgatggggcctattcgtctgatttagcgcgggccgctgagacagcgcggtttgttttagacgcgaacctcacctcagacagccaagacttggtcgagttacccgacttccgagaacaatttttcggttcgttcgatggtctgacaggggttgaagctggtgaagccctcgccggcgtacttggcttacctgccgatacaacctatggcgatttaatcggatcacttgacggtgatcaactgatggatgcctttcgtcaagctgacccagccggggatgctgaagatagccagatgttctggtcgcgcctaaataacgggttagacaccttgctaacaaagcatcaagatggtgatcgcgtgctactagtcgtccatgggatcttactgattaatttggttaatcgctttgccggggctgcttacaaggggattgaaccagaaaacggttccattacgacttggcaacttgatgaaaacggtttgcagctggaaaccttcaacgatacaaccactgaatggtaacaaaaaagaagcaccgcggtgcttctttttttatgcctaaacatcatcgtcgtcatgatgtttgggctgcgcttggtctgctttgtatgactgatacgctttatagctcaaataacctacgataatgatcgcaagtgctaatagaattcggaagataaagaaacccatgcttagttccccttcgcatcaaccatcgcatcattcgtttgcaccgttacccagccgtgcttcaaacgtgcttgcgcttccatgtaggcaatcgtttggtcattaattgacgcgttaattttattatttgcttccgcttcagcattcgctgctgtaatcttggcatcggcgtcagccttagcctgcgtttccttcgtcttagcttccagttcggccttcttattatcttgaccagccttaataatgtcatcaattgacttttgggtttgttcatcaattgacggcgtcccaaatgacaaatcttcgacaacaaagccgtatggttcagcggcttgttggaaactcttcaaaataccagcttgcgccttagttgaatctgttccaaccacttcgagcaacgtaaactttgccattgattcacgtgaggccttttgcaatttttgcgctagccagccggtttcaatggcatggatatctgcagaaccgaacttcttatagattgccaccgctttcgatggatcaacgtggtatgaataactaattttgacgtccgttttcttaccatccgatgttgccactgcaactcgttgcttaatcgattgtgtcttaatcggatactgcgtgacatagtctagtcccacgaagtgaatcccttgtgacaatgccttatcacggacaccgccagaaatcgcataccgaatcccgacatttccattttccacgcggtcaaaaaacttgaacccacccaagatggctaaaatgacaacaacaacccctaatccaataaacttaacctgtttacccatgcaacccccgtattatttatgataaaagaaatttttagttacaagaaatagtttatcgtacttttgcagtcctgaacagaggaaaaaataagtcgttacaaccaacttggctataacgacttcatcttgttactttttaaattcacggcgcgcttgcacccgcgcgacaattatcgaggctgcaatcgccaccaccaataaactcacaatcacaattaacgaagccatgtttgagatttcgaatgaccacccaaacatattaccaccttcattaatcaacatcttcgcgccgataaatgccagcacaattgccaacgcatacttaatgtaacggaacatcggcaataatttcgataaggcaaagtatagcgaacgtagccccatgatggcgaaaatgttcgacgtcacgacgataaacgtatccgtcgtcactgctaagaccgctggaattgaatcaacagcaaacaataaatctgaggcttcgataaaaatcaaagcgattaaaaattgcgttgcataccgtttgccattttccttcacgataaaatgaggctcggtaacgtcatccttaatcggcaaaactttgcgtaaccacttaataattgggctgtcatccaaattttgattggcctctttttcaaacagcattttcagccccgtgtaaaccaagaaaacaccgaaaatatacattaaccactcaaaacgatgcagcaaggccgccccacctaaaataaagagcacacgcatcaccaaggcaccaaagacaccccagaacaaaatccggtgttggtactttgatgcgatgccaaaaaagctaaagaccaagatgaagataaacaaattatctacacttagtgattcttccaatagatatcccgttacgaaatctatcgcatgattagcccctgcaaatagccaaataccaacggcaaagacaaaggccaatcctacccagataccagtcattaataacgactttttgaatgatggtgtcacattttctttattaaagacacccaaatccagcgccagcatgaccaccacaaaggcaaaaaatgcgacccagatccataaactaacttccatgaatgtttagcttctttctattaaggttaatagacataacccgtctactttcaatatgcaatgatagtcatctcagtcacaaaatgcaaacactaaccctagttcgtaacgcgactataaccatttcaccgcagaaaaaagagccaacccggataggttggctcttttaagaaattcaaaactgaatacccaaattactttgagaacttatataggtagaaaacattcaataatcattcacaaaaagctcaatataaggctttttaaaacaccatttaaatgattattgcgtgcttattatcggctggtgaccaatgagtgaccacagtgaccaataaaaaagcccgcctagattaagtgcaacacacctagtccagacgggcttatttctacttatctaattgttcaactaacttgttcaagctctttggtgttgcattcttaacgtagtaagtaccatcagttccgaagtcccacttgtaacccttccacgtaccttgaccttgcaccagcttgccatcgccgtctgaccagtaatacattccccatgaattcgtccagttagacttgatcaatttaccgttagcaaatgaccagtaagaacccatatgcttcttgataccgttgaccttatgcttgaatgatttgtcggcataccaaatgcccttcttagaccaaacggtagcgccatcaccagggttcttcttaatcaccgcttggtcagcagtgaagaagttgtcgtacaactggttaacgtcgaagcgacctagtgacattgggaaataaccatttgaaccccattgccaagcatgttccgtggagtagtagttttgagttgaagttggtgtgtaaggatatgaagcaatccatgacttttcaccgtatggcgttacttcaagatgcgaacccatagtgtaagcggtggtacggaacccacccttaatttgaacctcattttcaaacgcagttacaacagcttgcatatttgcacccattgccacttgtgatggttcttcaacgtcagccaccaaaacagcccctactggtaatccgtcagattgtgccatgtcgttgtctcatttgacaacttattcatcttatcagttcatcaactcgttgtcaacaacttgtttcaaactgatttcgattcgattgcaacgagatgaataccccgtaacaacttgatctatattacagaagcgaacatcaattgtcaacaactaatttcgacttcttttgttccatttttcgagcgaaagtcgctcactgaaaaactcaacttgaatataatacgactatcatccaaactttgcaatactttttgtaaacaaaaaacgcggatgattactcatccgcgttttcagtcgttattaacgcattgttgggaacaacaatacgtcacgaatcgtgtccgtgtcagtcaatagcatgaccaaacgatcgattccaattcccaatccgcctgtaggtggcataccgtattccaaagcctcaataaagtcttcgtcaataccttccgcctcatcattaccagcatcacgctcagccacttgggcctcaaaacgctcacgttgatcaattggatcattcaattctgtaaaggcattaccgtactctgcaccaacaatgaacaactcaaagcgatccgtaaagcgatcgtctgtttcgttcttcttagccaaaggtgacacttcaaccgggtgaccgtacacaaatgttggttggatcaacgtatcctcaacaaactcctcaaagaattcgttgatgatgtgaccaacgccccagtattgttcatacttaacgcccttttcgtcagcaattgcacgagcttcttcgatcgtcattggttgccagaaatcaacacctgtcgtttccttgatcaaatcaaccatgtgcttacgagcgaatggttgtgccaaatcaatatcgtgtccttggtaggttaccttcaagtcatcagtaaccgcagctgctgctgccttaatgatgttttcagtttcaaccatgacatcttcaaagttccagtaagctgcatacgtctcaattactgtgaactctgggttgtgcttagggtccattccttcattacggaagacacgaccaatttcataaacacgttccatgccaccaacaatcaaacgcttcaagtgcaattcaagcgcgatacgcatgtacaaatcaatatccaacgcattgtggtgcgtgataaatggacgtgcagaagcaccacccgcttcgttttgtagcattggtgtttcaacttcaataaagccttcaccgtccaaataatgacggatagccgtgataatctttgaacgctttacaaaacgttcaaatgaatcttcgtttgaaatcaaatccaaataacgttgacggtacttagtttccacgtcagtcaaaccgtggaacttgtctggcaaaggacgcaatgccttcgtcaagtgtgtcaaagccgttacgttaattgacaattcaccagcgcgggtcttcataaccgttccagtgaaaccaagaatgtcacctaagtctgacttcttaagcaattcgtacgcttcttcaccaacaactggcttttgcacaaagacttggatacgacctgaacgatccttgatgtctgcaaagctgatcttacctgagcgacgcttggtcatcatacgacctgcgatcgttacttcaattgcttgtgcttccaaatcttctgctgttgtatcatcgtacaactcgtgcaattgtgctgcagtgtgtgtacgctcaaaacggtgtccgaatggatcaatgcccgcatcgcgcaactcagccatcttgtcacgacgtgcgatcatttggtcattcaatgacacttgttggtcagccataatgttgcctctttttctttcactaatttgttatgacagtgttgtcacagataactataagtttgccaatcttaagcactttttgcaagtgcttaacccaactttatagtccctcagcatccttcgctgcaataattcctgataattctgcttcatcaaactgaatcttcttaccagtaaatcgatcgacaatctcaacaccgtgatcttcggcaagcatttcttgcaaatcattcattggtaaggttgccaacatacgctcataatcgcgcttcgagatttcaggatacaatgccacttctgtcgttgccaacaacttcacatcatccttaccaaataggttgaacaacaaatccattggtgtgtgtccctcaaccaattgtgatgaaattgatggcaagttagcaagcttgtcttccagtgccgtaatatcttcatctgacgcatcaggcaatgctgaaatcataaaaccacccgcggcagccacggtaccatctgggtcaaccaaaactgacactgctacggctgaaggaatttgttctgacttggccatgtagtacgtcaagtcatcgccaatttcccccgtcatcaattcaacttgacccgtaaagggatcaccttcaccaatttccttagtaacttgcaagaatccattagatcccacggcaccagccacatcctgcatgcccttagccgttaggggcaactcaaccgttgggttcgtcacgtaaccgcgtacctcaccttgagctgatgcttccacgacaattttaccagcagggccatcaccattaatgaccactgctaaacgctcatcgcccttcaaaatggcatttgaaaccatcagagagccgagcaacgcgcgacccaaaacggtcgtaccaagttgtgaggcctcgtggaactttgagacttctgccatcatttcagtcgcgtcaatggcaattgcacggaagtttccgtcagttgtcactgcgcgtacaagtgtatctgtcatattatatgtgcctcttattatttgtttattttagtatcagtttaacagaaaaacccgcccaggtagaacctgaacgggctttctttcaatcattaatcttcatcagtatgacgtggttccaaaacttctggcttaactgttgcctctgacgcttcttcgtcatcaaccaacttgttattagccgcttgcttggcttcctcgtatgacattggcgtaaccgtatcattttgaaccttcgttgattctggcatcttaccagtctcaaacaaactcaaaatttgcttttcgtccaacgtctcgtactccaacaaagcctttgcgattgcatcatgcttgtccttgtactcttcgatgatttcgtgggccttattgtaaccctcagtcgtgatacgacgaacttcttcgtcaatcaaacgtgctgtttcatctgaataagccgctgactcaccgtatgaacggcccaagaatggttgaccaccattctcaagttgtaccataccaagcttgtcagacataccgtactccgtcaccattgaacgcgcaatgtttgttgcttgctcaaagtcgtttgaagcacctgatgactgttggtcaaagataatttcttcggccgcacgtccacccatcaaaccagcaatttggtccatggcatccgtcttattcatcaacatttgatcttcacgaggcaacataatggcgtatccgccggcacgtccacgtggcacaatcgttaccttgtggacaacacgtgcttcgtttaataccaaaccaacaatcgcgtgacccgcttcgtggtaagcaactgtttggcgttccttagcagaaaccacacgatccttcttagctggtcccgcaataacacggtcttcagcttcatccacatccttggcgtaaatcgtatcgtggttttgacgagcagccaacaacgctgcttcgttcaacaagttttccaagtcagctccaacgaaaccaggtgtttgcttagcaatttccttcaagtccacatcatcagccaatggcttattcttagcgtggacgttcaagatagcctcacgacccttaacgtcaggacgaccaaccaaaatcttacggtcgaaacgacctggacgcaacaacgctgggtccaagacatctgaacggttggtagcggccatcacaatgacaccctcactaccagagaatccgtccatctcaaccaacatttggttcaatgtttgctcacgttcatcgtgaccaccacccatgccggcaccacgttgacgaccgaccgcatcaatttcatcgataaagatgattgatggcgcagccttcttcgcgttgtcaaacaaatcacggacacgactagcaccgacaccgacgaacatctccacgaagtcagaacctgaaatcgagaagaacggtacgccagcttcaccggcaactgcacgggccaacaaagtcttaccagttccgggagggccctcaagcaaaacacccgatggaatacgagcgcccagctttaagaacttctttggatccttcaagaactcaacaacttcgactagttcttgcttttcttcttcagctccagcaacatccgcaaagcgaaccttgttttctgaaggatcagctggctttgccttagacttaccgaagcccatcatgttaccacgaccgccttggccaccttggctcatgccgcccatcatcaagtagaacaaaccaaccatcaacaagattggcaacaacatcgttgccatgcttccccagaagtttgaaggttgtggcttcgttgttacttctgtcttcgtcttgtcagcagccttctgcatttcctcaacaattgggtcattactaatcaattgtgtctcaaaaccagttaccttagctgatgaaccaccaactaatgacacaagtgaatcagactttgcgtccttatcagtttgtgctttgcggtactcaccctttacgtcgtaaacgccggcacctggttgaatcgtgacatttttgattttcttatcacgcaattccgtcataaatttcgacgtagaaatagtcttcgtattagaagtttgcgatggaccggctacccagtaaatcaaccccataattccgaggactacgattacgtagaacaaactattccggacgaaattgccgtttcgttgattcttcatccattcctcctaccgacagcaaccgctatctgcgttgtttaatatatgttatccgagttggaaattagtgctcaggtgtgatatccaccgtgtctacgacatcagcgtgggctgggtcataaacttcgcgcttcaagacaccaacatatggcaagttgcggtaaagttgcttgtaatccaaaccataccccaccacaaatgcctttggcacatcaaagccgatgtaatcaacagttgcttctacaacacggccttccttcttgtcgagcaagctggccgtcttaacagactttgcaccacgttccatcaacaagtcgatcataaacttcaatgaacgacccgtatcaacgatgtcctccatgatgatgacgtcgcgtcctgcgatatccgtttgcaaatccgttacaaggtcaacttcacctgaagaagcaatcccaccgttgtagctagaaacgtcaataaattcgacttcagcatattgcatgtggcgcattacatcgaccgtccaaagtacggcacccttcaaaactgacaaaatgattggtgtacgtccttcataatcggcagccaattgcttaccaacacgttctgctgcttcggcgatatcttgctcgctataaagcacgcgttcgatatcgttattcatgtcccattggttcatgtctgttcaatctcctaaatcttaattcccctaccgttacatagcattaagaataccatgtttgacggtaaatgtttagtgctacaaataaaagaaatgtgaacgctttaatgtttttgtgataacaataaatagttatcaaagcgttctagctgtaattgtccacctaaatcaattagccccgtcgacacacttggattgcgcatcagttgaattgcctgggcaatttgactatctttgacgtttaagacgtgtttcttagtcagccacgtttgtatgataatcgtcaagacactctcatcaactgtccaatccaggcgtccggcctctaaagccttaacgtgaacgttaatcgcaccattcgcaagcttttgcagcgccgccaactgggtcgcaaacgtcaccacgtgttcagcggcctgttcattaatgctagtcaaagccggcagcactgtttggcgcatgcgattacgggcaaatgtttcgtccgcattggtatagtcttctacccattcagtcagcggttgaatgaccaaatctgctaggtcagctttcgttaaattcagcaatggccgggctaaatcaatatcgccacgtaattgctgtcgtggcgccatccccaccaactgggtcaaacgactgccacgagtcagcttatacaaaatggtttcaacttgatccccttggtgatgggcggtcacgataatgttagcgcccacttcacgggccattttaatcagtgcttcgtatcgcttttcccgggctcgttcttcaactgcgacagttggaacggcctcccaagtaagtgtttctatcaacccgtgggctaaatgcggtgtggctgcaaatgttcggcgaaccagcgcttcctctgcagcggcatcatcccgtaactggtgattcacatagccggcactcaccgtcggttgcacatcagccggcagcgttccttctgttaaccagcgcaacaagtgtaaggaatcttgcccacccgaaacagccaccaacacgtgatcatgttggtcaaataatccctgttcccgtatctgtcgggttaagttcgcacgtaatacttttggttgcatcgttaaccttcttcctcaatcactcttggttattattatagcttgctttgtacgaaaaaaaggcaatcagtgtcctgattacctttctttcattcacttcattactcacctggcaaattgaaaacaatctcgccatctttggtatacatgtacttttcacgcactaacttttcgagatacgattcatcacccaaatctttgacttcttgcttcaaattttgatgcgtggttttcgcactcgctaactgcgtttgtgttttttctaaacttgccgaagcagttgtatatttattatattgttggtgaaagcaaaccatggcataaatcaccgtggcaatcataaacgccgccaagacgaaacgacgccgtaagtgtaccttacgttggtaagcttcttgtcgattattgaattcaagtgttcgtgccccaccggcgttcagcggccggatgtttgtttttgtgttcatagacatcatgccgctgaccccctactgtctgattggcaacgttattgatagacaattctttttctcgatacctttacgttttacactgtacagtacaagtaggcttttcttaagcgtaattacctttccttaacattttcgtatcaaaacctaacggatagttatccacagagttatcccaccttaatccacacatagtttaaacacaaaaagcaccgcaaatgcggtgcttttttctcacaactgtcaattatgcttcttcgttgaagttttgctcgtatgactctgacacaatactgtacatgtgttcagcttcttccttacgaaccgtctccttggtactctcaaccttcatgattgatgtcttgttaccaaaacgaatcgtcaattcatccccagccttaacatcacttgatgacttggccgtcttgccgttgatatcaatacgaccttggtctgagatttccttcgcaaccgtacgacgcttaattagacgtgataccttcaaatacttatctaaacgcattattcttttcctcgtttcaatattgcatataggcggtcaccctttggcaacgcctcccactcttccgtggttaacaaatctgtcgttgccaccatcactacgaaagcaacggccccaacaataacggccaccacagccgttagaacgcttgccccacgcgatacaccgaacaggttatcactgaccagggttgccattttggcgaaggcgccagtaaccactaacgtcccaaataattttagccaccaattttgcggtaaccacccttgccacaaagtccgtggtaatcgtagtaaagcataccccaaaatcggcaaaagcgcgactgttgtggcgattgatgcgccagttatgccccagtgtggaattaaccatacgttcaggccagccttaaccgtcattgtcacccagacaagccaaatgagcccccgggtgcgatcaaaactttgtaaggcactagttgcaatggtcatcaacgttgccggcacaatcgccaacacaaaccacgacaaagcagtgctaccttcgcgggaaccaaacaacagctgattgaccgcgggcatcaccgcaactaagccaatcgctgagaccccggacaagataatcgccaaacgcatcgttaactgaaaatcatgacgtaacgctacgttatcttggcgcacaaaatgctggcggagtgctggcaacagcgacgtactcaatcccgtcgctaggaccatccccaattgcactaatggttggccacgatcgtagaccccttttgtatattcggctttggtcgccgataaaccaaacgtttctaacaaggccttggtcgaaaacgaatcaaccaattgcagtaacactaacagtgctgctaacaatgccaacagcccgccttcaaaccataagcgcttgaataggtggcgccaggtaatcgttttatcctgcttaacagtcaacgtaatcggctgttgccacacaccccgtagtgttcgtaccaaaaacaaggtcgccgccaatccagcaatggtcgcgccaaacgtggcccactcaccaattcggtaatctgaccatcccgtgtgaacaccccaccaggcaaccccgatgataattgccacacggacaatctgctcaactacctgcgatgtggctgttggaatcatattgcgttggccttgcgcaaaaccgcgaccaactgccaaaaatggcataaaccaaaacatccatgcaaccgcgcggactactggtgttaggcgaatattgccccccatcgccaaagccagcgctggcgcaccgccaaagacaattgtaaagaggaccgcactaatcccgactaacgaccaaaataaacgccgcgctaccagttgttgatgcgcatcgtctggctgttccgtaataatttttgatataaacaatggccagccactcagcgctaacaccatgccgataccatagattggataaacttgttgatacacataaaaaccagtattacccaccaaattttggaacggcacccggtaaatcgcgctcaacaccttagcaactaatccagcggctgccaagacaccggcgcccgccattaaattttgactacttttgctcatttgtcaccgtctcttctggcgctaacaaattgaataacgtcagcaaaccaaatagccaatcttcagccgtttggtttggttgaattggaatctcggcttgaactggcgcatcctgcttgacttgcccacgcacctttgccaacgtcaacgccttttggaaagtatctgccgtcactgacgcacgtggatcgaagttcactaacaacacgttttgtcgtttgaagtctcgacgcaacgttgccaaaccggcgcgatcagcagctgccttaacacgaccaactagcaacaagcgttgggccgcttccggcaattcaccgaagcgatccaacaaatcgtcttcaatttcttcgaacgcagcggtcgtcttggccttgcgaatacgctgatagagatcaatcttttgtggtccatcagcgacataatcagttggcaagtaggcttcaacctgtacatccaactcagcatcaaaactctttttgcgcttaccctgcttctcagcgactgcttcgttcaacatttgcgtatacaaatcatacccaaccgcattaataaagccgtgttgtgactgcccaagcaaatcaccagccccacgaattgataaatcacgcatcgcaatcttaaagcctgagcccaactctgtgaaatcacggatggcggtcaaacgtttctctgactcttcgttcaacgagcgtgtaccagggtacgtaaagtaggcatacgcaatgttgtttgaacggccgacacggccacggagctggtacagttgtgccaagcccatgtgatcagcgttttcaacgaacaacgtattagcatttggaatatcgaccccagtttcgatgatggttgtcgttaccaacacgtcgtactcacgattaataaaatcaaccagaataccttccatttgcgcttctgtcatttgaccgtggatataacccacgcgcgcttctggcaccagcgattcaatcatccccgccacctgcgcaatgtcttcaacacgattatgcaaatagtacgtttgcccaccacgagacatctcacgttcgattgcacttgccgttacgcgaccattttgctccatcacatacgtttgaattgggtaacgattggccggtggcgtctcaataacagacaagtcacgcacaccgaccattgccatgttcaaagtacgtgggattggtgtggccgttaacgtcaacacgtcgacgttggtctgcaacgccttcagtcgttctttgtgcttcacaccaaatcgttgttcctcatcaatgattagcaagcccaagtcggcaaaatccatgtccttcgacaaaatccgatgagtcccaacgacgatgtcaattgtgtggtctttcaagcctgccttggttgcatccatttgtttcttggtttggaaacgcgacattatcgccacattcacaccgaacccgtcaaagcgattcaacattgattcatagtgctgttgcgccaaaatcgttgttggcaccaacatggcaacctgcttaccagcgtgggctgccttaaaggctgcgcgcaacgcaacttctgtctttccaaaaccaacgtccccaaccaacaaacgatccattggccgggtcttttccatatccgctttaatttcttgggttgagcgaatttgatcaggtgtttcgggatatggaaaggcatcttcaaagtcccgaatcacatcatcatcttgaggaaaagcgaagccttgcttcaattcacgctcggcatatagctgaagcagctcgtccgcaatatcttcaaccttcttagcaaccttagctttcgccttttgccattcggttcccccaagtttattaatcttaggggccttttcagctgcaccaacatacttttgcaccaagtctaattgcgtgaccggtatgaaaattttcgcatcttgttggtatgcaatcgtgatgtaatcttgcttcaccccacgattttcaatcgtctgcatcccttcatagacaccgacaccgtgattaatgtgaaccacataatcccctggcttcagttcgttataactcttaatgcgttccgcgttcgacaacgtttggcgcttaggtgcacgcttacgaacttgttgaaaaagctcacgttcagtcaatacgaccaaattttgagccggcaattcaaagcccgcactcaacggcaaggtcgtgacctgtgtccggccaggcgccaaggcatctggtgcaacatcattcaccttcaacccaaaatcattaagggtttgaaccaacttttcccgtcgatcaggcgtattggttaggaacaaaattgtttggttttgcttctgccaacgcgcaatttcattctttagcaatggcatttgaccaaaaaattgttgcgctgggcgcacggtcaaattcgtcaaactcgtttggcgtaattgaccgataccacgttgcaaaggtgaaaataccaaactggtctggcggacgtctcgggccaaatcgctcaattcccagccaaaatcggccgttggcaaaaccaaattatccgccaagcgatcagtccaccaattattgttatctaatgccatttgccccgcgttttcaagcgcacggggatagtcatcaaacactgcaataccgtctgccggcaagtaatctaacagacttaccgcatcagggtagagtaaatgcaaatattggcgtacctcgggcaataaatccccttgcgccatcaccgttaacaacggatcgagtgcttccgttaaatgacgcttggcagcgccgtctaacttatcgcgtgtttccgtcatcgcaacttctaagcgcgtcgtagcagcttgcaaatcagcggcatcaatgaccaaatccgttgcgggtaaaatcgtcacgtgttcaagattttccaaactgcgttgcgtctctgcatcaaagctacgtaatgaatccaacgccgtatcaaagaaatccaagcgcaccggataatccgcatccaatgggtaaatatcaacaattgacccacggaccgcgaattcacctggctgttcaacgctgccattccgttgataacccatttggtataacgttgcttgcaactccgctaattcatattcatgatcaaaatcaatttcaagtgctgcagcggcgaaggttgccactggtggtaagtagcgttgcaccccggcaacaccggtgaccacaaccgcctgtggatccgtcaacaacaagtgcaacgcttgcacacgtgctaaacgggtatccaaagacgtcacagcaaattccgcagataacgtctcttccgttgggaaaaccgccacgtgttcgtcgccaaccatcgctgctaaatcttcggccaactgatcggcgtggaactgactgtcaccaacaatcaccatggggcgctggatattttcatgcagtgctgccaaataaacggtacgcgcagttcccgaaataccggtcatcaaatgacgaccaccttttttcagtccagctgctaatgtttgaaaatcattatcttgctggagtaaccctgctaattccatcgttgctcctttagttaaacttgttcattaaagttggcatatcgttacctgacgcaaaggcttcaaaaatatccaacgccttatcgataccgccaagcatctctggttcttcatccttgccaaactttcccaacacaaaatcaaccaccgccttttgtgtatgggctgggtgacccaccccaaacttcaagcgattaaatgtttgggtatcaaggtgttgggcaatactcttaatcccgttgtgaccacccgctgaacccttctggcgcaagcgcaaacgaccaagttccatatccatatcatcttgcacaaccaacaaatctggaatatccaaatcatagtagtccattaatggacggacagcgcgacctgaatcattcatgtaggttgttggcttaaccaacaacactttttcgccggcaatccgaacatccgcaacgaacgcattgtgggcaccatcttgcttgaaggttgcattgtgcttatctgccaaagcatctaccgtcataaacccgatattgtgacgcgtccggtcgtattctttaccaatgtttcctaatccaacaatcatcttcatgaggggctattctcctatttcaattccgcgcattaacgcacgaaaggggcagagtcgcaatgaccctaccctgttacatttcttatttacttcatctattttatcgcactttcaactattggtcacttttcgtgcattttttataagaaaacagctaggccacatgtgtcttcatcgtgcgacctagctgtttcattttttctaatgcttaataattgatagccccgttttgcggttaaattggagcatttcgtgttcgctatccttgtgataggcgtaaatcaaggtatctggatcaatggcgtggcattcaaaccaatccgattgttgccaccatggttgccgtgactggagtaaccgttggaaatgattaaaaatttccccacgcggttggtcccacgggaagtacgcccggttatccgggtccttgccgccggccatccccatttcatcaccataataaacgcacggtacaccaggcatcgtcaaccataactcaatagcccgcttcgtcaattcctcatcttcgttcatttcagtaaacaaacgacgggtatcgtgtgtccccatgttcgtaaatgcgccgaaaaaggcggacttgggataatttgcctctaacgtcataatcatcgttgtgaaaaccttagcatcgatttcaccgagcataaaatccaaaatcaaattctgcaacggataatgcatcgttgcttgcagaccaccaccgagcaaatacttacggcgctgattgtaggcgactttgttagatgcatcttcccagacctcaccaattaggatttgatttgttgacagttgttcacgaatccccgcgataaaatcatctggcaattcatccgcgacgtccaagcgccagccatcaacaccaaatttattccagtggttaataactgaatcgtcatcggcataaatgaaattccggaaacttgtctcgcctttattcacaactggcaaatccttcacgccccaccacgaattgtattcatcagggaacttttcaaaatcaaaccagtgaaaatattttgacgttggcccttgataggcccccggttcaacaaagtagccatctttgttaaagtaacgtgaaaattggccaacgtgattaaagacaccatctaagataacgtgcatatcgcgcttatggatttcatccagcaaatacttgaagtcgtcttccgtccccaaaattggatctagggccatgtaatccgaggtgtcataccgatgatttgaattggccgcaaaaattgggctcagataaatcgctgtacaacccagctcctggatgtaatccaacttgtccgcaattccacggaaattaccaccgaaaaattcccagcgagcaatctcgcctgccttgtcacgcacataaaatggccgatcatgcaaatcagcatagacaaaggtatttggttttgggctgttaatatgatggtccgcattaccgttattaaagcgatcgacgaagatgtgataaaacttcgcagtcgcataccagtccggcaactcctccatctcggctaagaccgtaatttgaaaatccggaattgatgaataggtcatctcataacgttgcgcttcaccacccaaattattaccttgggcggctaaccagtattggtcatatcctgaaataacttcaaagcggtaatacaacaatcccgcatgcgcagctgaaatcgaaatcgaccaattatcatcagtcgtttgttccaaatcatgccacgtcaccttaccagtctcgtcatcataaacccgcaatcgtacttcatccgctttacctgccgtttgcagggtgaccgtctcgccaacaacaacggcaccatatggatcacggtgggaaatgaaaaatgaattaaattccatttaagccaccccttacttgctttcttgttgcgctaataggttgtgaggcacatgccaaatttcatcggcatacgccgcaacagtatagtccgctgagaattccccactggccgcaatattcgccaatgacttacgtgtccaagcatgttggttttgataatcttggccaagacgagcttgtgtatccacgtatgattcataatcgcctaagacaaagtactcatcgttatcacgaatcaaagaatcaaagacggcttgcccctcttcttgcacatttggcactgtaccatcaatcaaggcatccagcacgcggtgcaactttggattgttttggtaaatatcccaagcagaataatcatgttgctcatagtgcttgtacaccgtgtccgtatccatgccaaaggcatatgcattttcagcgccagcagcatgaataatatcaatgttcgccccatccatcgtcgccaattgcaaagcgccgttcgccatcaacttcatgtttgatgtaccggatgcttccttaccagccgttgaaatttgttctgacacatcagcggccggaataatcaattctgctagcgacacgccataatttggaatgaaaaccacttgcatcttatcattcacggctgggtcattattcaccatattcgcgacttcattaatcaccttaatgatttgcttggcatagtggtacgacggtgcagccttcgcggcaaaaatatgaacacgtggcgccacataggcattggcatcatgcttcaacgccaagtaatccgtcaaaataccgagcaaatgtagcaactgacgcttgtaggcgtgcaggcgtttgatttgcacatcgaagattgcatcaacgttaatgtcgatacccatgttatgtgatacccaatcggctaagcgttgcttattttgccgcttcacgactgccaattcacgcaagaacgcttcgtccatattgaaatcccgtaacttcgtaatgtccttaggcaacttgcgccaatcgcgtccaatcttcgtatcaatcagcgccgacaacgactcattggccgcatgcatgtaacgacggtgcgtaatcccgttcgttttatttgagaacttagctggccataaaatgtagaaatcatgtaacaccttgtcttgcaacagttgactatgcaacggcgccaccccattgatggcgtgtgagccaatggctgccaaacgcgccatgtgcacttgaccgtcttgcaacggtgatgtgcgccaagcaaaatcttccccatgttcactcgcgacactcacccggtggcggcgatcaatttcttgaatcaactggaacaagcgcggcaattcttgcgcgaataaatcttgtgaccaacgttccaaagcttctgctagcaacgtgtggtttgtataactaaccgtgcgggttgtgataccccaggcttcttcccagccaagaccgtgttcatccaacaaaatgcgcatcatttctggaatgaccaccgttggatgggtgtcattgatgtgaatggcaacttggaatggcaacgcatgcaatgaataaccatccgctaagtggtgcttaatgatattttgcacgccagctgaactaaagaagtactcctgacgcaaacgcaagcgacgaccttcttcattggaatcatcgggatacaattcacccgaaatactttcaataacgctacgttcagaaacggaagctttcactccttctggcacttcagctgaccacagccggagcgtgttcacgacatcgttatcagcaccgaccatccctgtatcatacggcacagctaatacgtctagcccgccatcataaactggtcgcaagccatctggcgtatcttgcaagtaaacattaccgccataatggacgacttgtgcctcatcatcttggcgaacttcccaaacgtcatcatttttaagccaatcatcgggatactcgacttgatagccattaataaaggcttggcggaacaatccatagcggtaccgaatgccgttaccattaccggccagtgcaatacttggcatcgcatccataaagtcagaagccaatcgacccaaaccaccattaccaagtccttgatcaacttccgcttccatcacggcattgaagtcaacatccaactccgccatcatctgctctgtatcagctagcaaccccaggttaagcaggttcgcacgcaaatagcgacctggcaaaaattcaattgagaaataataaacctgcttggcgcccgtgtcgcggtaatcttccttagtccgacgccactttgttgcaatcttttgcttgaccacggctgccaacgcttgatagcgctgcaaatcagtcgcatccgccaagctaaccgcaaagtgcgcttcaagcgagtctaaaaattcctgctttaattgtgttaccgtatcgttttgttgcatcctgccacctcattatctttatagttgttcgtagagtgcgtgataggcttctgctgaacgtgtccacgacacatccacacccatcgctcgttcttgcaattggcgccaaactgccggcttgtgcaagaacgtttgttgcgcgtaatccatcatccaaccaagggtgccggcatcaaattgcttgaagccgaacccatttccttctcccgtgacttcgttatacggctcgacagtgtcgcatagcccaccaacttggtgcaccaatggtagtgtcccgtacaattgcgccatcatttgcgaaataccacatggctcgaacgcacttggcatcaagaacatgtctgcccccgcatatagtcgttgggccaaatgcacatcaaaatcaataatgacccgcaattgggttgggtactgcgctgccaaatgggtcaattgtccttccaattctggaatgcctgttcccaaaataataatttgtgcatcgtgggtcgccataaagtatggcaatgcttcagccagcaaatgcacacccttttgtggcgttaagcgtgacaccataaccatcaatggtcccgccgcatctggtagtgaaaactcttcgcgcaacgcttgtttatcagcttctttgccactcaaatcatcgcgtgagaacttcactggcacatccggatcggtctctggattataacgatctgtgtctaccccattaacaattcctgatagtttgtcctcgtataaccgcaagattggatcaagacgctcaccaaattcggcggtcttaatttcttcagcatacgttggactaaccgtgttaatgcggtccgcaaaaaccatccccgtcttcaaccaattactaccgtcaccaaaccgggcttcaccactgctgtacatgttccaatccaaatcgaagaacgtttgcaacgtgtctgctgcataagcaccttggaattgcatgttgtgaatcgtcagcaatgtcttaatgttggccaacggttgttgccagttataacgtgtctttaacaacgctggaatcattgacgtatgccaatcattcacatgcaagacatccggaataaagtcaatctcttgcatcatctcaataaccgctagttggaagaacgcaaatcgttccccatcattccagtggtcatataactttttacctgagaaatatgaacgattatcgatgaaatagtaaatcacaccgtttaatcgcattgtcttcacacctgcgtattcttcgtgatgattaatccacacggtgaaccaacgcaaatccatcaattggtcacggtactcatccggaaagatatcgtgatagaacggcgcgacgacacgcacatcgtcaccttgcttattcaaggcattcggcaacgccccggccacatcgcctaagccacccgtcttgtaaaatggcaccacttcacttgctgcaaacagtgtcttcattagttcagtacctcttcacgcttggcgcgcaccacagcatccttaccaaccacaattggcatctctggtgtcccatggagcacaacacctggttcgataatggcatccttgtccatgatgacgtaatccaagtcggcaccagcgccgatttgaccaccttgcaaaatgaccgagtggcgtaccttggcatcctcagcaacggttactgtccggaaaacgactgagtcttgtaccgtaccagcaaatgaaccacccgttccaaacaatgaacgatgcgtggccgccgtgtgttcaaagcgggctggcgcttcattcttcgccttagtgtgaactggtcgttccatcaacaagctgtagtagttttcgtagtctaacaaggcttgattcgcttcaaaatagcttttgacatcatgcactggcaagtgaatgccttcgtgaacaaccacgtttgcgccaaagtcattcatcatacgacgaataatggcttgcacgttcttacctgtggcatgctccaactcgcggtcgcaagcaatggtcaagatatccgcattaaccacactggcttgcaagtacaccaatacttgttcacccttaacgtggcgaatacgctccgctggcactaaatcacgtgctaagccattgtcggtcaattccaacaccagcattcctggcaacaacttttccgtcgccatccacgtcgcaatcaccgtgaccggttgttcctgttcacggtgactcgccaccatttgcgacaagtccaaatttgcaacttctgacgtgcccataattgccgtgtatggtgtcttggcatgggtcacaaaccggtgcatgtcctttaacaacgctcgattctcctggaacgtcatgaacaaaccaccgcccaagcgatccatttgccattcccgaccagtgcgcacgtggtccaaaattgattggcaacgtgcgggcatcgccatcatcgtcttggtcaccccagcgttactggcagctgacaatggaaaatcaatcaatcggaacttggccccaaatggcatgctgccaagtggtcggtcaatcgttaattgccccaacgtgtggctttgcgactcattcaaatctaaaatgacactcaattcattacgcattcgtcaatactccctcgtttacagtcgtttggttgtaatactcaccgcaaccaaccacggcgatatcatccggcgtaccaacaatgaccgcgcctggcgcaatttcagcatcttcacccacaatggcgtatgatactgctgctcctgcgccaaccttcgcacctggcatcacgacactgtgatcgacgatggcatgttcttccaccgttaccccggttgaaatcaaactgtgcgagacacgcccaccaacataaaccgcatcaaccattaaactatcgtgaatctgcgcttcttgcgccacgtacattggattttggtttgttgtgtgtgagtagattcgccagtgtcggtcagccaattgcaattcattgtgcttatcaagtaattccatgttggcttgccacaatgattgaatcgtaccaacgtcgcgccagtaatctttaaaggcataggcgtacacgttttcgttgttcgccaagtacgccggaatgacgttcttaccaaaatcaaccatgtcgttgccaccttcaaaaccggctaccaaatattcgcgtaacttgcgccagttgaagacgtaaattcccatcgatgccaagttcgactttggttgcgctggcttttcctcaaattccaaaatcttatggtcgttatccgtgttcataatgccgaaacgcgatgcttcgtccattggcactggcatcaccgacactgttaagtcagcgtggtttgccttgtgtgcttccaacatctttgtgtagtccatcttgtaaatatggtcgccggacaaaatcatcacgtactccggatcctgacgatcgatgtaggccatgttttggtaaatcgcgtgagccgttccttcaaagaacttgttgcccttgccatcggcgtatggctgcaaaatcgaaacaccgccacccatcacgttcaagccccaatccgagccgttcccaatgtgttggttcaattcgtatggttcatattgcgtaatcacgccaactgatgtgatatttgagttggccaagttactcaacgtaaaatcaataatccggtaacgtcccccgaacggtaccgcgggcttggccaagtttttcgtcaacttacccaaacgtgttccttgtcctcctgcaaggatcaaagctgttactttatcatccattattttttccccgtacttgcttcttttgcttaataatcagtgcccccgtcgctggcaaaatcactgaaatttcatagtgatcacctaccaagaaggcttcgtagtctgttggaatatgttgccaagtcccaccaaaggcaatatcttcagtgtttagcaaaacatcatagcgaccggcgcgtggcacaatcacgcggtaatcatctttttgcactggcaacgtattcatcgccataatgatggtgtcactcggtttcttaccatgacgcatcaatgccatcgtgccctgagcaccttggtcagtttgtgagaagttcaccccggctggtacaaaatcttgcgcccaaaaagcatgttcatcacgataaagtttgttcagttcggccgtgaagtgttgcatactccggttcataccatcctgtaaatcgcgccattccagcccttcttcatcgcgccactccaagaattggccccattcgctccccatgaagcgtagtttcttgcccggatgcgccatcatccaaaccatcatcgtccgcaaattggcgaactggttgtagcgatcaccgaacatcttgtgcatcaaactctttttcccgtgcaccacttcatcgtgtgacagtggtaacgtgaactgttcgtcaaacgtgtacataaagctaaacgtcaaattattgaatgcacccgtgcgatagagataatccaattcaaagaaatcgagcgtgtcatgcatccaccccatattccatttgaaatcaaagcctaatccctctggctttgtcaccccaggatatgccgtggcttcttcagcaaacatcaaagccgatggtacgcgttcatgaataatggcatttagcttttgtaagaatgcgacacccgcataatcaatcgccgtgccgtgctcgttgacccaatcttccttaccggcatcttggttcaagtaaatgatgtttgatatcccgtcaacccgaagaccgtcaaaatggacatcctccaaccagaagagtgccgccgaaatcaagaaactttgcacctgtgacttacccaaatcaaagttccatgtcccccagcggacgttttctgcaatcgtgacatcccccgcttcaaacgtcggtgtgccatcaaagcgataaagcgcatcatagttcttgataaagtgtcccggcacaaaatcaagaatcaccccaaggtttgccttatgtgcttcgtcgacaaaatattgcaaatcttgtagataacccatgcgtgaagttgccgcgaagaaaccgtatgattgatagccccacgacatatcaagcaagtgttccgtaatcggcaacatttcgatgtgggtgtagcccatttgcttcacgtacggaatcaactcatcagccagttcgcgatatgataaatacgagccatccgtgtgacgacgccatgatgtcatatgcacttcataaatattaattggctgattcaacttatgacggcgaccttggcgaccacgatacaacccgtcatgccacttgtatgggcacgtgttgaccaccgctgctacaccaggctttttctcatactcgtgggcaaacggatccgtccgtaagaccacgtccccagccggcgtttcgatggcgtacttgtataaatcgccttccttcagtgccgttgtggtaatttcccatacgcccgtctcctctaacggatgcatggcaaacgcctcgctaggcatccaatcacactgcgctgatgcaagatgcacagccttagcgtgtggtgcccaaacgcgaaatgttagttcagccttatcccgcgtaatcccaaaaaacttatccgcacgatatgactgaccagtattgaacaagtatgccgcttgtaaattttcctctggcacttgtactttcagcataataattgcccctctttcatttccccatgtaaatctaaatttttctaagcgttacgttatgataccgaagagatatgaaatccatgtccgaaaatatgtggtgatttttttatttctacggtgcaaaattcatgttttgttcaactttgagcatttttcgacgacacgttgtcatccggacacaaaaaatcccgtaacgcttaatttcgttacgggattcgttttgtatttgtttcataagattttttgaatggtttcatcttacgacattgtcacttggtgatacactggcgctggcgtgtgcgtcgttatttgctgatctgcatacgccgactgacggatatctgcatccgtaccattattttctatcgaaacaaagtcaccaattcttacatcatagaccagttgtgaataatcaattgcgctatcgttcatcgttccatcctccgtgacattatgtgcttgcgttgttgagttgatgtctacatcataagtcgccttggttaacgaaaacttagcgcccggttagtgcaaccttaaattcacgctacgccctttcaacaaaaaacgccgacagtcacatgaccgtcggcgtttttaatctcttatttcttctctttatttacttagcagtcgcgtcagccaacatattatagtggcgacgatgactcaaatagtaaatcatcattgccgcaattgatacaacaaagatgccaaccaatacctcaacttgcggtgcgatcgaaccaccaatcatcaccgtttcacgtaaaccatcaaccgtgtatgtcattggcaagtatgggtgcaaccactcaaagaacttgtttgacaattgaattgggtaagttccagccgaaccactcaattggatgaccaacaagaccatggctgcaaacgcaccagctttaccgaaccacatgtaaattgccgtaaccaacgcagcgtccatcactgcaatcagaaccatgaagccatatgttgcacccgggttgattgggtccatacctagtacagccaaactcaaaccatacaaaaccgttgccgcaacaatagcaataccaaacagcattgccatcttagaaccggcccatgcccacaatgatgaaatctttgtgcgtggtgaaatcatatcaagcatcaaattcaatgccatcatccccacgaacattgccactgagaacatgtatggcaccatacccgtaccattattagcaacgtgatccttttccttgtggctagcctttgctggcgtcgcaacttggtgatacgttgacttcgtcgcgtgtagcttcttgaccttatctgacgcgtcacccatcttgttagccaatgtttggttacctttctgaacttgggtcaatgcagggccaatttgctttgaaccatcagccaacttttgtgagccatcactaatttgaccggcgccacttgctaattgaccagcaccgctgttcaattcattattcttgccagccaacgtatccaaaccactcgtcaacgtatttgcaccatttgccaattggccagcgccgcctgctagttcgtcagaaccggctagcaattgctcagtaccattgttcaactcagctgacttgctgtctagcgtgtttgcaccatcgactaattggccaataccgctgaccaactcacctgacttattgtttactgcattcgcaccatttgccaattgaccgataccattaaccatggctcctgactttgataacaactctgacgtgccatcattcaacgatgccgacttactatttaatgtattcgcaccatccgtaagttgtgcaataccgttgaccaactcacctgacttagcctgtaattcagacgtgccatccgttaatgcttgtgattgactatcaatctgattagcacccgcatccagttgctgtaccgcgcctggcaaagtcgctaattgatttagctgattctgagcatctgtcaaagtactatcattaacctcaaccgagtctaccagttgcttattgtcatcaatcatctgttgaattggcgcaacttctgaagacaatgcagtatattcgcccatcatatccttcatcaaagtcgcaacttgcgaattatcttgtgtcgcttgcacagccttagcaaccgccgcttgttgctctgggttcattttggtatccgtaaatgcctgctgtaaattggcagtcattgcatcactatcagccttttgagctgcttgaatttttgtaacatcatcttgcaacacattaacgtgttgttgaataccagctaaaacatcttgtccacttctaccctgataactattttgtaattttgcaaccgcttgttgaatgtcaccaagagtctgttgtgcattagcaatcttattagtcatatcagattgttgcaactgagtgttcaactcgtctaaaccttgtgttaattgcttaacaccagccgtgtattgatatgtaccatcattaatctgcgcaataccttgcgtcagtgttggtgtttgctcattcgcttgatttaaaccaccagtgatcttctcaacaccagctgtatattgatgcgtaccatcattaatctgcgtaataccttgcgttagtgttggtgcttgaccatttatcgtattcaaaccgttagtcacttgactaaccccacctgtatattggcgtgcaccatcgttcgcacggttcaaaccacctgccaactgatttacaccagctgtatattggtgcgtaccatcatttaactttgccacaccttgcgtcaacgttggcacttggccgttcaacttatttaatccggcagccaattgttgactacctgagtcagcttgcgcaaccccggctgtatattgtgacaaaccattggtcaacgtgttcgtaccgtccttaaacgtcagtgaacttgatgccaacttttctaggttcgtggtcacttcatcactaccagacttaatctttgtcgtcccatcggccaacttttgattggcatcggcagcttgggtaatccccttacccattttcttcacttgaccaaaaattgtcttagcataagtttctgtcacttgggctgaaaccttagccgtaatcgccttggcacctgattctgacaactttcctgcgataaagctgtgaccagaactcgtttcatagtgcaacaccatcttcttaggctgcttatcgagcagtgtcgtggcgttcttagaaaagttttctggaatcgtaatgaccgtgtagtacttaccatccttcaagcccttctttgctgcggcatcagttggaaaactgaaatccatcgccttcgacttttctaattgcttctttaaatctgatcctaccgtcagtttcttaccttggtatttaactgacttatcatgattcactaccgctaccggcaggtttttgactgccccatagggatcccacaatgaactcaaaaacgtcactgcgtaaattgatggcacgaaaaacaacacgaaaataactaatagatagaatttgtgctgttttagccatgcccattccgctttcagcatgtcatatccctcctacttaataatctctcacacttaaccaaccagttattgaacaacttgttgaataaattatctacttgcattatattaagtctgtacagtagaaactacaatatacaattttgaacagggtgttcaataactttggagagacgctatgaaacaggctgaccgtaatgcaaaaacgcaacaaattatcaaagaagcattcattgatttaattaatgaaaaagggttcaacaatttaactgtgtctgacattacccgggcagccggcgtcagtcgtggcacgttctatgttcactacacggataagtacgaactcctcactaaaattgaagacgaattggtcgccaacatcacccacgcgttgagtgaaaatttggatgagccacttaccaagcacaccgctgaagaaatttcaggttcaacctaccgtgtctttaacaaggcgctcaactatgtcgacagcgagcgcatcaccatgcgggcactcttctcaccaaatggtcatccccaattcttcaaccgtatcaaaaatttggttgacgttttgtttaccgatcagttaactgcgaaccacggtcgtttttcagacgcgctaccgattgactacaccaaagaaatcgccctcaatagtctactcaatatcgtgcgtcactggttagacaaggataacccagaaacaccagatgaattagcggatattttaatgcggagccgatttatcgcgcctcacgaactcattacctttgaatagtcaaaaaatcctttcgaaacacatttaaaaaccgccaatcctccgattttaaatcgggagattggcggttttttgtttacatatatgatgtttttgataagtcctcaagcgactccaagtggaagcccttgcgcgacagcacgttaataatctttgacaacattccttcattaaccgtgtccggtaacgtaaagagaattcgcatcgtacgggggttgttgtcaggattcaaagtcattgatgacgcaatttgcgtataacgtgtgataatcttagcagccttttccaagctaccacgctcaccatccgtcacaagcgtcaacgtgtaacgtccttcatctgtttgccaagaatcagccatcaaacgcatcatccgactgtgcgtcacaatccccacaaaatgattttctttgtcgagcactgaaatgaatggcaaatcacgaagcgtaaagaacatttcaaaaaacgttgcttcgatgccgacaaatttcgtcatgttacgcatgtaagtcgtaactggcaaatccatgcgtccgccatctacctggtgtcggtaaatgtgcatcttataaatggcaccgcggaacaattgaccactctcatccaaaattggaatagcacgaaaatttgagttatcaaagatatccaaggcatcctgtaatgtcgcattttcgctgaccgtggtcaatacatcacgttgcttaattaaagttgctagcatttttgccgactcccgtttcttagtttctaattcatttataataccacgaatgcctacccactgcacctttttatcaaaactgtcaacctttcttctaaaaaaatgagagttaactttgaaccagaagttagcccacagcaaaaagcggtgacaccagcctttggcatcaccgctttcatattacatctttttagctggttgcaaggtaaacccctgccatggttcaatcaacgccaacaacgttagatcttctggatggatatggccgaccacgttaatgcgaccatcattcggcaaatcacgcaacgcaatttgcaactcacccttatattgaccgtagtcgttgttatcaattaaaacatccccacgcgtcacgtcaaccgtgttaaatgctggaaaatcttcctgcttatacttaacgcgtgtctgcgttgaacgtaaaacgtaatcggaacgatcaccgcgatacatttgtggttgccggtacatcactgcctgcgacacgtcagaaacaagcggttcttcgacaacacgcaaaccaaccattgtccgattaaaggcttcagccgctgctttcaagtcgtcatcatcagcgaacgcatctgcaatcaacacgtcgtccactaacccgttaaaacgtaattcctgcacttgcgtcgcaatcggcaagttacgatgatcttccaacgagactaaaccatcactgactggccatggtccaaatgtcccactcggcgcattaacaaacgctgccgttcgcaaaccatagcgacggtactgctgtgacgtttccgcaaaataatcacgacccaagcccgtccagcgctgtggatagaaattgtgtgagccaattagattgtcgcgattcacaccaaaatccataatcaaatcgagatagtgctgaccacgtgacatgttcaattcaatttttaaaccatagggattatgcgtcatttgcgcctcttcagctcccgtaaacccaaggtccaggcgcaagccccatgcacccatttccgcaaacaaacgtaaatccgtataactcgtccctaattgttcaaacaactctgggttgatatccaaaatggttttcatccccaactcattaccacgtgtaataacctgcttgtactggtcaagcaaatcattcatgtctggcgtcaattcaagcaacgacgtaaaaatccgcgtatacccataactagccgccttttcaatataggcaatattgtccgtcacactcgcacgtgatggatacaccgaaattcctagttcccccatggttaggcctccactgactgtccttcaaacgccttttcttctgacgtttcatctgccaacgtttcgccttcaagcatttgacgttgacggtctactaacttgaagaatgggatgtaaagcaacgtatcaagtacgaacaagccaatttgcaagaccgcacctgagatgtgtgaaccagttgccaagaatccagaaataattggtggcatcgtccaaggaatcacgacaccaaccgttgcgtgaacaatccctgttgccatcgtaacatatgcgatgatggcattgataaccggtacaaaaataaatggaattaacaagtaaacattcaatacaactggtgttccaaacatggttggctcattgatgttgaatagtcctggtggcgtaatcaacttcgccaacgtcttaaattccttactcttagctgtcagcaccatcgcggcaaccaaaccaatggttgcgccaccaccaccaaggtaaacaaacaaatccataaatggttgggtcacgatgtgtggcatcgtcgcatcagcattttgtgagtaaaccttagcattttcagccatcaaaccaagccaaattggcgacataatcgcaccagtaacgttaccaccgtgcaccccgataaaccagaacagcgatgtaatgattgacacaacaatcgcaccggccaatgagccaccgaacgctgacaatggtccacccaaaactaattgcaggataccatgaattgatgccattggcgttgcagccaagccggcatagattgccccccacagcaatacgattacggcacctggaatcaatgccgcaaatgaattggcaaccgctggtggcacaccatcaggcatcttaatgcggatgtctttcttcatgaaccaagcaaaaatcttggtcgaaaccaatgcgatcaaaatagctgcaaacaagcctgaagcgcccatgtacgttaatgggaaaccttcgcctgcctttgccataatcgtcggcgttgaaatcacataccctgacaaggcaatgattcctgatgatacgccatccaccttcaattcttgtgcatatcggtaagcgattccgaacacggcaaccacacccatcaggccaaatgtaccgttagtaatcttcacaagccaatcgaatgacccattatcaattaaccacgtcttaaacgcgtcaattgaaaacccgttggcaattaacatcgttaacgaaccaacaataaccaatggcatcgcgtaggcaatcccatcacgaacggcattcaacgccttattagcagcaagctttgcaccaattggcatcaaataacgttccagcaactctgtcactttcttcattgtgacgtccccctttgtctagttgcctaaatcgtatctaaaaagcgggacgaccgcatgcgccctttgtgaaatatccttgaccaagcgtcagataatttaaaaatttaacgttattgctaaaaaaggcattatttatcactttccctactaaaaaacagccccaatgcctatgcatcaggagctgtttagaacgtcctatttacctgtcttagttttaacgaagccagctagccaaaccaagctcaagccagcgattacagcacctacccagaacatgtgacccatgcccgtagcagtttcttgcgcaatcaccttggctgatgatccatccgtcttaatcaagaccgcggcaattgctgtaccaactgctccggcaaattgttgaatcgtgttaaagatggcgttcacatcaccagacacctcacgtggcacctctgccaccccagctgtcatggccgtggtaaaggccaagttacggcccagcgtgaacaatgcgtacataaccgttaacccaattgtcgtaatcgatggtgccatcacagcaaacacaatcatcacaataaagaaggcgattgaaccaatcgtcaatggcttcgttgcaccagcgcggtcataaaaggccccataaactggtgatgaagctgatcccaacaatgatcctggcatcaagacaaagccagccaccattgttgaagcgcccaatgttaattgcgcatattgtggaatagcaaagttcacggctaaattaatcgcttgtgacatcgcataaatcaacaacgcaaagaccattcccttgctcttgaaaacagacaagtttaacaacgtctttgatgaacgcaaggcaattcgaataaaggcaatcatagccagaatcgcaataactgctaagacaacgattgaaactgttagcttacctgcttcaagttgtcctaatgccaacaaagccgtagtcaatgaaatacctaatacaatgaattgcataaaatcaaagcttgccgtttgatttggcttttcatcagacaaatttcgcaatcccaaaatcatcccaatcaacacgattggcaagacgatgatgaagatagcacgccatcccaaagcgtatgtgaccagaccaccatacactgggccaagggctggcgctaatgacaaaattagcccaccaaagcccatgtacttaccaatttgcattggtggcacactcatcaaaataacgttgaataccaatggcaaggcaatacccgttccaatagccatcaccaaacggcccgctagcaatagccagaagcctggtgcgacaatggaaatcacgtcaccaatcacaaacaaagccatcccccacataaaaatcttacgtggactcataattgcctttaagaaggctgaggttgtcatcatcaaggccacaacaagcaaataagctgtggttaaccattgcacagtccccatcggtacgccaaattgcttaatcaaatcaggaaaagtcacgttcattgacgtttctgtcaaaatcccgacaaatcccaaaatagcggtcgcaacaatcgaccaaatcacacgtggtgatactttttctgtcatacttaaaatactctccttcaataatagaaacgcttggaataattgcgtcactagctattgaagcatactttgtcccctcttcgtaagtacttttttcaaagactgtttaaatcacgtcatcccgaacgcttaccgctcattaaattcattcttcattgccagtatttcacgatatctcagctccgaataccatcctgatattcttagatacatcagtctcagtcttcgctttatttatgatggttataaatcggcgtatgattagagacaactagacaaacactcagtattttttagagggagggcaaatttatgctaaaaggtgtattagtttacaacgctatgccattactaggggttaattctatttttttcacgccaaacggggtattgggtggaaatccgtcaaaatttaaagccgctttaaatgcggccttagcaaacataaatagttccatacaaattgatcttgatatttcaaatggaaatccacgcgaacttcaagattaccaatatatattagtcacggattatgcttccaaatgggtagatagccacgatttcccaaattcacaattagtcgccatctcaagccgtgattttttcgacaataaagttgataatgtcatcaagcaattagtttaaccaatttggcggaaaccataaatggagcacaacaaaaggccactcaacacgtttcaaaacgtatcgggtggcctttttcagacgatatactttgatttcattcaattagcggttatgtttatcgataaatattttcaatagaaaacttaacgtcacgataccgactaatactatcgctgtgaacaatacgtcagtttttcattattggcgtactaccagcgtttgtcccgcttggacaccattcatatcaacccctggattcaaagcctgcaattgggccagcgtcaacccatgtgactttgcaatcgcaaaagctgtcgtccccgctttgactaccactgtcgatgaagccgaggcatcggtagcatcatcagagtctgatgttgagccaccagtcgcagcactcacttcactctcaatcgcttcagacgccgtatcaacatcggctgccttttcagttgtggctgtctctgggtcagccttactctcagattttgttgacgatgactttgccgaagtcgtttctgtcgtctcaggactcttaaatacatcacctaccgcatcaacagcaactggtgcaaagaatccaacggcaaacaaaataacgtatccaaccgcaattacagaccagaattgcaaacgtgtaggtcgtttaggttccatatctctatacccttatccattttacttactaatagcgtatcattattacaccattttaaaaactagtatacccacgtaactactgttttttaaacactatggcgtttttgtgaataactttatttggcgtcatcgtcgcgttgcgacgaggcgcggcaaacggggagtaactccgacaaaaatctgtctgggtaaactccgccggcacgagcaccggctagcacccaaataattaggttaagagtttaggtccgatcgccttatctagccggcggtcggccgaacttgtgagttcacccagacggattgctccgttactccccgttcaccacgccagcagctgagatattcttatccattatcacattgcatttaattttcgctcgtacttcccgaaattttgattcataaacaccaaccggctacatctttccaacgttattttttgtaagcgtattcaaaattagtgtagactagttcatgaatacaacgttataacttgaatttctgcaatacaaaggagaaaccaatggcctatttaaaaaaattcacgactttcaacaagtttggtttgggtaccaataaggttggtggccacaatttattcgataaccttgctgacgaggacggtatcgccctagttaaagccgctttagatagtggcgtcactttgttagatacggcatttgcatatggcttcggtcgttcagaggaacttattggccaagtcattaaagattacgaccgctcacagttaatcatcgctaccaaagccgcccacgatccggcgcaaaactatgcctttaacaattcacctgaattcttacaagcgtcagttgatagcgcgttgcaacgcttagatgttgactacatcgacattttttacatccacttcccagacgcatcaactgataagcgtctggctgtccaagctttgcaagaaatgaaagcggcgggcaaaattcgggccatcggtctgtctaactttaacctggaccaaattaaagaagccaatcaggatggttatgtcgacatcgtggaagacgcctatagcttagttgaccgtactgctgaacagacaacttgggcatatttgcaagaacatgatatcgagttcgttccttattatccacttgcttctggattattaactggtaagtacacaaaaacacaaaccttcacgagcgatgattggcaatcgcgcaatccgaatttccaaggtgaacgttatcaagccattttagctggggttgatatcttggccgaaattggtcaagcttataacgctagtccctcacaggttgcgttagcttggtacctcaagaaccctaacatcgcggccttgattccaggagcccgcatcgcagcacaattgcatgataatttgaaagcgctcgatgttgccttgagcgacgaagattatcaaaaaattgacgtcgcatttaagtagtccatctgatacaaaagaggttgcaagccatctgactcgcaacctctttttcattttattacttagctgaacgacggaagtccaacaattcgtgtgagatttcagcagttgcgccgtaaaccttcttgtaaattgcgtgaacttcttcgtaacgagctgcacgctctggatctggcaagtattccttgtcaaatgagttccaagcagttgccgcatcttgcactgtgtcaaaccagcccaaaccagtagcggccaagatagctgctcccattccaggaccttgctcgttcttcaatgacacaaccttcttgttgaagatgtcagcttgaatttgcaaccacaatggtgacttagcaccaccaccgatggcaacaactgtatcgaagtcagtaccagcttcttcatagatatcaaagatgtccttgaatgagaagataataccttccaaaactgagcgcacgaagtcagacttcttgtgcgtaccgtcgataccagtccatgatgcacggatatcaccgtcagcgtatggtgtacgctcaccaaccaagtatgacgtgaacaacaaaccgttagcgccaaccgttgacttaccagctgattcaaccattgcagtaaagtcttcatcagcagcaaatgtcttcttgaaccatgacaaggcgtaacctgcagccaacgtcacacccattgagtagaacttgcctgggatagcgtggttgaagaagtgcacttgacccttgtaatcaacatctgcattgtcttcgtacttcaatacaacacctgatgtaccaattgatgacatcaccatgtttggttgcaagatagctgatccgatagcaccggcagcgttgtcggcagcaccaccaaagaccttagtatcagtcgtcaaacctgagaaggcagcatactttggtgagatgttaccagcaaactctggtccttcgataatctctgggaagaagtcaggcttcaaaccaaaggcttcttggacttcctttgaccatgtacggtttgcaacgtccatcgcaactgtaccagcagcgtcagaaatttccatcgccaacttaccagtcatacggtaacgcacgtaatcctttggcgttacgaatgaagaagcttgtgagaagatttctggctcgttttccttaacccacaaaatctttggcaatgtaaatccttccaaagccttgttacgcgtgatatcgatgaattcttgacccatcttctcagcgatttccttagtttgtggcgttgtacgtgtgtcattccacaaaattgctggacgcaacacttggttgttgtcatccaacaaaaccaaaccgtgcatttgacctgagtatgaaatacccgtaatgtcttctggcttaataccatcatccaaaatcaaacgaacgattgcgacggtcgtaccgttaacccaatcttctgggttttgctcgctgtatcctggctttggttgtgatagtgggtaatcatatgattgttgtgcaacgatgttaccttgacgatcaacagcagagatctttactgatgacgttcctaggtcaacacccaatacgacttcgctcatgtttatgtcctctttctttgttatgtatacaacgagggctgggctaatttaatggcccagccctcgttgccgtagggaattgccctactgttatgttcgctatgtgagcgtgagattggcactcacaatgcttttagttgagattatttttgagattttttgagattgagagtgtcagttagattcattgcaaaaggcacctaaccaacaaactgattttcatcagctgcaagccttttttacatggttttacttagttaagttggattacttgttgaaagttgaacccaaaactgagtagatgtagttgttcaacgtagccttgatagcttccaagtgacctgactcaacagtagcgaagatttcttcgttagtcttgttcaagatgtaagcttcgaagtcagcaaacgtagccttgtcgttttcgaagtcagcaccgataccagtatcgaatgatgcgtaacgctccttgtagatgttctccaagaagttgtcttcgatcatcttcatagcaacacggaatccggcagcgtaaacgtccataccagccatgtgtgcgtagaacaagtcttcagccttgaatgaagcacgacgaacctttgagtcgaagttcaaaccaccagttggcaatccaccgttcttgatgaactcgtacataaccaaagtagcttcgtagatgtcgttagggaattcgtcgatatcccaaccagtttgcttgtcacccatgttggcgtccaatgaacccaacaaaccagcttcacgagcaaagcgtgcttcgtgctcgtaagtgtgaccagccaagtaagcgtggttaccttccaagttcaacttgaagtccttctccaagtcgtacgtcttcaagaatgcgatagtcgtttgcacgtcagtatcgtattggtgagcagttggctcctttggctttggctccaacaagaattgaccagtgtagccaatttcgttagcgtacaacttagccaacttgaagaacttagcgatgtggtccaattcgcgcttcgtgtcagtgttcaacaatgactcgtaaccttcacgaccaccccagaatacgtatgattctgagttcaagcgcttagcaatttccaatgagtgcttgatttgtgcagcagcgtaagcaaatacgtcagcaaatggtgtcgtagcaccaccggccaagaaacgcttgttcgtgaacaatgatgacgtgttccacaacaacttcttgccagtctcttgcatcttttgctcgatcttgtcgacaaccttgtccaagttagcgttcgtctcggccaaagtcttaccttcaggagccaagtcacgatcgtggaatgcgaagtactcaacacccaacttgtccatgaactcgaacatgtagtcaaccttcttcaaggcttgttccatgctagttacatcatcaacaccatcaacatcccaaggacgctcggcagtaccttcaccaaatgggtcaaccatgcgttggtccatcgtgtgccagtaagcaactgagaacttcatccagtccttcattgacttagtttcaccgttaatcgtgaatacttcttctgggttgtagaagttgtaaccctttgcgtccaagaagttaacaccctttgcaccaccaaggaattctaccttaggaaagtcgaacaattctgacataatgtcatcctccaaaatacttttaaaatctgtcttatcaatcaaaacctgtttcggttttggttagttgatttaggcaaccaactaacttacgagatttattatagggtacccaaagtaagaatgcaacccttttcatgtgattttcttctcaattgcgtcacacagaaacaaaaaacgcctagaaataaacttctagacgtcttttatgataatttttctaatttttgcatgcgctttcataagtttgattgtgcactttttacaagcttttacaaccaattggcatccgcttgatcttcctcggtcatcgtaaacttcaactcataacccatcatatcaagcaagtggcgcgtgacaattgcgacaccacccgccaaggtcgctttattaactgaattcttagcaaaaaatagcggtgtgtccgattctggcagtatctcatgatacgtttgcagcaacagatccaacaactgtggtgtccccgcaataaaacgtgaatgaacgaagatcgcttctggtgcagcatattgggctagattataaaccgtccggctaatggcatgcacccactcttgtaacagtgcaattgcatccgagtcgccacccatatataaggaaagaaaatcatcacgcgtgatttcatcctgtccttttagaacgccaagtcgacttaacatcgcatcttcggcatacaaatcttctatatgaattggtgcatcaaatttaccagctgctagataatcattgttaataatcacctgacgaccaatttcacccgcctcaccatgcaaaccacggaacaagcgttcattttgaataattccggcaccaattccgttatggatgttcacgaccgcaaagttgcggtaagtctcttctgagtcataatcgtgaaaatcacgtaagtagactgccgccaaattagcttcgttttccaaaaataccggtacatccagttcttcagtcaattcggtagccaagtcatgttctagtaaatctgtgtggaatggggtgtaccgtacacaattgtcttctacaacaccgtgaatggccacacccacgccaatcaaaccacgttccgtgtgcatatcacccaactgcgcaacatatgatagcattgcccgcttgatatcgcggtaagccatccccgtcacagtcatttggccccgagcaattgtttcgcccgtcatacgcgcaactaaatagcgcaaatggtgccgtcccaaatcaaacgatacaatgtaaccaaactgacggttaaatcgaattagcttaggcttgcgaccacccgctttcgaaacggctccctcaccaagctcttcaatataacccaagtcctctacgtcacgatagatagttgtaaccgtcgatttgtgtaacgcaatttgatcagcgatttcactacgcgatgtttgttccgcattaaagagggcttgcaacatcaatttacggttaacatcccgcatggcatcttgatcaactttgttaaccatacttttctcctttatataggtaaattattttctcactgtgcacttcatgtgcttctctaaaattttcaatccttattattgtacaagagattgccatagcatgcccatctcatccaagttaattcacgattatcaaccaacccagtcacaataacttctattgtatcccaaatgcggtacaaattacaaagactatgtgaataaattatcaaacagttagttgtcaggcggaactaaccatgttattataagtgagtaaaagaaatgaaaacgttttctatatatcgttatttgatacacatgataacgttttaacttctaaaaacatctctcacatatatcttttaaggagttattcattatggatgcaaacgtaaagaacgacgagtttgcgaagctttcattaatggaccgtgtcgcatatggtttgggtgactttgcccagaaccttgtgttcggtaccgttggtggtttcttgctattttatctctcaacagttaacggtatctcagccgcaactggtgccacaatcttcttgattgtccgcttggttaacgtggtttgggatccatgggttggtgctacggttgaccgtcgcgacccaaagggtggtaagtacctcccttacattcgtaacttcggtattccgctagttatcttggccgcaatgctgttcttgccattcggtcaatggttcccagcaattaagttgccattcgccttcttgtcatacttggcaacggcaatgatttactcattcgttaacattccatacggtgccttgaacgcatcattgacgcgtgataacgaagaaatcgctaagttgacaacagttcgtatgactttggccaacgtcgctaacttgatggtttacacattgttcccactattcgtgcaattggctacgtcagttggtcgcgaatctaaggatatcggaatgttcggtattcacttgaacttgggtaactatgcttcacctcaatcagccggtgcctggtttaaggtctacgccgtttacatggtgattggtttcatcgctttgatgattacttactcaaagacgaaggaacgcgtcttgccagaaaagaaccaagaacaagttaagtactcagatttgtttgccgagttcaagcgcaacaagcctttgcaaatcttgggattgttcttcctggttggtttcacatttaacttcttcggttcaactgcttggccattcttcttgcaatacaacattggtcactcagaatggaacggttcaatctcattgattggttcaattcctggtatcttcttggttgctttgtggcctttgattcgttcaaaggttggtaagaagggcttcttctacctattcttggcaatgttctcagctggttcacttgttttgtggatctggactaagacgccagacacaattgctttgggttacgttggtcgtttcctacaacaatggggattgacttcagccactggcttcatgtggtcattggttccagaagttgtctcatacggtgagtacacgtcaaagaagcgtgttgctggtattatcaacgctatcatgggcttgttcttcaagcttggtttagctttgggtggtatcattcctggttacatcaacgccgctactggttttgatggtgctaagaaggtccaatcagccactgctttgatgggtgtacaatggtcaatggtttggttgccaattatcatggcaatcgtcgctggtatcatcatcgccaagtatcctttgacggatgacaaggtcgctgagatgaaccacgaaatcgaaaaccgtcgtaacaacaagtaatcataattagaaagatcggtagcctgctgccggtctttttttgcgcaccaaaagtttgtgaattataattcaaatagttggttgcactaatcaactaaccatgttatatttaacgtacagagttaatggtaacgttttcaaaggtctgtttaatcttgaacatgccccacaataacaccactaactatacccgatctctcacaactaatcgggacacatacaaactaatttcacataaggagcatctcacaatgcaaattcaaaaccctgtattgcctggattcaactcagatccatcaatcatccgtgttgaagacacgtactacattgcaacgtctactttcgaatggtacccaggtgtccgtattcacgcatcaaaggacatggttcactggaacttggtaactaacgttcttgatcgtctagaattgttggacatgaagggtaacccttcatcaggtggtatctgggccccagacttgtcatacgcagacggcaagttctggttgatctacactgacgttaagatcactgacggtgccttcaaggatatgacgaactacttgacgactgccgagaacatcgaaggtccttggtcagcacctatccgtgttaacggagttggtttcgacgcttcattgttccacgatgaagacggtcgcaagtacttggtacaacaaacttgggatcaccgtgaataccaccacccatttgatggtattacgttgactgaatttgatactgatacgatgaagttgaagccagaaacggctcgcacgatcttcgaaggaactgacgttaagttggttgaaggtcctcacttgtacaagatcaacggtgaatactacctattcgctgctgaaggtggaactgtcttcactcaccaagaagttgttgctcgttcaaagagcttggatgagaagtcattcgtggttgagcctgatggcccattcttgacgaacttcgacacaccatactcatacttgcaaaagcaaggacacggtgccttggttgacacaccaggtggtgaatggtactacgcttcattgactgctcgcccatggaaccacgacactgagtcatcaactgacccacgtggctggtcaactttgggacgtgagacgtcaatccaaaaggttgaatgggatgaagctggttggccacgcgttgttggtggtcacggtggtcaaacgttcgttgaagcacctaaggatgctatcttgacagaggcacctgccgaccactcacaacacgatgagtttactgacgctaagttggacatgaactggaacacgttgcgtgtgccattctcagatgaattcggttcaactggtgacggttcattgaagttgatcggtcgcggttcattggtaaactaccacgacttgtcattgattgctcgtcgttggcaagcattctacttcgacgctgaaacgaaggttaagttcgacccattctcataccaatcaatggctggtttgacgaactactacaaccactcacactggtcatggatcttcatcacgaagaacgatgacggtcaaagtgtcatcgaagttgctgagaacaagggtggacaacgtaacggtacgtacacgtcatacttgaaggacgatgctatcgtcatccctgaaggtactgaatacgtttggttcaagacgaaggttcgtaaggaatcatacacgtacgagtactcattcaacggtactgactggactgaagtacccgttgtcttggatgccgcagtcttgtcagatgactacgttgtccaatcatacggtggcttcttcacgggtgcttacgttggtttggcagctgtcgactactcaggttacgacacaactgctgaattcgactacttcgactacaaggaacttggcgacaagcaacttgaagacggatcatactcatgggaagcttcagaatcacgcttcggctaatatctaaagactaactactaaaaggtagcgatgcagacgcgtcgctacctttttttgcgtaaccagaataactttgagaccatcagacaatttactggcatcgctccacaataccggccttaacatgcgcgtaattcgcacacttttattgtgaaaatgttatcaaacactattaacaagtacgtatataaagtgtatagttaactatgttaattgagttgttaacgttttcagtaattgtgaattcgataacgatacagatgcaaatattttatagaaagcgagtatgcaattatgcgtaaaatctcacctcgtttgatttatttctttggagcccttggtggacttcttttcggttatgataccggtgttatctcaggagcaatcttatacgtcaagcggactcttgatttaaccgctcttgaagagggaatggttgtttcttctgttctacttggcgccatgattggggccatgtcaatcggtcctctatctgataaatttggtcgcaagaagatggtcatgttcgccgccttgattttccttatcggatcactcggctctgccttttcacctgaatttatcaccttggttttgagtcgtgttgtccttggaatcgcagttggtggcgcatcagcgctggtaccaacgtacttggctgaagttgcccctgctaagatgcgtggctcattaacatctctgaaccaattaatggtcatgtcaggaatcttaatggcctacatcatcaactacgccttctcaggtatggcccacaccgtttcatggcgttggatgcttggttttgctgccattccttcagccatcttgtttatcggtggcgtcttcctaccagaatcacctcgttaccttggtcgtatcaagaagttcgatgaggctttgactgttttgaacatgttgcgtgagcctgctgaagcacaagctgagttacaagaaatgaaggacgctgatgaagttgaacttggtggtttcaaggaactcttctcaaagttcgtccgtcccgctttggttatcggggttggcttagctatcttccaacaattcatgggaatcaacaccgtgttgtattacgccccaacgatttttaaggccattggcatgggcgatagcgcctcattgatgggaaccgttggccttggaactgttaacgtgattatcaccgcttgggctgtccgcgtcatggaaacccgtggtcgtaaagaatggttgttaatcggtggtgtcggcatggccgtttcattggtcgccctagccattttgacaaacttcgccgcaactggcatcatgtcatacgtcaccatcgttgcgatggcattctacttgattttcttctgtgctacttggggaccaatcatgtggacgatgatcggtgaggtcttcccactagccgttcgcggtgttggggttggtttctcttcattggttaactggggtgccaacctacttgtttcattgatgttccctgtgttgttacaacacttctcaatgcccattatcttcggcgttttcgccgtaatgtgtgcattggcatcattcttcgttaagcgctacgtcttcgaaacacgtggtcgctcacttgaggaaattgaagctactttgcgtgatcgcgctaatgtggctgaggacgacagtgtggtcgctggtaccacaccaatcgcacactagcctttaattgcaacacctaaaccgagtcggttggttaccgacttggtttttatttgctaaaataggtgtattgcgtcaaaaaggaggagctgccatgtcggaaatcatcaaacggatttttaataatcgcgtcattaaaactatcattgacgtttcaatgcgtgttgatatcgtgacggccagttcatcaattgcctacttcggtctcctatcgatttttccggcaatcatcattatcgcaacgctcctgccctactttggcttaaccatttcaacggccctcagctacgtccaaatggccgttccgacctcagtatacgactttgcccgacctattatcgaatcgattctcggtcaaaaaggggtcggcgtgctatcagcttcaattatcatcactctgtggtcgttatcgcgagtcgtcgcatcaatccgtacagcgcaaaacggtatttacggggtacaacctaaaacaattgccattatcgatcgcttcatttcaatggcttggatgattcttgtgttagggattatgggtattctactgatcattgcttcagttggctctaacattcttgaagctttacccatcagcgctaatcttgtgcaacaaatcgaatccgccaaatcaccagtggtcatcggcggtttattcattggtgcgtcgcttttcaactgggttttgccggttaaaaagccccgcttgcaatgggccctcgtcgggacaatcgttcaagtggcaatcgtcatctggttaacaaaaattttcggttggtatgtcagtttagcctcacaggcttatacattctaccaagctttaagttcggccattatcctgttgctttggattaactttattgcactagccgcactaatcggtaccatcgtcaccgcaaccttggaggagttattcccctcgcaaaacgataaattggccgttattcaaacatttggtaagtctattatccgaaaaaacggaaaaaagtgagtgatatttattgttttattaagctagtcacgttatgattaatagtgttgataaggataacttgttaacattagagacagcaacttactcatatcgctgagcttaaccaactcagcaattgtaggtctaaccaacctacaacctactccttaagaattacccagtgtgatggtctaaccaaccattgttataacacgcctaaccaacgtgttttgggaaaaagagtcgtcctcggactgactccgaaaccgcctgcgtctaaccaacgtaggcggttttgttttgcccaattatccggtaaaatcaaaggataaaaaggggaagcattggggattttcattatgacaacatcgcatgagcacgccgtgttagacgtgtgtgcccgtatcgggcgcatcttactagaaagtggcgctgaaacaccacgcatcgaagaaaccgtggagatcatcggacgaacagccggcgttgcaatttcatgctacgtcacattaacggctgttttcgtatcattaacgaaccaacctgaaacacaattaaccaaaacaaaacttggcgcattcaacctacaaaaggttgatgacatcaatcaactctcccgtgaattttcggcgggacaggtgtcatttgatgatatcgtaacgcgtgtcgccgccatcgatcagcacgtgattgatttcaactggccgactaaaattttgggtgctgggctcgtgtccgtcgcacccatgctggtatttattgccgattggtcagatttaggcttggcctttttcattggcatcgccggttacttaactgcgcaactcgtcggccgcaaagccacggccaccccctacgccaaagaagtcgctgggggatctgtgattgcattattggcgtggggcctagtcgctagcggtattggccaccacgctgaaaacatgattgtcagtgccgttatgcccttagtgcctggcgtcgcattgacgaattcaatgcgcgaaattatggccggtcatatgatatcaggaacagtccgggcccttgatgcactcttaatcgcagccgctatcggtggtggcgtggtcttagcaaccacactcctgcacttatgcagcatcatttaggggggcatcatgacatatttaatccaattcatcattagtttcgcatcgacggttggctttggcattatcacaaacatcccccgtcgcgccttaccaacagctggtttaacaggcggcaccgcttggacttgttacatcttcgtccaacacttacacgcaaatgtctttctcgcgaacatgaccgccgccatcatcatcggactccttggtaactggtttgcgattcgcaagcgggtgcccgttaatatgatttacatccccagcttagtatccctggtgcccggcggtactatctacctcgcaatgaaaaatttctcgctaggccattacgccaatgcacaagccggcgtcatcacaacggtcacgattgcagttgcactagcagtggggtttgttttagccgaagttattgtccgacaaatcaagcaacacttaagaagtcgtcagcaagactcacttgcccgataatcaaaaaacacatttaaaaggtcgccgatcatcccattcaactgggtgattggcgaccttttatacttaaccatgccactcacacgtcaactcgtgatcattaatcaaaccagcagcctgcatgaacgaatacaccgtgacaggaccgacgaatttaaacccataggccttcatggctttagacacactttttgataagtcggttgaactaggcatttgcgtataatcaatcacacgattatcaatcggtgttcgctgcacaaatgaccataaccaggcatcaaaagaaccataatcatgctgaatccgttggataccttgcgcattcgcaatagttgctgtcaatttttgtcggtgtcgaataatgtctgcattttgtaagagcctgtcgatgtctgtcgccgtcatttgcgcgacctggtcaatatcatattgggcaaacgctatgcgaaaagccgcccgcttatgcaaaaccgtctgccaactaagccccgcctgataggtttccaaactcaacaattcaaataactgctggtcaccatgggtcggacgcccccattcgtgatcatgatacgccgtcatcaagtcatcttcaccgtaattcgctacccaagtacatcgcaccaccataatacccctccaattcattaagttaaacctaattgtaaattaaaataaaaccgctaacaagtctgttaacggtttatagcgcttttagtgcatgtgcaacatgccggcagcgcccaaggcaaggactacgataccaacaacaatacggtagtatccaaagaccttaaagtcattatttttaatgtaattcatcatgaccttaatggcaaagtaagccacaatccatgaaacaataaagccgacaaccataacgccagtttgggcacctgtaaagccaccaccacctagcaagtacttacccaccttcaaaatagttaccccaaacataactgggatactcatgaagaatgagaattcagcagcaacaaaacgtgacgctcccaaaattagcgctcccaaaatagttgatcctgaacgtgacgttcctggtacgattgatagcacttggaacagcccaatgaacaaagccatcttgtatgacatggcattcaaatccgtcaaaatcgcattcttgtttgccaagtaacgctccacgacaatgaatagcacaccataaacaatcaacattgctgccacaacccaagcatttagccagtgggcatccatgtaatcgttcaaggccaatcccgcaatcacggccggcaagacaccaacaatcaccttaaaccaaagcgtccatgtttgacgcttttccaaagatgactttgatggtgaaaaagggttcaacttcttgaagtaaagttgaataaccgcaaaaattgcccctaattgaatcgcgtaatcaaacatcgccgtgaaactcttagtccatacggccccgcctgggatgttcatgaatgactccgcaataataatgtgtccggttgatgatactggcaagaattcagttaatccttccacaataccaatcaccaaggacttcaacaaatcaagcatgtcttgctccttatttttaaacttatcgctattacaataccagaaaaaaagcgttgcgcctatacacgcaacgccttctttaccccggcttaattgacgtgaatatcaccatctgtcgcaataatactcaagcgatctggtgccgtttcattttcgctaaattgaccagcatacttggttcccttaaccatcacatcaccatcagttgtttgcaattgcaacccaccgaattgggcttgtgcggccttaaagtcaccatcacgtaaggtaaatgtattcacccccgtatactggctcgcagtcgtcgtcacatcaccatcgttcacttgcatcacacttgcattaagcgccgtatgattcaaatgcacatcactatcagtaccagataacaataacttacccaattcaccattttgcaccgtcaaatcagaatcgctcatgctaatcgttgattgcttaaggacggcatccgttaagtgcacgctaccatcacggttagccaccgtcatatctggggcagtcaaattatttaacgtaatatcacctgcagtggcgctaattttaactgtcttagccgtcaaatcctttaacacaatgtctgacccgactgacgtttgcttaaatttatcaaacggcttattttgcggtacgctgatggtaatgtgttccggcttcttttcgccaaagccaacgcccacaccattatcattttccgtattgtacttaacatatagtgtgttatgccgcaccgaaatatgtaaccgggctgcatcacgcacactcgacttcaccgcatacgtatcatcgttattcgtcactaaccgtacgtcaatatcctcagtgttaatattgaccgacttaaacgccttcacttgttgattaacagtttttacttgtggcaccacaaaatgcccatcacgccagttcaagctattttgaccatcgtttgacaagccaacaaacatcaaaacgacaccgacagccgcaatcactagtcccgtcagtatccaacgcatcatcttaggcatgcttcgtgcctccttcttgcttacgtgagaacttacggccaatatacttaacaaagttcattaggccaccaaagattacgcggacaatggcaaagccaattggccaagcaataaattggagaccaattaaaatcagcccaataccaccttggtacaaagccgtttgccagcttgtcccaatgatggcaaccgccccaacaacctggaacaaaccagttgctaggaataccaatagcaacataatcaaaaatacggcaatcacaatgacgataaacaagcccaacaaaatcagaatcattgctggaatccacacaacggaggttaccaaaccaaccaacacaacccacaataagttgaattgtcgcccgattcgttcacggaaatgatgaactggtgtttcattctcttccggtgcatcttgatccgccacatcatcgtagcgaattgagtaatctactaatacgcggcgtgccaattgcttaggcgtgccaaattctcgaatcaacgtttcgccggtcaaacctgcgtctgacgcatattcacgataaaaatccaacacatcttcgcgttcttcatcagtcaaaccaaccaagtggcccttcagttgcgtgaagtaaatgttattttccatcaaccttttccccttctgccggcatcattaagtcgttcacattgtgactaaatacccgccattcttcttgcacacgcgtcatttcagcgcggccatcgtctgatattttgtagtagcgtcggttgcgtccttcaaaaggttcatcataagttgtcacccagccttttgcttttaagcgtcgtaacactggatacatcgttgactctgaaactgaaaagcgttcctgaacttgtttcgtcaacgcgtagccatataaatcttccgatgacagcaacgacaagactagtccatccatcagatcactagataattgcatcgccatggttcatcttcctttacaatactataactcatataatatactctaagtatagggaacgcagggggttgtgtaaagcattttgctaccccctttaacaattcactttgggttcatatagaaagaaggttttcattatggcaagtaagaaactaacgaagtcaaacgacaaagtctttagcggggtacttggtggtgtcgctgactatttcaactttgatgcaacgcttgtgcgcattatctttgcggccttggttgtattcaccggctttttcccaatgggtattttgtacatcattgcggccgttgttatgcccgatgccccaactcaccacgaatacgagtttaaggatgacagtcgcaaggacatcaccccaaaccgtttcgacgacgatatttaataggcttaacgaaaaaacaccgcgcgatgcggtgtttttttgattggtaatatggatgatcatcaatactcccctagaatatctcaggtgctgcaacaggagtgggttgtgcggtagcacgacaccaacacaaaaatgagcgtcaccgcaaatgcagtgacgctcattttttacactttaaatttgtttaccagctgaacaatccaaccatcgccgctgacatcaatgataccaggatacctgataccaaaatcaatggcacgttagctgcaattagttcggccttttcacgattaaccaagctcttgtatgaaccgataatcatccccaatgttccaaagttggcgaaactcgtgacgaacactgtcaagacagcgcgcgcgtgagctgacgcaaacatacctgagtggtgagcaacttgctttgagacttctcccatcaccacaaattcgttcgtcaccaactttgttcccatgtattgggcgatacggaaggcatcatcgacgttaaagccgagcaaccaagcaaatgggaacataatgacaccgaagatattctccaatgataaccatgacaacgtcgtcaatgacaacaagttgtcgatcaaagaagccaaaccaacaaaggcaattaccgtcgccacgataataaccgccaccaaaccggcaccttggattgaatcacccaagaacgcaaagaatggttggcgcttaaccttaccatcctcagtcgtttcatcgtgatccaataccgcgattgtatcatcagcttcggcgacttgcgttgggttcaagattgtcgtcatcataatagcgctcaagatgttcaacggaatcgccgtcaatacgaattgaccaggcatcatcccaacgtatgacccaacgatggcggccgttaccgtactcatcgacatcatggcaaccgtcaaattacgcttagcgtccatttgttgcagttgcaacttagaaacggccagcacttcagtcgtgcccaagaacatcatttcaactgagaaaaatgattcaaacttaggttgtcccgtcaaaaatgacaaacctcggccgacccacttaaccaaccatggcaatacaccaatgtatgtcaaaatatcaaacattgggataatcaccaaaattggcaaaacggctgacgtcacaaaattcatcgttcctgatgcaggcttgacccaatcaggcaacgcaaaggcaatcccgtcaaaggccgcactggttaaccattcaaatccattcgctgcgactaacacagcatctcgaccaattgaaaaactcgtaaagaaccaagccaaaattaattggataaccaagatgacaccaactgaacgccacttgatgttcttacgatcacgtgaaaataaatatgccacccctagaaatacaaagattccgaggatgttcatcaacaatagcatgtgctacttctccttgaggggttcttacttatgtaaaataacttaacaaactaagtgtatcaaaagtaaggcctttgtaaaacggttaacctcgataatccgtccggtaaaacgtttaacgtaccaaaattaactaaaaaaactgttgcgcatgccacacaacagttcctttttacttatttttgaaagccaaccgctgtgatattcgttggttgggcaatatgaatttcagggtgggccataatgtagtcaccaatcaattcagctgtctctaactgcacttcacgcacaatcttatccgtactaaacatcgtaaaattacccgccccaccggcacggtagttattcatcgccacctcatacgttgctgccatatccaagggttgcccttggtacgatactgccgtaactcgatcgcctgctggtcgactaaaatcaaacgtataatcaataccgctccaaatatcatagttgtagtgctggactttcggctcaataaacagcggattaaccgtcaacgtaccatcggctgccactgcaaagtaacgcccgtttacctccagtgcatccttaatatcttgacctgtcagtgcttcaacaactaatgtattcggataaatatagttagtcataatatcacgtaacgtgacatcattcgccaagccgcgtacttcatcattaaataatgccgtattggcgatagtcgtctgcgttgcgtccatttggacacggttaaccaattcaataaacgggtgactgtggagacgcgccgcaaaatggtcggtaatgcgcatgttgtcaccgaccgtaccaactgccgtatcaagccattgattcgtttggctttgcaatggttcgattagcgccacgatatctgcccgttctgcggcatccgccgtcttgataaggctggcttcccgaccgacaaccgtctgttgctcatctagatcaagggtgattagcccaacgttatctgcccggtaccccggttgtgtcgtcggtacaccatccgcaacttcagcaatcattcggtgttggtgacctgtgacaagtgcatcaacacctggcaagtgcaacaattgatacccttggttttcagaggtcaggcgttctagcggctcaccagtttgcaaatcttccgcaaagccaccgtgataggcaatcaccagcacatcaacttgggggcgtaactcagcgatatagttttgggccacttcaaccggatcggcaaataataatcctcgaatattatcagcctgttcccacttggccacatatttggttaacaacccaatcacaccaattttaacgcccgcccgttcaaaaacagcgtacggcttaccaataaacggttggtgtgtttctgcatcaaggacattcgcattcaagagttgtggcgtatccgccatcacccgctctaaataatcgcgaccgtaattaaactcgtgattcccgaagacgcggacatcatacccaactgaatcagccaattgttgataaatacccgcggcctctggcgcttgtttttccacgtaattcgtcagtggggaaccttgaataaagtccccattttcaatcgttacaaccgcttcgccatgtgacgcccgttcttgtagtgctgcaataaccgttgccgcacgtgttaagcccagtccgtcatttaataatggtcgacgaaaatcatccgctcgcacataaccatgcacatcagacgttgaaatgattgatactcgcatctcttatatccccagtctattttatgtacaacaggctgccaaattaaattcagcagcctgttttcacgcatttttactatgttatattctaagctactttggctgttaaaccaactttttacggagttgacctgacaagaaatcaatcaccgtcaccatgataataatcccaagtagaatgatccctacctttggccactgacgtgtttgcaatgcaaaaatcaaaggcgctccaattccaccggcaccaaccatacctaagatagctgctgaacggaccgcaatttcaaaacggtataacgtgtaattcataaactctggcataaccgctggcaaagttgctaacgttaacccatcgagcgccgaaccaccggctgcgacaatcgcttcattcggtccacgatcaatgttttcaaccgcttctgagaatagctttcccagcataccaatcgagtgaatcgatactgccaagacacctgcatacgcaccaggaccaaccgccttgatgaacataatggccaacacaatttcagggaagacacggacaattgtcaaaattaccttacccaaggttgaccgtggtgtgaagaaacctttcttcgttcgtgcagctagaaacgcaaacggcactgataaaatggccgaaataaacgttcctagaaaggcgatggctagcgtttcaaccaacgccgtcaccaaatcttcgccatcccctgtataaacgtatgaccaatccggatggaataagccatgaaaaatggccttcgtaataatcaatgcttgcggcttaaccgatgccaatggaatccccgaaaaggcccaggcaaagatcaagaccacgactgccgtaatcacccaaggtcgaaatcgttgccaggggctttgttttactaattgcattatgccaacgcctcccgtaatcgattagaaataccatccacgataatgaccacgaccaagattgccaaaataacaatcgccgtccgatcgtagcggaagagcgacaacgtttgactcaagtacaatcccacaccaccagcacctagataacccaagactgtcgatgcacggacgttgatttccaacgtgtacaggaagtaactcaaaaattggttaaacacctgagggacaactgcgaagacaatcgtttgaatgctgtttgcgccagctgcagtcaaggcttcgatcggcccgtcgtcaatcgtttcaatcgcttcatagaacaactttgaaatcatgccaaaactgaacaccgtcaaggccccaactccggccatcggtccaataccaacaatcgccacgaacaacgccgctaagagcaaatcaggtaatgcacgcaccaagttcaaaaagaaccggatgatgccacgcgccacagcgtttttcatgatattacgtgctgctaacaaactaaatggtacggcaataatggtaccgagcaacgtcccaaccaaggccatttgaatcgtttctaagattggtgtcacaatcgctgacacgtatgaccaatctggttgcgtcatcttaatcaagatttgccaaaattgatcccaactaaaatctgtcgagacacccgtcatttgccctgacccaaataggatcaagatgacaagcacgactgtcagtaagcctttaatatgccatttttgactaaactgacgctctggtaataatgattccatgactactccttatctccagcttcagcataaataccgtcaaagtcgtgttcattaacttcagcaattggcttatcataaaccaacttacccgcacgcaatcccacaatccgggtcgcatacgccatcgccagtggcacactgtgcaagttaaccaccaccgtcatcccgagatctcggtttagatgttgcaaatcatccatgaccatcttggtcgttttcggatccaacgacgcaatcggttcatcagccagaacgaccgttggcgattgcatcatcgcacgtgcaattgccacacgttgttgttgcccacctgacaattcgtcagctcgtgtatagtatttatcaagcatattcactttattcaagttttcagcagccttctctttatcagcttttgaaaacaaaccgaacgtactcttgaacgtcgagtagtatcccacgcgaccagccaaaacgttccgggccaccgacgcgcgcttcaccaaattaaaattttggaaaatcatggcaatattacgacgcaacactcgcagttggctgcccttggctttggtaatatctgcaccatccaataaaatctcacccgctgtgacatcgtgcaaacgattgatcgcccgcaacaaggtacttttaccagcccccgacaggccgacaatcaccacaaattcacctgaagtaatatctaagttaatgtgatcgagtcccaccgtcccatttgggtaaacttttgaaacatcttttacttggattgtgccagtttggcttgccatattcattcccctgatcgttttacttaacaactaatcaacttgcttaatcgttttaaaaaatatgtactaagaacgagcttcaccggtaaaacacaccaccaggaaactcgttcttcatttttcatcgctagtagtcatcgctaaacgtaaatcttgcgtgaccgacctgctttatttaattggacttagttgataccttcaacagccttttggtacttacggacaacgttaaagtttgaatcctttgactttgcaacaccagcccagctgtatacatcgttcaaaaccttcttaccttcggttgtctttgacaccttaatcatcgcgttttggattgccttagtatcagcctttgaaatacccttacgcaaggcaatagtatcgttaggaatcttagctgtgtatgtcaaaacacgcgtatccttaaagacatctgggttatccttcttaacaacgttacgggcgtcatcaaagacgaaggctgcatctgtgtcaccgttcattactgatagcacaccttgatcgtgacccttaactgtcaccagctttgcgtccttcacgacgttgacacccttcttcttcaagtcaacaaccgggaacatgtacccagcatcggatgtcgtgtcttgaacggcaatcttcttacccttcaaatccttaacagacttaatctttgagtccttcttaacaagtacttcggcacggtagtaatcaacaagcttgtcggtgtttgaaccgtcccccttcttgtcgttaatgccgtagcgttgtgattgcaagataacctttgcaccgtattgcttgtgagcttgtacatatgggtcaggtggcaagaagcccatgtcaaccttctttgaacccattgcctcaacgactgtgttgtagtcagttgagatcgttacgtgaactggaatacccaattgtgccttcaacaacttctccaatggctttgccttggcttgaattgtgtcagcttgtgatgatggaacgaattgtacattcaactccttcaaatcaacctttttgtcagcagcgttaactgatgccgctggcaatgctgtaactaatgttgaggctgcaatcgtaactgcagcacccgcaacaagctttttaaacatgtcccctagtactccttagctatctgttcctaattatcattacccaaattggtaacccatttaaaggttgtattaaggataacaacgaacattatttacgtcaatatcatatttgttcattttttgacgttaaacgttttaacaaaaacaaaaattacgattattagttcgttttatgaagttgtccaatcccttctacatgtattagactactcgtccaatatttaggcttaattgtgatttctttttgattcagtatgcgttttgtaaaaggcaactttacaattaaaacttctaaacaaaagaggttggggcagaaatttctgccccaacctcaaaagccgccaatctcccgatttaaaatcggaggattggcggcttttaaacgtgttccgaaaggctgaccccttaatataacgccatttgacccactcacacctctacgctacgctccaaggcataagcaggtcaaacaacgttatcatcggggccaaagcgcctttcgtctcactctcctattaacatttatgacaagaccgtcccatttgaggcgataacttgcttataccaatcgaacgacttcttcttcgaacgcttcaaagatccactaccgtcgttgttcttgtccacataaaccatcccgtagcgcttagtcatttgacctgttgaggctgcgaccaagtcaatcacaccccaggcaatataacccatcaatggcacaccatcagctattccgtcggccatcgccttaatgtgctcgcggaaataatcaatacggtaatcatcattgattgacccatcagcagcaactgtgtcttcagcccccaaaccattttcaaccaggaacagtggcttttgataacggtcatataactggttcatcgtaatgcgcaagccaagcggatcaatgacccacccccacttactcgttggcaaataaggattcttagccgacttcacgacgttaccttcgttggccgtcaactcatctaagttatgcgctgatgtacgtgacgcatagtaactaaacgacacgaaatcaacggtattctttaagatttcttcgtcaccgtcggccatctctatcgcatcaacccccttagaagccaacaaactcttcatgtatgatgggtagtaaccgcgtgcctgcacgtcaataaagaatgtattgtcgtggtcatccagcattgactgccaaacatcttccggcttactcgtgtaagggtagaaactaccgcccgcaatcatgcacccaacttgggcggctggcagcatctcatgaatcatcttcaccgttaacgcgcttgcaaccaacacgtggtgtgccgcttgatacgtgacctgcttttgattttcaccaggttggaacgccaacccagcccccgaaaatgggctgtgcaagataatgttaatttcattaaatgtaatccagtacttaactaaatcgccaaattcttcaaaacatgtcttcgcatagcgagtgaagaaagtaatcatctcacgactacgccatgaaccataaccagttactaagcccattggcacatcaaagtgcgccaatgttaccaaaacttccataccatgctcacggcacgtttcgaataatgatcgataataggcaattccttcaggattaggcgtctcttcatcaccatttggatacaagcgactccatgaaattgatgttcggaataccttcaaacccatttctgctagcagggcaatatcgtccttatagcggtgataaaaatcaattccggtatggcttggatagtacagtgtctcatccaattcaggttgcgccacttgacccaatttcaccggcatccgcttgtcgccaatgggcaacatatcaatgttactcgtaccacggccgccttcatgccaagccccttccgtttgattggcagcaattgcgccaccccacaagaaatctgctggaaatacagtattcgtcgtcataaatctcttccctcttcttcgttaaacttacgccattgctggttctgtgtctgcttccttgtcgtggtggaagacttccatcacatgttccttgaatgaaacgtgaccaggcgcaaccggcgcaatatccttaaattgatctgaatttgtaatcacaaccatcgtcgtcattggcaacccagctgccttaatcgcatccaagtccgcttccaacaactcgtcaccgactgcaacacgatctcccgcggccaccttagccgtaaatggttcaccattcaatgaaaccgtatcaataccgacgtgaatcaacacttccacaccattatcgtctgtcaatccgatggcgtgcttcgttggaaagaccgttgtgacagtccccacaattggtgacacaaccttaccatcttccggatcgattgccatccccttaccaagcaagccctttgagaacacttcatcagcaacatcgtgcaagcccttagccataccagtcatcggcgccattagcttaacgctgccgtcattagtcatatctgcttcgtcatcttcgaccggaatatcttcaaacccaataatcaacgtcaaagcaaatgacacgactactgaaatcgccataacggccgcaatccacaaaatgctagttgggttgtccttatcaataaattgtactgacgtaaacaagcccggcgctgccattgagtgggaagccaaacctgccaaacctgcaaccgcaccagcaataaagccggtaatcactgaagcaatcattggtcgcttcaaacgaattgcaacaccatacaaagctggctctgtaattcctgcaatcaaagctgatgacgctgccgccaaagccgtttgacgcaattcgcgattcttcgtcttcattgcaacggccaacgaagccccaccaagtgacatgttagcgccaatttcagatggcataaccatggcttctgaacccgtttcggcaatcgtcgtcacaatcgttggtgtaaacacacggtgcatccccgtcatcaccaacaatggccaaatcgccccgacaatcgcaacagccaaccagccaagcttaccgtgaataccgtaaacaacggctgagataccattaccaagccaaacacccattggtccaaccaatgaaatggcaatcaccgctcccaccaacaagatcaacattggcttcaagaagttcttcattaccactggcgtaatacgatcaacacctgcttcaatgtaacgcaacaaccatgccatgacgatggccggaataatcgtgtacgtatacttcactgacgtaattggaatcatcgccagtgtcacagcttgaccttcagccgccttagccatcaagtccataaatgctgggtgaaccatcaacccggcaattgcgacagccaagtacgtgttcgtgccaaatttctttgaggctgataccgccaccaaaattggcaagaagaagaacgaggcatccccaattgtatttaacaagacatacgttgatgaggtttcgcctgccacacccgtcatgagtaatagcatcgcgagcaacttcaccattgaccccccgataatggcgggaatcagcggtgtcatcgtcccaataatggcatccaaaatcgtcatacctacgcgctttggcgtccacttttgcttttcctttggtgcatcatcttgtgcaacactaccttcaacaccaagtggcaaaatttccttgtaagcagccgccacattattaccaataatcacttggtattggccgccttgctttaccaaacccataacacccggaatgttcttcactttggcatcatcagccttgctctcatctttcaaaataaagcgcaaacgcgtcatgcagtgtgtcaaattcgtaacgttttcagcgccaccaacaccggccacaacattgcgtgctaactttttaaagtcttgtgccatgttttcttacccctattaactaaaaatccccgtttgtttattacatacttaatgatagcgtttacattcgcgcaattattgggcgaattatgcacaaaatgtgaacacgcatgtgcattcgtatgtttaatttcaatcattttcatgactttaccatgcttcagacatgtaaatgatatgtaactccccaattacattcagttcagttgcacatgctgacaagttcagtctattgtagacgtcacaaaaatgcaaacgctttcatttttcaaagggccgaaattttcggctagaaaaaaagaacgagactagggattttatcctagtctcgttctttttcagtcattattgaccataataattggttgttgctccggtcgtatcagccgtcgtccccgtaccatacgtcgtggcaccagtcgttgcgtctgtatccgtcgctgtgctactgtcatccgattcagaatcatcaatatcagaagcacccgttgttaccaaaccgtttgccaacaacgttgccgctgtgacttcaccaccgtacatgttacccgtcttcttgtgcttcaagcccaatgacttgcgcaaaacattagttacacgctgcttttcttctggtgaaatcagctcagaagatcccgaagacaaggtcacttcagttccttgagcatgatcagtcttgatattcttcgcagcactcaagtacttcgaaataattgtcgtcatatctccaaaggtcaaatcagtcttcgttgaatctgacaaagtatccaagaacttcgcattcacaagcttcgtcggattactctttgccttatcaacgattgcttcaagcaccatacgttggcgctcctggcgaccgtaatcaccttgcggatcatcataacgcatacgagagaatgccaacgccgccttaccatccatcttatggtaagtgtgcgtcacaccgtcttgggccgtaaacgtgtacgttgatgatcccttcttgaagctaaacaagtatcctgcgtcatcatgcgccgtataagggttatacgcaaaggtcagcggtgactttaccttcacaccgtcaagttcattaatgaccttttccataccgcccatgttaacaagcgcgtagaaatcaatcggtacatttaaccaatcttgaatggtttgaatagtcgtcttggctgaaccaaattcgtaagctgaattcaacttttgtgggaattcatcctcataaccaacgggggcaatcaccgaatcacgtggcaatgacataatcgtcactttatccagctttggattaacggtcacgagcatcaatgaatctgtacgccccttatagtcacgtcccagttcccccgtatcagttcccaatagtaaaattgagaatggcttaccgtctgacaacacatctgacacgtcgcgggcttttttcaaaccagtgctttgataagcatcatccacagcgttctttgtattattgtaggcaataccaaacatcactcccacggccaatacaatcacagctacgaccgccaaaattgtattacgtacccgcactttgtcgaactttggcccgtcccctttgggattcatattcggcatccgtaccttactcagcgggttattagccgcacgttctgcctctcgacgcgcagaacgtgaatttggctcattatccatgagcgtctcctctcttacctggtcagtaaccaggcaatcaactttcttgactgttttagttatctttttaatattacgagctagaactttaatgaaacttatcgtaacctattcattttaatacaaaaaggacgccccgtcagcatatctagcaacggagcgtctttttcatgtctattttttaaacagctactggtgccttaatcgactttgccggcttatagccttctactttaatatcatccatcgtatagtcaaaaatcgattttacatctggattcaatactaattgtggtaattcaaccatctcgcgtgacaactgttcagtcacttgtgcaatgtgattagagtaaatgtgggcatcccccaacgtgtggacaaattcacccgcttcaagccccgtttgtgcggcaaccatatgcaacaagagcgaatatgacgcaatgttaaatggcacgcccaagaaaatatctgccgagcgttggtacagttgcaagctcaacttgccatcggccacataaaactggaaaagcgtgtgacatggtggcaatgcttgtgatggcacatcttcaggattccacgccgtcacaatcaaccgtcgcgaattagggtttgtcttaatttggttgaccacatcgtcaatttgatcgataaatccaccctgcaccttacgccaatgacgccattgcgcaccataaacatccccaagttcaccatattgcttagcaaatgcatcatctgctaggattcggtccacaaacaattgatgttgttcatcatattgggccttaaacgcttcatcgactaaggagcggcgcccaaaatcagtcatatctggaccagtgtaatctgctgattcaatccagttcttaaaggcccactcatcccaaatatgattgttgtgttccaagaggaatcgaatattggtatttccttgcaaaaaccacaacaactcactcttaatcaaaccaaacggcactcgctttgttgtgagcagcgggaaaccctccgccatgtcaaagcgcatctggcgaccaaaaagcgaccgcgtccccgtccccgttcgatcacctttggcatgccccgtctccaacacttcttgcgctaaatctaggtatgcttgttcattctgactcatcagttctcctccatcacgtacttttcaaaatcgactaactgaacatccgcttgcgtcaatggcacttgttgcaaggcgacatttttcgcctcaattaatgacattgcaaattcgtcattattataattacgcaaatagtttattttcttaatacctgcttgtaacaagaacttcgtgcagtggacgcacggaaaatctgtcacgtagatttcagcaccttctgccgcaattcccatctttgctaattgcattaaggcattttgttcggcgtgaactgcccgaatgcagtgtccatctaccagtaaatcaccaacttccgtgcaatgtggtgtgccggttagtgaaccgttatagccactcgcaatgattcggccatctttaacgactaccgcaccaacgtgtaggcgtgtacaggtactacgtgaagccagcatcgccgcttgcatcataaaatacgccggccagccaattcgttcgtctttcattatcgcattcccctcttgctgtgtttataattcaagattaacagaattcacgaactatacaagtcttgacttattgcatagtacggcaattaatcacgtgacatttatcaaatgttcggcgaaacacaacacaatcagcaattgctaaatcaaaacgtttgcttttccaacgattctcccaaaccacttgttgcgctattcgggattatggcattttgtacccagaactttatcattatctctaaaaatctaattttacaaaatgcttgataaaattattttgtattgttaattttctttttttgtgctaaaattaacaacaggtttggtgcacactttttgtgcaccggttttacgcagcgatttcatttgtcgctggttgtgaggacagcctcacgaaaggagtgccttatgcctgcagcattagcagaaattaagcaacaattagacgatcacatcggcgagccaattacgttggttacccacgagagccgccaccgtacgattgagcacgaagctgtcgtacgcgaaacgttccgttcagtattcgtattggacttgaagcaagatggtaatgaatttgaccgtgcttcattcagctacacggatatcttgacggacaacatcgagatcactttcgcctaaaaattaaaatccctgagcgacaaaatttgtcgctcagggattttttgttacctattattcagtttccgcatccggcgccacgtcatttgatcgacgtgagacttcgaattcgttaatatatgcatccttgaagtcgagtggcttaatgtcaaagtctacgacgcgaattgcttcacccacagttgggtttggcttttcttccaagaagtaccccgttaacgtcaccatttctgagtcatcaaatgggcgaatatccgtgtggaagtatcgttcgaaatcatacaacgtcatcttaccagataccttatagtgcatgttacccttttcgtctgatcccatcttttcgactaaatcatccgcaacagcgtccatttcatcacgcactgagccaaacagctcttcataaatatccttgtccgtcacaatacctgacgtaccaccatattcatccttcacaatcacaattggcgtccggcgcgcaatcatctcttgcaaaacatcttgaattggcatattttcagaaatcgttggcatccgacgaataatcttacgaactgaaatttggtcattcacttgcgactgacgcatcaaatcgtagttaaagacgtaacctaaaatcttgtccttgtcattatcagcaaccactgggaagcgtgagtgcttcgtctcaaaatagcgttgtaacgtatcatgcaccgtgtctgtaatatcaacaacatccaattgggtccggtcaatcataatatctgccgcaaccttgtcattcatttcaaaggcacgttgcataaagacgtaatcttcttcatccaattgtccactacgcgctgcggtacgtgacaaactcaaaatttcagcttctgagtaaacttcatcgccttcactagctggcttcataccgaacaagcgtgtgacacctgtcgcagagacattcagcaaccacacgaatggatagaaaatgatgtggaacaagcgcaatggcgttgccacaaataatgacaccttaactgggaaatcaattgaaacgtttttgggcaccaattcggtaaagaccacctcaacatacgtcaacaaaaccaacgcaataattgaagcaatcacacctgagcttggacccgtcattttttgcaaaatacccgcatccaacaacaagtgtgcaatcgtctcttcacccatccaaccaagaatcaaaccagacaacgtaattcccacttgggtcgttgagagatactcattcaagttttcaaccatgtgaatcgttgtcgcaattttacgcgagggtttttcgcgactttcttgcaactcaattagcgcacttttgcggaccttaaccaaggcaaattcagccgccacaaacagcgttgcaaatagcaacacaataataatgacaacaactgaaccccataattgtccttcactcaattttatcttcctactttctttttatacatattcaatgtcccaattataacaaaaaaccctgataggtatcagggttttgcttacatgcttaattattttgttggtcttcatttgaagcatcatcaacttcagcttcaggcaaagccacgacctcaaactcttcaatgtacgcatccttgaagtccaaggccgtaatttcaaagttattaatcttaatggcttcaccaacttggaagtcaggatgatcgtctaggacatatcccgtcaacgtcaccatttctgaatcttcgaaagacttgatttctgtcttaaagaatcgctcaaagtcgtacaacgtcatctttccagacaccttgtagtgcatgttaccatcttcgtcagaaccaagcttttgaatcaaatcatctgagacatcatcgatttcatcacgtaccgtgccgaacaattcttcgtaaacgtccttgtccgtaacgatacctgacgttccaccatattcgtccttaacaacaacgattggggcacggtgttcaatcatttcttgcaacacttccgtgattggttggttttcagaaacgactggcaagttacgcaacactgtccgaacagaagcattcatactcaaacggccctgacgaaccaaatcatatgaaaagacataaccaaggatcttatccttatcattatctgccaccaccggcatacgtgagaacttttcctcaaggtacaagttcaacgcatcaccgattgtatctgtgacattaaccactgttaattgcgtacggtcgatcataatatcaaccgccaccttatcgttcatttcaaaggcacgcttcatgaacgtcaaatcttcttcgtcaatttcaccagcatccgcggcgtccttagacaaagacaaaatttcattttcagaataaatatcttcatcgggatgtgcattaaatccaagcagcttcgtaacccctgcggccgttcgatcaaacaaccaaatcaaaggatacaaaacaatgtggaaaaacatcacgggacgcacaatgaacaatagcaccttaaccggttggtcaatcgcaatgttctttggcaccaaatcggtaaagaccgcgtggataaaggtaaagatcaaaattgccgcgatagatgccacactgtgtgcaatagctggtggcaacacacctgatgagataatcaagctggcaataaacgcctcacctaaccagcccaaaatcaatgacgtcagcgtaataccaacttgggcagttgatagatactctgtcatgtggtgtgtcatgttaatcgcatgtgttaaattttttgatggtcgcttacgtgcctcttgtagcgcacgcaaggctgaaggacgcaccttaaccagtgagtactcagtcaatgtaaacaagactgccagcaacaaaatgataataatcacaacaatattggtcataatagacggaccggaatccataatttttttacctcttctttaataaaaatattttgtaataagaaatattatagcaaaaatcaggcgttgtaaacacccgcatcaaataatgcgttatgtagttcaacaaatcgctccaaagaaagcttttcagcacgggtccgtgggtcaagatcaatggccgccaacgctgccgttaacttcgcctgcatcgcttcacccttaccaaatgacgttgttaaattgttccacaaagtcttacgacgcatgacaaagccaatcttaaacagctcaaataagcgcttttcatcacgtggttgaatggccaatggctcacgtggcgtcaatgagataattgctgaatcaacgtttggatttggcacaaacgctgttcgtgaaaccgtaaaggccaatttcgcattcatgcgatattgaacggccaaggttaatgaaccgtaatcctttgtacctggttcagctgacaagcgatcagcaacttccttttgcatcatcaccacgatattatcgaaatgaatacctgattgcaaaacttgcattaaaatcggcgtcgtaatgtagtatggcaagttggcaaccaacttcaatggtgcggtcacatcctcaaattgcttggcaaattccttttccaaatcaaccttcaaaatgtcattgtgcacaattgtgacgttatcatatggtgccatagtgtggtccaaaactggaatcaagcggtcatcaatttcaaaggccacaacttgcttagcggcccgggccaactgctccgtcaacgccccgataccaggtccgatttcaacaacgttgtcagtcttttgcacatccccagctgccacaatatttttcaaaatattgatatcagtcaaaaagttttgtcccaaagacttcttcgtgttgataccaaattggttcataatcgcttgcgtacgcacaggcgtcgcaatatcaggtacatcagacattaattcttctcctcgtccatctcttgcaagacggtgtttaattcttcattcgtcacgccaaacatatttaagcgcttcaacagttgtttgccattaacatatcctaagcctagtcgttctgacacgtgttcacggcgttgggcggcgttggccccggccattaagcctagcctaattaaatctgctcgcgtaatgtcggatgacatatccatatcacttgccgtgtacaccttgcttagcgcctgctgaatatcagctgccgatgcatactcaatgcctaaactatgatgcttgatttggcggccggcctcatcttttgttaaaaaagcatgtttggcatctggcacgactgctgtaatcagcttacgcaagcgctcaccgttgaaatcagggtccgtaaagacaatgatgccccgtgtttgtgcagctcgctgaatcgcttgtaacgtcgtctcagacaaagccgacccattcgtttcaatcgtatctgccgccaccgcatggcgcagtacttccgtatcggccttaccttcaacaacaatcacttctttaatcttcattacttgtccaagcgccacaagcggtgggcgttttctgtcgtaatggcagctaaatcattgtatgacatgccaagttgctcagcaatgttcgcaatcgtgtaacggacaaacattggttcgttttgcttaccacgcattggcgttggtgccaaataaggtgcatccgtctcaactagcagacgatccaacggcactgactgcaatgtttcatggacatccttagcatttttaaatgtggcaattcctgaaaatgaaatatacatccccaaatccaagaattgcttggcttcatctgccgtacccgtaaaggagtgcatcacaccaccaaattctgcgacgttcgcatccttcaaaacatcatacgtatccgccgttgcttcacgtgtgtggattgtcactggcttgtggaactcacgtgccaagtctaattgttgcttaaagaccgctttttgcacgtctggggttgggttttcttcccagtaatagtccaagcccatttcaccaacaccaacaaccgctgggtcagctaattgttcgcgcaaagtggcaatatcttcaggcttaaagtcgccactttcgcccggttgccaaccaacgatggcatttaccccttcaaattcatgagcgatttcaatggcacgttgattaccgattgtatcgtaaccaaccacattcatttcaacgacacgatattcacgtgcacgtgcccagtaagccgccacatcatgccagaaagcttcatcattcaagtgcgtgtgcgtatcaaagctgtctgctggacgctttgttggatcgtaaattgccatgttatctcctaattctaaacgtttgtgatacttactattctatcacagcaaccatgcccatataaatcatgccccttcatgatttgtctaaaaaaacgtccggcgaaaggcatgttaaaaaccccaccactaaccaagaacgaaatcgattaacgatgaggtttttatcctactcttctgagtcagtcgctaaaactaatgcttgtgcagacgtgacttcgttatatagttcattaattaacgctgcactgaaacggtcattttgccgaccatcctgtacgtacgtcaattctgcccctagcgcccccaatagtaccgcttgctcttcagccgtggatacttgttggtcgtggaaacgatcacgttcttgcgcagctacatcgcgcagtgccaccacataacgtggatcttcgtcgcttgattcagcctgcgcaataaattccgtcaccgccggttcactaatttccgcaatttccgtaaataccaattcacgactcgattgatacttggcgaccgcatcttctggactgcggtaattcatctgcttgacggccgcaaattttttctgcatccgcaaggtttgttccaaatcgtgctgctcatgttctgtcagcgtacgtcttgccgccttacgctgtaaccgatcaactcgtcgttgcatcttagctgcaattttatgcatacgttcttcaggtttaatttggcgggtatttaccagtcgtagcaccaccccttccaaaatacggaaccacatccgaacattatttgtaccgcgagcccagcgtgcatcagcattcgctttcacacgacgatagtaaaccatcgttgcttgcgagactaaaccagcatcaatcgcggcatctaccgcatcgtccgtcacctgctgaatatcagtttgcgcccgttgccagagcgcccggtccaattggtcagccccatatcccagctggtcttgtagttgaccaatcacgttccgtttaacagagttagaaacattcagtgtctcaacatacgccatacctgcgttaatcatcgcaatatgtgcttgtgagtactcggtcatatcataatcagcttgtacctttggcaagatccgtggcaagataaacagcggcgcgaccaagctgacaataatcacagtggccgcaatcaagagcaacatatcacggtgcggaaatgcctgaccattcgttaatgtcaacggcaatgaaaaggccatggccatcgtcacggttccgtgaacaccgcctaatgcaaaaatccatgcatcacgatttttatgtgcctgatcaaccattgatgccatcggcgaatcgcggtcgacgcgttcaatcataatgtgcctaaatgccgtcatcacggcataaattgccaaaccaatcccaatgtaccctaaccatgtcacgattggttcatgaagatacgtcctaaatactcgtaccaatgataagcctaacaacacaaacacgagtccattcaataactgtgaaacaatcgttgttaattgattattcaagttatttaattgtgatgacataaattgcgtgtggtgtttttcttcgttcgagataatccccatcacaaccaccgcgataatgcctgagacgccagtgtgttctgccagcccatatacgagaattggcgatagtaggtaaatcataacgtgcgctaccgtatcgtcaaattgggctctcaagagatgctgacggatatataacagcaccaccccggcaagtgccccgacaatggcgccaccacctgcgacgactaagaattcttcaaagccgtggacgaatgaaaatgttcccgtattcatccaaagaagggccaactccagaaccaccaaaccagtggcgtcattgaataatgattccaaatttaaggcccggccaatccccttaggaactgccagcccttctgtaactgactctaatgcagtggcatccgttggtgtgacaattgcggccaacgccaacgccatcggtaacgcccaaccaatggcccagtgaccaaataacatcaacaccacaaccgtcatcacggcaataataccagccaaactaataatggcacggaagtttttagataccaagcgcacgtcagttcgttgaccttcataaaatagcaatggtgcaattatcagcatcataaaccattccgggtcaagctctacgactgaatggcgcaacactgggatcattgccagaataatgccacctaagatttgccaaaatgccttaggtactcgtggcattgcttgcgacaagaggttcgcaataataatggtgagtatcatcggcaccagcgtataaaatattgtcataattctttcctattttcagaatattacagcagatcaggcttctaaaccccatcattactgatcgatacccttattttaacaaaaaggaagcgatgtatcggccatcgcttccttaatttcatgtattaacctagttcagaaccagcttcaatttcatctggcaagattgtcaaaataacattaccatccttttcggcagacaacaacataccttctgacatttcacccatcatcttacgtggcttcaagttagcaacgaaggcaaccttcttaccaaccaatccagcgtactctgggtaccacttcttgatacctgacaaaatggtgcgaccttccttagtaccgtcgttcagcttgaagcgcaacaacttgtttgacttctcaacttcggtaacttccaaaatttcagccacacgcatctcaaccttgtcgaaatcgtcaaattcaatcaagtcctttgttgggacctcgatatatgacgcttctgtctcttcagcaggcttagcagccccaccagtcatctcatcgcggatgtaagcaacttcagcttctacatcaacacgtgggaagattggctcacccttggcaacaaccttaccaccggctggcaaatcttcaaacttcaaatcagcaatttgcaagtttgattctgccaaaccaagttggtggaagatttgctttggtgctcgagtcaaagctggttgcaacaagatagcggcaacacgcaatgcagcggccaagtgcgccattacggatgctaacttgtcagcttgtgcttcatccttggccaaagtccatggcgttgtctcgtcgatgtacttgttagcacgtgaaatcaacttccaaacttcagccaacgcatcagcggtgcgcattgcttgcatgttttcattgtaagccgtgataacatcgttagccgtttgaaccaaatcagcatcgaattcagttgcacctgagttcaaagctgggataacgccatcttcgtacttgttaatcattgcaacagtacggttcaataggttacccaaatcgttagccaaatcatagttcaactttgatacgaagtcttctggtgtaaagataccatcatttccgtaaggcattgcacgcaacaaatagtaacgtactgcatcgatgccgtaacggtcagccaatgtatcagggtacacaacgttacccttagactttgacatcttaccatcacgcatcgtcaaccaaccgtgacccaacacttgctttggcaatggcaagcccaaagcgtggagcatgattggccagtagatcgtgtggaaacgaacgatttccttaccaactagttggacgttagcaggccagaacttatcaaacaacgtcgtgtcatctgatccgtatcccaaggccgtaatgtagttagacaaggcatcgatccagacgtacacaacgtgcttaggatcagatagcacgggaacaccccacttaaaggctgtacgcgtaactgccaaatcttccaaacctggcttgataaagttgctaatcatctcgttcatacgagattctggttgaataaattcaggatgtgacttgtagtagtccaacaaccagtctgcatacttacccatgcggaagaagtatgactcttccttaaccaactcaacttcgtgacctgaaggcgccttaccaccgataaccttaccgttttcgtcacggtaaacctcggccaattgtgactccgtaaagtactcttcgtcatcaacagagtaccaaccttcatactcacccttgtagatgtcgtcttgatccaagaattgttggaaaatcttttggatggccttttcgtggaagtcatcagttgtacggataaagccatcattcgtgatgtccaaatcagcccacaacttttgaatatcagcagccatgccatcaacgtattgttgtggcgtcatgttcaacttttctgctttttgttcaatcttcaaaccgtgctcatcagtacccgttaagaagtaaacatcttcgttcaacaaacggtggtaacgcgctgccgcgtcagccaaaaccgttgtgtaagtgttaccgatgtgcaacttaccagatggatagtaaatcggcgttgtaatatagaacgtgttcttgtctgccattttctttatacctcccgccactacgaatgggtagggcgtcattttttaaactgcaggtgtctcctgcaatgtctgccttttattatatcaaattatggcctaactgagagggcttttcacatgaaccaaaaaatcaaactaatgtctgtacgtcgacgccggcaatcaaccgatcaagttgctcatccgcatgccaatccgtcggttcactgtcaccaaacttaacattatgagtcacggcgtgtgcttcttgatagatattatgtgactgccttgcaggcacaacaaaataatcaccagtttggtacacagttagtttcagttcatcattcgcctcatacgtcgcaagaacaactttgccggtctgcacaatgtagacttcctgatacttttcatgatagtggctattctgccatgcacctgtttgattaacggttctcgtatatgaactaccatctgtagctactaagccaagtcgggcctcgccgtttggcattagccgaaaattcgttttaacaccatactgcgttgcaacttctttttcttccataagacaagcctccttttaaaaaagctggcttttataggtgatattgggccgtcaaggattggccaccaccattcgccacatagccggcaccgcctttatttatcatccgacgtaaagccgttaactctattgaaatttcacttggtactttcgtggcatctgataatttcaaaaaatacaacgagtttgataatttactagcaactgtttgtggtagttgttgctgttgctgatgatccgctttagccatgttcactaatttttcagcctcgggataatctgcaccgtctatctttctcgacatcgtctctaataactcatcaatttgttgatccaattgttttacaccaaatccaaacatatgtaagtccccctttgtgtacgttttaacagtacaccggaattttaacgcacgcaaatacacctgttaacccattattaaatttttttgtatcatatttaggctatgatacaaaaagagcttgagacagtagcaactatcccaagctatcaattactttttaactgcatctccataagctgcaaaattattttccgtagccgtcacgcgcacattaactacttcatcagcaccaatcttatcagccaccttagctaaatccttcaaagccccctctactgacatacccaatccagatacaatttgaatttgttcaagtcctgctggcacttcgccaactgtcattggtaacttaaagtcatctccaccaaatagtcccattacactgtcctccgcctttttagttggctttattgtacctattaatcatcaattttgcagagttggtgtcctgtaacgtccatccttaaaccaccacttgttggtggtttttttgtatcagaaacggtaattaacatatattagtgataaaactgacacaaaaacaccgtatctcacaattaatattgaatttgtgcgtagtctgggcattctttctgatataattgtatttggctagttttttcgagcggtcgaaaagaacatcaagatagaaacgattgctaccgaggtttggtagagagaaaggaagtcacatcatgtctgattatgctgtgaagtacgagttactccacgtggaaaagcacactggtgcacgtttgggtaaaattacaaccccccacggtgaagttatgacaccaatgtttatgccggttggtacacaagccacggttaagaatgtgtcacctcgtgaactaaaagaaatcaagtcacagtttattttgtcaaacacgtaccacctatgggttcgtccgggtgacgagttgattgccgaagctggtggtttgcacaagtttatgaattgggatggcccaattctaactgattcaggtggcttccaagtgtggtcattgtcagaacgcaacaacattaaagaagaaggtgtgacgttccgtaatcacgtgaacggggaggaaatgttcttatcacctgaggttgcgatgcgcattcaaaataatttgggttccgatgtcatgatgcaattggatgaagcgattccatactttgaaacgtatgattacgtgaagaattcagttgaacgaacatcacgttgggctgaacgtgcgttagctgcccaccgtcgtccggaagatcaagccctatttggtattgtgcaaggtgccggtttccgtgagcttcgtaagcagtctgcttcagatcttgtttcacttgatttgcctggatacgccgttggtggtctgtctgttggtgaaaccaaggaagaaatgaaccgtgtccttgatttcacagtgccattcctacccgaaaacaagccacgttatttgatgggggtggcagcacccgattctttgattgatggtgctatccgcggtattgatatgtttgattctgtgctgccaacacgtatcgcacgtaagggaaccttgatgacgtcgaagggccgtatcgtgattacgaattctaagtataagaatgacttctcactaattgatcccgagacggaagactacggttcacaaaactttaccaaggcatacttacaccacttgtttaaggctgacgaattgtatgcgcaaaacattgcgtctgttcacaatttgcgttacctattgaagttgatggaagatatgcgtcaagcaattgctgaggatcgcttacttgagttccgtgaagaagtcatggaaaactacggttacaagaatccgaatgcgcgcttgttctaactattgttaaataaatcctagaggagtgtactactatgagtgctaatattttgattttggtcgtcttcgtggcggcaatgtactttattatgattcgcccacaacaaaaggcacaaaagaagcgccaagagatgatcaacacggttcaaccaggtgccgaagttgtgacaatcggtggcttgcacggtaaaatcgctgccgttgataatgaggcaaagacgtttgatttggatgctgaaggtgttattttggtattcgagttgtcagcaatccgccaagttgttaaggcagctccagctgcggctgaagcacccaaggcagaaacggcaactgatgaaatcgtcgacacgacagctgatgttgtggcagacgaaaagtcagacgacgctaagtaatagatgaaagagcctgagtagatatttctcaggttcttttttattatggattttaaacgaaaggcgtgcgacgaagatggctgatttactagaaattccggtgcaactacatactgaccgaaaaattttacatgttgatatggatgccttttatgcacaagtcgaaacgcgagacaatcctgcgcttgccgaggtggctttaattttggcgcgtgatccgcgacaacatagtggccgtggtgtggttgctacagctaactataaggcacgacaacttggtgtccattctgcaatgagcgccgctgaagcacttcgattagcgccagaggcaacttttttgacgccaaattttgaaaaatatcgggccgtgtcaaatcaggtccatgaaatttttcatcgttataccgacaaagtggaaccaattgcatttgatgaagcttatttagacgtaacagaaaataaaattggcattgataatccagttgcgctagcccatgcgctacaacaaactatctatgaagaactgcaattaaccagttcggttggggtatcgtttaataagtttttggcaaagctatcttctgaacataataagccagccgggctgaccgttgttcgggaggctgacgttcgacctttcttagatgcattgccaattgaggaggtccgtggggttggtcaaaagacggccgaacggatgcgtgaactgggtgtcacaactggcgctgcgctatatgccatggaccaaacgacattgacccaacattttggacggatggggtatgacttttaccgacgaatccggggtgttgatgaccgaccagttgaatggcaacgtgagcggaaatcagttggcaaagaacgaacgtatggtccgtttttggataacgaagagaaaatcatggctgaactaaagcgactggctgcactcttagagagttcgctacagaaaaggtcgttacacggcaaaaccttggtattaaaggtacgtgatgaagattttaatacggaaacacgacggacaacccaaccagattatttaccaaatgatgcgaccgagtttgaacgtttagcagcggatatttgggaagaattagggggatatcaaaagccaattcgcctcttaggattaacgatgacaaatttagcaccgctaacctttgaaaatatccccctgaatctgtatgataactaatctaatcgcgtaattaccgcggttttctgctatacttattaaagtagcgggtggtagccccaaactgttaacgttgcgagcaacgtttgtaaactagatagaattgagattgaatcatgacagcgcaaacagcaattctagcgcaaattaaggcagcggacacgattattattcaccgtcaccaacgccctgatccagatgcctttgggtcacaatttggcttggcggagttaattaaaacgtcgttccctgagaagcaggttcacgttgtgggcaagcaagtgcctagcatgacttggatgggtgagatggagcaaattccagactcactttacgatgatgcattggtaattgtgaccgacacagcgaactcaccacgtgtcgatgaccgtcgtttcgactacggtaaggtgttggttaagattgaccaccacccaaatgacgagccatatggcgactatacgtgggtgattgaaggcgcttcttctacgtcgacgatgatttttgccttctataaggaatttgaagacgaattgactttgtcagatgcaggtgcctcatatttgtatgccggtatcgtcggcgatacaggtcgcttcctatacgcgactaagtctgaaacgatgcaagttgtcgctgatttgatgaagtttgattttgattggtttaagattaatcaacaaatggataccatctcagttgaagctgcccgggcttctggctatgtttataacaacatggtcacaaccgataacggctttaattacattattttgacgaacgaagttgttgaaaacttcaatcttggtgattttgggacggcctttattgtcccattactaggaaagatcaacacagttaaggcctgggctgtctttgaacagcaagatgatggctttttccgtgtccgactacgttcacgtaacacggtgattaacgaaattgcaaagcgacatggtggcggcggacacaagtttgcctcaggtgcttttgccaaggacattgatgaagtccatgagattattcgtgaagccgatgaaacattgaaggagcaaacagaagcataatggctaagtttactgactacaacttgcgcccagaaatttatacggcgttggatgaaattcgtttcaccacaccaacgaaggtgcaagaacgcttgattcccgttgtgatgcaaggacgttccgttgtgggacaatcacaaactggatcaggtaagacacacacatttttgattccaattttccaaaagtttgatccaactgctcaaaaggtgcaagccgtgattaccacgccttctcgtgagttggcgcaacaaatctatgcagcagccaagcaattgggtacaggattcccggctgaccaacagccacgcattggcttgtatgttggtgggactgataaggtccgccaaatgcaccaattggaaagtacacaaccacaaattgtgattggaacaccaggacgtatcaaggacttatatacggctggtgggttggatatccacacggcatcagctttggttgtcgatgaagcggatatgaccatggatttgggcttcctaccagaagttgatgcaatcgcgggtgcgatgccagaagatttgcaaatgttggtcttctcagctacgattccacaaaagttgcaaccattcttgaagaagtacctaacgaaccctgttgtggaagaaattccaacagaaaccgttatcgccccaacgattactaacttgttagttggtacgaagggcatgaagaaggatgacttggtatacgagttattgacgatgggaaacccatacatggcgttggtgttcaccaacacgaaggaacgtgcgcgtgagttaaccaagtcattacgtaaccgtggtttgaaggttgctgaaatccacggtggtatccaaccacgtgaacgtaagcgtaccatgcaacaaatccaacacttggattatcaatatgtcgtggccactgatttggccgcacgtggaattgatatccctggtgtatcattgattatcaatgatgggattccaacggagcttgaattcttcgtgcaccgtgttggccgtactggtcgaaatggtatggaaggaactgccattacgatttacaacccagatgaagaagaacgcgtgcaagcggtcgaaaacatgggtgtgacgtttgaaccaatgacttactcacatggtgagcttaagcctggttatgatcgtcgccgtcgtaagcaacgttcaaagtcaactgttaagctagacccaacgatgattggtttggttaaaaagaagaagaagaacgttaagcctggttataagcgtcagattaagtctgcgattgcccgtgatgcaaagtacaagaagcgtgttgaggaacgtcaatcacttcgtgccgcgcgtaaggctaagaaaaaggctaacgataagtaaaaaacaggctcgcatgtgcagtgtgggcctgtttttttgtgctggcttgattgatttcagttgattttcaggctacgattaaaggagcgaggaattgatatgaaatttgtaattgccccagattcatttaaaggtagtatgacagctaaagaggcggctgtggccattcaagttggtttgcaaaaaatttatccagatgcggactatgagttggtaccgatggccgatggtggtgaaggcacagttcagtcattagtcgatgcaacggatggtgatatcatcactgctaatgtacaaaatccgttggacgaaacggtgacggccttctacggtgttttgggcgacggtcaaacggctgtaatcgaaatgtcagccgcatctggtattcaattcgtgacagaagaaacgaagaatccgctgattacgacgacgtttggcacgggccaattgatcaaagatgcgttggatcgcgggttgcgtcgcttcatcatcggacttggcggttctgccacaaacgacggcggggccggtatggctgaagcgttgggtgtccgattccttgatgaaaatggtcagcaaatcgcacgtggtggtgcgccattagcacagctagtcaagctggatatgggccatcttgatccgcgcgtggctgagtctgaattcttattggcttcagatgtcacgaatccactgattggcgaaactggtgcgtcagctgtctttggcccgcaaaagggtgcgacagcagcgatggtggccgagctcgatgcggctttgacaaattatgccaaggtgattaagacacaaataggtgtcgacttggctaatacaccgggggcgggcgctgccggcggactcggagccggtatgttggcgttcacacaggctaagatgcaatcgggcattagtttggtagttgcagcaactgcattagtcgccaaatctgctaatgcggatgtcgcattcgtcggcgaaggtgcgattgatttccaaacgcaatacggtaagacgccaatgggtgcagcacaagcgattaagcaagcctcaccggatgcgaaggtcattggattggctggatacgttggggatggcattgatgcattgtatgatttgggtatcgatgcggtgttcggcatcctgccgggtgcagttgatttaccgactgcaatgaaggctggtgaggcaaatctcacacgaacagctgagaacatcgcgcgattgctaaataccaaataacttttacaaaaacatttcaagcaaacaaaaacggttattagaagttcttaatatgttacaataatgaacaaggacatatcatttatggtttgagagccaacagaaacgttgtggatgatgtaaacaacgctcaaccttttgtgatgctaccttcatagctgtttgtgaaagcaaaccgtgcgccagcgttaacggcattcaaagaggtaatgatgcagactatcattgcaagcagagtggtaccgcgtgtaggcgtctctgtttttgcaatgggggtctgtttttattttagatatttatttaagcgaggattggaagatgaagccattatcatcagctgagatccgtgatatgtttttgcgtttcttcgaaagcaagggacacagcattgagccatctcaatcattgattccaaaggacgatccaacattgttgtggattaactctggtgtcgcaacgttgaagaagtacttcgacggttcagttgtacctgaaaaccaccgtattacgaacgtgcaaaagtcaattcgtacgaatgacattgagaacgttggtcacacggcccgtcaccacacgttgtttgaaatgatgggaaacttctcaattggcgactactttaagcctgaagttattccttgggcttgggaattgttgacgagtccagaatggtacggtatggaccctgaaaagttgtacgtgacggtttacccaaatgatactgaggccaaggaaatctggttgaacgttgtggggttgcctaaggaccacttgtacgaagaaccagataacttctgggatatcggtgagggaccttcaggaccagatacggaaattttctatgatcgcggtgaagaatttaacgccgacgatgccaaggaaaactaccctggtggtgaaaacgaacgttacttggaaatttggaacatcgtgttctcacaatacaaccacttgcctggtttgactgacaacaaggattaccctgagttgccacacaagaacattgatacgggtatgggactcgaacgtgttgtctctgttttccaaaatgccaagaccaactttgaaacggacttgttcttgccaatcatccgtaagacggaagagatgtcaggtcaatacaagtacggtgatgatcctgaaaaggacatctcattcaaggtgattgctgaccacgcccgtgccgtaacatttgccatcggtgatggggctttgccatcaaacgaaggtcgcggttacatcattcgtcgtttgcttcgtcgtgctgttttgcacggtcgcaaattggggattgataaggtcttcttgaaggacttggtcccagtggttggtgagattatgaagtcttactaccctgaggttttggctaatgcagactacattgcatcagttgttgaagctgaagaagtccgcttcaacaagacgttggcagatggtttgtcattgttggacggtgtcattgatgaagcgaaggctaacggtggtgttatcgacggtgcggttgcctttaagatgtatgacacgtatggcttcccatacgagttgacggaagaatcagccgctgatgctggcttgacagttgaccgtgctggcttcgatgccgaaatgactgcgcaacaagaacgtgcccgtgccgctcgtggcaacacagcttcaatgggtgttcaaaatgccttgttgacagatttgaagacagaatcagcctacgttggttggtcagaattaacagttgatgctgctaagttgacagacctgattgttgataatgaattggtcgagtctgctaaggatggtcaagccgaagttatctttgacgtgacgccattctacgctgaaatgggtggtcaagtagctgaccgcggtgttgtcattaacgcagctggcgaagttgtcgctgaagtcgttgatgtacaaaatgcaccaaatggccaacacttgcacacgttgcaagttaatgcagaaattaaggccggtgagacgtacaagctcgatgttaaccgtgcgtaccacgcagcggtttcaaagaaccacacggcgactcacatgcttgaccaagctttgcgtaacatcttaggtgaacacacaacccaagccggttcattggtcactgaagatggtttgcgttatgattttacttacaacggcgctgtttcagcagagaagttgcaagaaattgaagatttgatcaacgctaagattattgaaaacttgccaatttcatgggttgaaacggatatcgaatcagctaagaagttgggggctgtcgcagtctttactgaaaagtatggtgagaaggtccgtgttgtctcaatcggtgacttcaacgttgagtttgacggtggaacacacgctaattcaacggctgagttggggatgttcaagattgtcagcgaacaaggtacgggtgccggtgtacgtcgtatcgaagcggtgactggtcagggggcaatgaacttgttcaagcaacacgatgcttggttgaacgaagcaatggcccaagttaaggcaccacaattgtcagaagttaacgataagattgctgctttgcaagcacaattgaaggatgccgagcgtcaagcggcttcattggagcaaaagctggctaatcaagctgccaatgctgcgttcaacgatgtacaaacggctggcaactttacgtttatcgcgactgaaatggccgttgaatcaatggatgcgttgcgtgcaacagccgataactggaagcaagcaacgccatcagatgtgttggttttggctgctaacttgggtgaaaaggttaacttgttggttgctgcttcaccagacgcgattgctaagggtgttaaggccggtgatttgatcaaggccattgcaccagctatcggcggtggtggcggtggtcgcccagacatggcccaagcgggtggtaagaacccagcgggtattgcagatgcatttacgcaagcagcagattggttgtctgcaaagtaaacttgcatttttattgaggggaacctcggaaggaggctgaaaatgacttcattagataatacagctgtctttgattttggtaataaccaagaacacgacgtacgtaagacacttgagattgtgtacgcagcgttggaagaaaagggttacaacccaatcaaccaaattgttggttacttgatttcaaacgatccagcatatattccacgtgtaaacgatgcgcgtaatttgattcgcaagtttgaacgtgatgaaatcattgaagcgttggttaaggattacttgtctaagtaatttggttgagaaattccgagagatttaagagaaattttggtccagaaagaagaggtcagataatatgggacgcgtaatgggtctagatgtcggatcacgcacagttggtgtggcagtatctgacttgctcggttggacagcacaaggtgttgaaatcattcgcattaatgaagatgagaaagagtttggcattgcgcgcatgaaggagttggtggcacaattccaaccaacggggttcgttcttgggttgccaaagaacatgaataacacatccggtccgcgcgtcgatgccgcacgtgcatatggtgatttgttgacggaaacatttggcttgccaattgattttcaggatgagcgcttgacgacggttgaagcagaacgtatgcttgttgaagaagctgatgcgtctcgtaagaagcgtaagcaggttattgataagttagcggcggctttgattctccaaaactatttggatcgcaaaggaccacttgtaaagtaagaggtaaacataatggacgaagagcaagacattatcacattggttgacgacaacggcgatgagcaacttttcgaagtgctatttacgtttaagtcagaagattttggtaagtcatacatcgtcttgtacccagcaggggcaggcgaagatgaagaagttgaaatgttagcatacattttcgaccctgaagagacggctgcgtctactgaaggtggtttgacgccaatcgaagacgacgcagagtggtcaatggttgaagagcgtttgaaccaattcttggatgagcaagaagactaatgttttagtacaattaatgaccggtgatgcatcggtcattttttgttaactggaaaggacgtaaaaatgaacgacgcagaattgttcgtcttaactgacgaggacggcaacgaacacgaatttattgagttgttctctttcgactcagaagattttggtaagtcatacatcatccttggccctgcagatgcagcgatggatggggatgacgaagaagaagttggtattatgccattcatctacaataaggatgatgaagaaggtatgttgcaaccaatcgaaactgacgcagaatttgatatggttgaagaagtgatgaacacgatctttaatgatccaaacttacaataattatgattaagactgatcccgatgaaaaattgggaccagtctttttttggactttttgattggttatgtgtctctattactggaggaaaaaacatggcaaatctaaaagcgtattattatcgatttcagcatatgatttggtttgcaactggcctaattggtatcggtattgggttagttgtttggtggcagtgttcacagaccgcaccagtattaccgcgagatatttcgccaagcgtggcggctgaccaatcaacacaaaaagcggtttcggttacacggaccgtgcagccgtcagttcaatcggcgaccgtcgtggttgatgtgaagggtgctgtgcaccgtccaggcgtttataaatttacagtaccaccaattatggcggatgcccttgaaaaagcgggcgggacattggcaactgtcgaccgcacccgcttgaatctggcagcctccttgacgaatggtcaggtactgtatataccgaacggttctgaaatagtgccagatgcctatccattaccgggacaaccaagcaccaccgcaccatcggcaacgtcagcgacaacagccactgaaacatcacttgtcaatttgaacacggcgacggtcgttgaattgcaaaccttgccaggcgtgggtgaaaagcgggctcaggatattgtgacccagcgtgaaacgatgggtgggtttaagacggtcgatgacttgcaggaagttgctgggattggggagaagacatatgctcgcttagctccgttggttacggtttaatgcccggttattggttagtcctgtcattgtacattgccgggttaaacacggtaatccgttatcaattttggtggtcagtgccgctgttattgtggttaagtagcttactcgtaattcgttttcggtgtcgcattgttttgacgatactcatcacgattggctatgttggtttttttattgcacaggatgcaaagctaaccgcattagcgcaacgcccaactggtaaagttgagagtacgtttcgcatccatgccgatgaactacagtttagtggcacaacaattacagggtttgcggtgatgccaaatcgggaacgggtgcggttaacttggttttgccgtgaggaagccacgtttcgccagctacagacgacgcatgtgggctatgttgtcaccggggtcggcgattatgaagggatccaaccacgccggaatgcgtataattttgatccgattggttattggcgaagtcgggggattattcatcagtttgttgtgaagcaagcgaccatcacgggagttgatacgccaacagggccatggccatttattaatagtcggattcggacgggccacagccgattagttgcctggtttgaaacgctaccacctgggttgcgtgactatggtgaaacattatttttgggttatacgcgtcgtgacttctatgatgataacgttggtattcagaagatgggtttggtacatttgtttagcatttcaggctttcaagtcgcgggcgtctatgtattgtggcgtaagttcggtcggtggattggcattacccgtgaacggtcgttgttaattgtacaagtgcttttagttgtgttgctgctatttgctggcggtgtccaatcattggtgcgggcggtattattggcgttaacacaagcttggcgcgaattgggatggctccgcttgtcagcagttgatgcttggggcgttgcattgttagggggcttattacttgaaccgggggtgttacataatttaggtggccaattatcatacctgctaacttttggcctcttatggctaacaggcaaaccgggttggtggcaatgcatctttttgtcggtattaattttaccagtgctgttgtggcatacgtacgcttggcatccgattagtattctggcaaatttggtggcgatgcctgtatttacatggttagttattccggtactgttagttggcattggtgcggcttggtgtggtctgacgcctatcatgtcatgttgtaatgcgctgattaacggcatccagtttggcatcgcgcaaatggaccgtgtaccaggtgagctagtgtttggtcagccaccgttgttgctaagcggtgttgctttggttgggacagttagttggctgttgaggcgcaggcgtcggacaattggtttggtgctattagtcatctatggcgtgatgtttttgttaccaagattagcaacgggcgggtttgtggcgttcgccgacgttgggcaaggggatgcaacgattgtgcgacttgcaccccggcaagtcatgctggtggacgttggtggcaaaatgaatttgccacaaccaccatgggccaccccacagaagcgtgattttcaggcacaacaattggtgcagtttttgcggggaaagggtatcacacgggtgcaacaattagtcctgacgcataaagacattgaccatattggcaatttgccacattttttacaacaaatacctgttgataacatttacgtgccactgggtatgatgcaaacggaggcctatcaggaattggtcgcaccacattgtaagggtgcctcggtacaagaagtgcaagctgggatgcgtttgaatcgttggacgttagtgaagcatccgtttaaatccggtgcaggcgataacgaagattctgtagcggtgttggttgagacaggacctaaacggctgatgctgactggtgatttggatcaggcgggcgagcgaaacctattagatgacccgatgcttggtcgggtgccgatactaaagtttggtcatcacggatcgaaaacgagtacggcctccgagtttgtacagcggttgcaaccaaatgttggcgttgtttcagcaggggtaaagaatcgatttggtcatcccaatcaagaaacgttggttacagcctaccaaaataacatgcaagtgttcagtactgctgaaagtggtatgttgcaatattgctggtcaggcaagcgtgaccggtggcaagcagaaatcacatcacctattcaacttccggggcgaccatgatacagtagaaacatgagaaaaacgaggaggcaggcagcatggcgcttacgctaagagatgtgcaacaggatgttgccaagcaaacgttaaagccaatctatctgattcaaggaacagaccagtatctacttgatcaagttcgatcagcgttcgttagcttgattccggatgaagatcgcacgttgaatttggcccaatttgatatgcgcgaaacgccactcggtgtggctatagatgatgcacgatcggtaccgttttttggtgatcgacgggttgtcatgattgacgacgcgtacttcttgaccggtgaaaatccccggacaaaggtagaacatcatgtcgaagatttgattgcatatgcagaacatccagagccccaaacagttttggtgatttttgcaccctatgaaaaacttgatagccgtaagaaggttgtgaagttgttgaaagagcaggcagcttatttagcttttggcgatttaacagaaaaagatgttcgtagcatgatcacggataaattgcggcaaaacggctttgaaatgtcgggcccagccatccagctacttgttcgactcacgaatatgtcattgacccaaattatgtctgaactggataaattaatgctgtatgcctatgatacgaagcaaattgatgagcaagcagtggatgctttagtcacacgtaccttgagcgaaaatattttcgacttgattaatgcgttgttgaatcgtaaattaacacgggcagtcgaactgtatcacgagttaatcgagggtggtgaagcaccgcttcgattacatgcagctattctcgggcagttcaggttgctattgcaagtgaaatcagccacgcaaagtgaagctggtactgcaaaaatgctaaaggttaacccatatcgcgttaagttggcgcgtcaaactgttcgccgcttcagttaccctgcattagcaaaagcttatttagggttagtcgggatggaagaacaacttaagtcgacagcccgtgaaccagaactgttgttcgaattatttgtcttgcgctatcaagcagatattgcttaggaattttacttgcattgcgttagaaagtttagtattatatttgaagtgcaaaagcacacgaccttttacgatgtttgacggttcaccgtcgtcctacgttgtctaaggcgactatacaaaagaaaggtggatatccaacatggctatttctgcacaacgcaagaatgaaatcatcaaggaattcgcacgtcacgaaggtgatactggttcagttgaagttcaagttgcagttttgactgctgacatcaacgaattgaacgcacacatgtcagagcacaagcacgacttccactcacaacgtgggttgatgaagaagatcggtcaccgtcgtaacttgttgcgttacttgcgtgacaacgacgttcaacgttaccgtgagttgatccaaaagcttggattgcgtcgttaatttttacattaacaacgtacgttattttgacatttatcatcggagggaaaagcgatgccaattattgagtcatcaatccaacgtgcccgcttgaacaaggtgcaacgcgagcgtaacatctcacaattgagtgcataccgtactgaagtgaagaagttccgtaaggccgctgaagctggtgcagacaacttgcaagagttgtttgttaacgcttcatcagctatcgaccgtgccgcttcaaagggcttgattgctaagaacaaggcttcacgtgacaagtcacgtttgtcagctttgttgaacaagtaatcaacgttagctaaatagggattatatcccacatcaaatgttatttgttcgcaaatgatgtttgataaaaagagcaagtctgttatggacttgctcttttttgttatataactatcagacagcttaatggctgttgtcgatcaggtgttcgccatttttatttttcttgttgttggtaccgccttcaaactgtggtaaactggaataaatcatacaaacgtttgggttgtgctgacccgtgaaagacaacgagaataggaacattatgacaacgacattaagtattatgccgttcggtggcgtacgtgaaaacggaaagaacatgtatgcagttaccgtcggtgaagacatttttattttggatgcagggttgaagtacccagaaagcgatttgcttggcgtggatgtggttattccagattttgcctacttggtagaaaacgctgataagattgctggtgtctttttgacacacggtcacgcagatgcaattggtgcattgccttacttgttaagtgaagtgaaggtgccagtttttggttcagaattaacgattgaattggctaagcttgctgttgaagctgagccagaagcaaaggggtttgatgattatcacgttgttcgtggtaattcagaagttagctttggggatgtaacggtttcattttttgagaccacacacacgattccagaatcattggggatcgttatcgaaacaccagaggggcaaattgtttacactggtgactttaaaattgatacgacggcattgccatactaccgaactgatttagcgcgtctcgcacaaattggtgccaagggtgtaattgctgtcttggctgatgctgccggtacagcaagctatggtttgtcagcacacgaatcagaacttgcagagtacgttttggactcattccgtgcacataagaacggccgtatcatcgtcgccgcagtggcttcaaacattcaacgtatccaacaagttattgatgctgcttacaaggttggccgtaaaatcgttatctcaggtaacgatttggaaaaggttgtccgcacagcccttcgtttgaagaagttgcacttgccaatgcctgaaaacgaattattcgtttctttgaagaatttgagcaagctggcacctgaagaaactgttattttggaaactggtaagatgggtgagccaattcgtcatttgcaacgtatggcacaaggcgatgaccgcaacatccaaattcaagaaggcgacttagtctttattacaacaacaccatctacggccatggaaggttacgtggcgcgaacacgtgatatgttgttccgcgccggtgcctcagtgaagcaaatttcaacggataagaagtcttcaggccacgcgtcaaaggaagatttccaattgttgctcaacttgttgaagccacaacatgtgattcctatccaaggtgaataccgtgtcttgaatgcggcttaccatgcggctgaacaagttggttacgatgatgaccacgtttggttgttggcgaagggtgataacctgcgttgggatggcgagcaaatgttcttgggtggctcaatccaggtcggctcaacaatgattgatggttctggtgttggtgatattggctcaatcgtgctaaacgatcgtcgcatcttgtcagaagatggggtctttatcgccgttgtaacgattgatcgtaagaagaaaaagattgtcgcaacacctaagattgactcacgtggtttcgtctatgtgaagacgtcacgtgatttgattcgtgaagccggggaattggttgaaaagacagttgctgaaggcattaagaacacgaaggaattcgattggggtaacttgaagaattcagtacgtgatgccttgggtaagttcctatttgagcaaactcgtcgtaagccagtgattttaccagttatcatggaagctaatcaaaatggccgtcgtcgcaagcgctctgcaagcaagacgaataacaagtcaacggacaagccggtagcagctccaaagcaagctgcccgcaagccaaagcctaagaaaaaagtgcctggtgcacaaggacaaggtaatggcgcacaacaaaagaaacaacaagcaccggctaatcaacaagtaaagccagcgggggctacggaggaaggcgctaagaaaaagaagcgtcgcccacgtcgtcgtaagccaaaggcaacacaaggtgaacaaccagtaagtgcagaataaaaaagaagcgtcggttcttaggaatcggcgcttcttcaatctagaaaggtgagggcatgacaccagaggaagaagaacgatttgctagcttagtggcaaaagggcaagttgcttttgacgagcattcatacggcccagctttagatgcattggatgaagcttacgatctcaagcaaacaccagcaatcaaccagttgctgacgcgcgtactattggcagatggtcaatataagactgcacagttgtttgctgacgaatttattgacagttacctagcgactgccgaaacagcgcaattatacgtgacggttgccttgcataatcaacaatttttgacggcccgcgaatttattatgtggttaccggagacgcaacgcgccgacttgatggcccaggttgtgacggcagaaatgacagctcggcaaacgcaacaggcaacaatcacaacgattgcgcggcatttttatcatttgagcgacggggatgcaatcagtcaacgggaacggttgattgcagccgacaaattgccactagatgagtatctagttggggcacgtttcgtcttattggacccatttttaacggccatttcacgtgtatcagtcttggaccggttacgccgtttacgagtgacgcagtcagttgatatggtgtggcttgacggaggcacactgacggttgtaccagcccaacttgaatctattgaaaatatggttcagtatcaagctattgtgactgaattacaatcgtatgaacgaacagttgggcctgctatgattcatggcctggcagaacaagtccgattgatgcttatgattgcttaccccgtcttggaaagggttgcaattgaaactaaaagttgggttgccggcttaattgctgagtcgctcggcaatccggtgccagaagaagcagtggaacagcgcgaatggcgcgcaaaattacaggctgaaatgttagctttaatggcgtaaaaccggctttttaaaatcagtttgcaaaaaaagataaaaattatttacaattaacacgaagttatatataataattccagtctcataaagagaaattactaaagattttcgcaccaagttgttttagttcttttaagaatgtagtataataatacgtaagcaataagggttagcccaataaaggactaacatgcgaatattaggaggacaagcttttggctaaggaaaatttcgagcgcactaagcctcacgttaacattggaactatcggtcacgtcgaccacggtaagactactttgactgccgctatctcaaaggtattggctgacaagggtttggctgagcaacaagactttgctgctatcgacgctgctcctgaagagcgtgagcgtggtatcacgatcaacactgctcacatcgagtacgagacggaagctcgtcactacgcccacatcgacgcccctggtcacgcggactacgttaagaacatgatcactggtgctgcccaaatggacggtgctatcttggttgttgcttcaactgacggtcctatgccacaaactcgtgagcacatcttgttggctcgccaagttggtgttgactacttggttgtattcttgaacaaggttgacttggttgacgacgaagagttgatcgacttggttgaaatggaagttcgtgaattgttgtcagaatacgatttccctggggatgacattccagttatccgcggttcagccttgaaggctttggaaggtgacgcagaacaagttaaggttatcgaagagttgatggacactgttgactcatacattcctactccagagcgtgacactgacaagccattcttgatgccagtcgaagacgtatttacgatcactggtcgtggtactgttgcttcaggtcgtatcgaccgtggaactgttaacttgaacgacgaagttgaaatcgttggtttgaaggaagaagttcgcaagactgttgttactggaatcgaaatgttccgtaagtcaatgcaacaaggtcaagctggtgataacatcggtgcattgttgcgtggtgttgatcgtaaggaaatcgagcgtggtcaagttttggctaagcctggttcaatccaaacgcacactaagttcttggccgaagtttatgttttgactaaggaagaaggaggccgtcacacgccattcttcactaactaccgtccacaattctacttccacacgactgacgttactggtgttgttgaattgccagaaggcgtagaaatggttatgcctggtgataacgtaacattcgatatcgaattgatcgcaccagttgccatcgaaaagggattgaagtttacggttcgtgaaggtggacgtactgtcggtgccggaactgtttcagaaatcaaggactaattttacgtttaacgtagaattttccaatgtagcttaggctacgcttttaaaagagagttattacatcttatggtgtaataactctctttttttcttatttctccggttagcaaatgtcacgagatgtggtaaagtgaactatacaaattttacaaatagagggattttacatcatgcaaatttatttggccgcaccattctttagtgacgaacaagttgatcgtgttgcacgtattgaggcagcactggaagcgaacccaacggttactgacttctactcaccacgtcaccaccaaaagacggataaccctgaatacacgccagcctgggcggccgaagtgttccgtcgtgatgtgacacaagtgcttgatgcagacgccttggttgttgtcgctgatttccgtgatgacgatgcagactcagggactgcctttgaagctggtatggcttgggccttaaagaagccaatcatcatggttgaagagactgattacaagacgaacttgatgttaactgaatctttgactgcctttgtgaacaaggctgaagatttggcaacttatgatttcaagaactatcctgaatcaaagtttgaaggacaattgttctagtaaattacgggtttacagtcgattttcggcctagaattattgccaaaataggcactttccggtaaacttataaagtatgtaaagataatatatgtaactgactattagttggttactattggaggaataaacatggctaacgcagttttcactaagggtgaaggcaacaagggaacgatcaagttcgaagttcctgttgacgtatacgaaaagggtatcgacgccgcatttaacgacgttaagaagcaaattacggttcctggtttccgtaagggtaagatgcctaagcaagtctttattcaaatgtacggtgaagagtcattgtaccaagacgctttgaacatcgttttgccagatgtttacgctgatgcagttgcagaagcaggtgttacgactgttggtcaaccaaagatcgacgcagagtcaatgaacaaggatgaagcttgggttttgactgctgaagttgaattggctccagaaatcgaattgggcgactacaagggtgttaaggttcctgcatcagacgttactgtttctgatgaagaattggatgccgaaatcgctcgtttgcaagaaggtcaagcagaattggttttggttgacgctcctgcaaagaacggtgacacggttgttatcgacttcgttggttcagttgacggtgttgagttcgacggtggtaagggtgacaactactcacttgaattgggttcaaactcattcatccctggcttcgaagaccaattggttggtgccaaggccgatgacgttgttaacgtaaacgtaacgttcccagaagaataccaagctgctgacttggccggtaaggacgctttgttcgttgttactgtgcacgaagttaaggctaaggaagttcctgcattggacgacgaatttgcaaaggatatcgacgaagaagttgatactttggcagaattgaaggacaaggttaaggcacgtttgacgactgaaaaggaagacgctgctaaggatgccaaggaagacgctgctatctcagctgttgttgataacgcatcagttgctggtggagaaattcctgattcaatgattcacgaagacgttcaccgtcaaatgaaccaattctttgcttcaatgcaacaacaaggtatctcaccagagttgtactaccaaatcactggttcatcagaagatgatttgcacaagcaatacgaagaaggtgctgagcgtcgcgtaaagacgaacttggtattggaagctattgttaaggcagaaaacatcaagcctacggacgaagacgttgctgctgaagtaaagtcattggccgaccaatacggtatggacgaagctgctgttcgcggtgctttgtcagacgacatgttgtcacacgacattgctatcaagcaagttgttgacatgatcgttgaaaacgctgttgaagcttaattctaaacaacgttaattaagaggttagactttttcgagtctaacctctttttgcagtgttacgctatataagtcctaagaatatcgtataaaaaaacacaaaatctctggtacaatagtaggtaacttacgtttcgactaacgttaaaaacttacaggaggttgaacagtgtttaatacaaccgataattcaaacggcattgcctactgttcattctgtggtaaggcttcaacagaagtgaagaagcttatcgcagggcctggcgtatacatttgtaatgaatgtgtggctttggcacaagatattattaatgaagatttgcaacaagatgcattggagcgcacattgactttgaaaacaccacaagagattgtcgataacttgaattcatatgttatcggacaagacgaagctaagcgtactcttgcagttgccgtctacaaccactacaagcgcgttaacgctatgttgacgggtgatactggggctgaaggtgttgagctgcaaaagtctaacatcgccatgatcggacctactgggtcaggtaagacgtatattgcacaatcaatggctaagcttttgaatgtgccattcgcaattgcggatgcaacgactttgacagaagctggatacgttggtgaagacgttgaaaacattctattgaagttgatccaagccgctgactatgatgtcgagcgcgcggaaactggtattatttacatcgacgaaattgacaagattgccaagaaggccgaaaacgtttcgattacacgtgacgtttctggtgaaggtgtgcaacaagcacttttgaagatgctagagggtaccattgctaacgttccacctcaaggcggtcgtaagcaccctaaccaagagttcattcaaatcgacacgacaaacattttgttcatcgtcggtggtgccttcgcgggtatcgaacaaatggttaaggaacgtgtcggagctaaggtaattggtttcggtacggactctaagacagtacaatttaagaatactgacaagtcaatcatgcaacaggttgtacctgaagatttgatgagctttggattgattccagaattcattggtcgtttgccaattttgacagcattggaagagttgacagaagatgatttggttcgtattttgacggaacctaagaacgctttggttaagcaataccaggctttgttggcacttgaaggagttgcattgacgtttactcccgaagccttgaaggccatggcacacttggcaattgagcgtgagacgggtgcccgtggtttgcgttcaattattgaggagacgatgcgcgacgtaatgttcgatgtaccatcacgtgatgacgttaacggcgttattattactgaaggtgctgtattacgtaacgagcaaccagagatggttacagaacaaaactaacggaggatttatcatggaagtacacaatgtcgaaatggtaatgtccgctgtgcgtgccagccaatacccaactgatggtttacctgaggtggcattcgttggtcgttcaaacgttggtaagtcttcattgacgaacgttttgattaaccgcaagtcatttgcccgcacctcatcacaacctggtaagacgcaaaccttgaacttctacaaggtggaagatcaaatctttttcgtcgacgtgcctgggtatgggtatgctaaggtttctaagaaggcccgtgaagagtttgcggtcatgattggtgaatacttgcgtacccgtgagccactgaaggggattgtgcaactggtggatgcgcgtcacatgccttctaaggaagacatcgagatgtacaactggttgacgtctgatgacatcggcctaccagttttggttgttgccacgaaggctgacaagatttcacgtggtaagtggaataaggctgaggcagatatcaagcgcggattgcaatttaaccctgacgtttctgactttgagattttctcatcagaaaccaaatatggtaaggataacgtctgggactggctagaagcccgtatgctcgatggtacggattttgatccagaagaattcgaagattaaacgaaagcacgcatgcaaattgcgtgcttttttatgcggttgaacaactaagtatatcttggctgccacctgccatgctcgttgcaacgcgacgaccgctcaactatctaaaagttaaccgtttcacctaatgttcaaacagtaaatttgtgccgacatggtgtaaaattgtacttagggagaagagaatcgctaagcagaaagaaagtaggcgactcgatatgcaagtgaaacacaatgatatgattgtcgaggcatggcaaatctcagacgatacggcacctgctgtttgggtgcaggacgcattgcaaaagggtattgtgacttggcaatcaaaggcagataaccagttgcgattgcatgagcctgatagtattggtaattgtggtgattatctaatcaaaaacggcccagcattcaaaattgtgaaggcacctgaatttacttcggattaccaaacactaggataattagcaagtcaatgaaaaacgctgaaacatcagcgtttttttgctatactggaatttatgaaataagaacgacatccgtgaaaggaaggcaaaaccatggcagaaaagatgcgctttaaaggcgaaatccttggtaagccaattaccattacgtcaaatgagacccaagcccacatgaaggctgtgttcgacttggcaaatcaacaattgaacgaaatgcgcgagctagccccacgcttaactgacgatcaattactaacgttgttggccattaatgcactatcagatcagttgaagatgcaggccgagaaggacgctaataagtaatgaatttactatcagttatcattctggtgttattagtcgctgcgatgacgcgtggctatacgctcgggtttacacgtagtttagtctcgctcgggggccggtttatcgtgtacgcggttgccattcttttgtcgcatcgcttcggggcgtggattcatgcgacgtttttgacaacaatccaagcacgatgggccgcaaacggtgtgccaactgtgctagctgataaagcaaatgaatttctggcgtcaggattagcgtttggaatcttgatgtttggcgggtcgctggtcctgcggtcgattgaacgcagtctgcgttttattaataaggttcctgttttaggtaaactaaatcgcttggctggcctgcttgtatacggccttttagtctacattgaaatcttctttgttttacaattaacacagacattagaaatcccttggtatcacgacgcgatgattcagtcacccgtcgcccagtggatgttaaatcaaacaccttacttctcagacgccatctatcaatggtggattctccagtagggcagaaatagagatattagaggttcagacagatgaataagaaagtcttggcaacccttgagtatgatgcggtaaaggcccaattgcggccatacctctcaacggctgccggtgaaaatgagttgcgcaacttgttgccaacggctgatgccaatgaaatgcaagcttggttggcggaaacgtctgatgcagctaaggtattacgttggcaagggggaattaatattcctaagctggctgatgttaagccacacatgcaacgtttacgtatcgatgcagcgctaagtggtacagaattggcccaagttggtcgggtgctgtttacaaccggtcaaatgcgtatgttctttgaaaacttaattgaagaccgtggtgagccattggctgccttgcgaccatactactcacgtttggttgtgatgcaagatttgacgcgccgtgtgaacacggcaattgatggtgatggtcgtgttactgacgaagcgtcacctgaactacaccgggttcgccaagcaatcacctcgactgaaaatgcaatccgtcagaagatgcaagattacactcgtggtaagtcagcacagtatctgtcagatccaattgtgacgattcgcagtgatcgttatgttattccggttaaggctgaataccgtagtcgttttggtggcgttgtgcacgatcaatcacaaactggtcagacattatatattgaaccagctgacgtggttgatatgaacaaccgtttgcgtgagcactatatcaaggagcgacacgaagaagaacgtgttttggcagaattgtcagatatgttgcgtccggaagccgaaaacattcagaagaatgcagaagtgttaggccacttggattttgtgaacgcgaaggcgcgttatgctgcagcaactaaggcccaggagccagagtacagtccagaaaatcacgtgcgtttgctccaagcgcgtcacccattgttggacccacaaaaggcggttgccaacgatattattattggtgaagactacaaggcgattattgtcactggaccaaacaccggtggtaagacgattaccttgaagacgctgggcttgttacaattaatggcccaatcaggtttgtttatcccaacggctgagtattcaacggttggcttgtttaaggaagtctttgctgatattggtgatgagcagtcaattgaacaatcattgtcaacgttctcatcacacatggtcaacattgttgatattttgaagcaaattgacgcggattctttggtgctatttgacgaattgggtgctggaacagaccctcaagaaggggccgctttggcgatgtctattctggatgcagttggtgccaagggttcatacactgtggcaacgacacactacccagagttgaaggtctacggttacaaccgtgtcgacacaatcaatgcatcgatggagtttgacgttgacactttgcgtccaacgtacaagttcttgcttggcattcctggccgttcaaacgcgttggaaatctcaaagcgtttggggttggatcaatcaattattgatgctgcggcttcattgacgtcagaagattcgcaagagttgaatgacatgattgctgatttggttgaacgacgtaatgccgttttggcgcaacaagtgcagttggcgcaacaagttatcgaaaatcgtcagatgaagaacgattacgagcaaaagcttgaaaagatggaaactgagaaggcccgtacactggaagaagccaagaaggaagctaaccacatcgtggcagattcgcgtaagaaggccgataagattatcgctgatttgcgtaagatgcagttagatggggtggccgttaaggaaaacaagttgatggatgctaagggtgccttgaacgcaatgcgacaagaaccatcagcggaaaacaatcgcgttttgcggaaggctaagcaggctaagagtcaagatattgccgctggtgacactgtcttggttcgtgagtacggtcaacaaggtactgttaagcgcaagctaaaggacggcaagttcgaagtccaaatgggtattttgaagatggtgctggctgaagatgaaatcgagaagcaagccgctgcacaaactgcgaagtcggagcaaaaggcagccgctaagccacgtgttagcacgaataaggcggttaaccgcgcaaacgcatcagcaacgcttgatttgcgtggccaacgttatgaggcggcgatgggtgagctggatcagttcatcgatcgggccttgctgaataacttaccttctgttgaaattattcacggtaagggaacaggcgctattcgccaaggtgtgcaagaatacttgcgttcacaccgtgcggttaaggactttagctttactggtccggaccaaggggcaacgtacgccgaactaggttaatcaaaatgaagaaagactgattctgtgttaagaatcagtctttttctattcttcacaaactcttccaagcttggtaccggcatttgtatggctgaatcagtataataaacggtaaacagggaatatgaaaggaagaaatgaacatgacaacagcaactgcgacacaatctgaactattggaaaaatacttgcgtgattcacacgtcttgaatttggcaacttgtgtgaataatcgcccatctaaccgtgatgtcttttatctgatgccagatgaatttacaaactatatctatatcacaacgccacgtaattcaaacaaaatggctgaaattgaagcgaacccgcacgtatcattcacgacggtgccaaccgatgatgataacggattcgtgacgtcaaataaggcgcaaattcatttaacggataaggccattgatgatgttttgccattgttggataatcaaattccagaatggaccgaagtcgttggtggcgcgaaggaaacctttgttgtcttgaaattagaatttgaatcagtaaagttctttggtaaccaaggtatcaactctgtcttgattgatgatcaaggtgtggttacggaggaagtataagtgatgaggcggtagtcggtgacgattgcggccttttttgtatcatctgaagggggcgatgacgatgatacgtgcgtatatgttattgtttttgacagtttgcttggcgtttttagtcggtgatgatgtacaagccgtgacggtcatgtcgaatactgaaattttacggcaaacggagccgattacggcctatacactggctggccgtgcaacgactatcaatttgccgacgaccttgatgctccccagttaccggctgagttatcaggaactcaatgccttgctagcagcatacggcttaaccgggagtgcggggtatcaaattaccggtttagggaaaccacagttactcacggtgcatcaaacacatgcaacgttgaaacaagcgcaccaaactacgaaacaggttgatgggcggaaccaggttggttatgcaggtgaattgaccattaaaaatgtgatttatcatgacgtgaagctacgtggaacaacgaagattaagttatttatgccacgtcaaaaactcgcggtctttcagttagatgccgggttaggcaaatttacaactagtaatccacgcgtgcaagttacggcgttaccaggtgagcaggtgcccgaggccacatttgagcaaccccgtcgtccaggctatcggtttgatggctggcgcttgcatattggtcaccattggcagaaagtacaacatttagtggccagacactgtccaagtcatcacgtcattcatgcgtacgcgtgctggcgtgagcggtaaggggatgtgtgctaagatggagacaaatggaggtggttggccatgggatatttgttaatgttggctggcatggttttgggtgtgctcatcttagcagttgggctgattagtttggtacttggtttattgatgggggatggtgccgtaacgggctttgctttaaaatcgattggggtcggtgttttgatgcttggcgggtcagtttggtgggctggccggcccacaggtgaggaagtaacacaggagacgtcggttaacgcgacggtcgagggtgggccaacccgtaatggtggcacggatgacttgttgccaattattggtggcgagattattgcgcatgagaatgatgatgacaatcaggcgctattagatgacattgaaccgctaattgcggcagaaattatggctggcgatgacgaaggtaacgcaagcgattatgattaatatcatgagacagctgtcgacaatttcggattttagcgttatactaactttaaattagaaaacaatgaggaggctgttaatatggcagtacaagatattacagacgcaaactttgcagatgcaaccgataccggtgtaacgttgaccgatttctgggcaacttggtgtggcccatgtcgtatgcagtcaccagtcgttgagacggtggctgaaacaatgcctgaagtaacattcaacaagatggacgtggatcaaaacccagcaaccgcacaagagttcggtatcatggcaattccaacgttgcttgttaagaaagatggcgaagtggttgagcgtttgactggtttcacaccagcccaccaactagaagctattttggctaagtacacagcctaacttgattaagaaccagcaaattaatgctggttcttttttcattctgtgttatggttattaggttatacttaaacattaaggaaagctttctgctgatgtagagggctttttagcttgtctgttaatgtgaaagtcccagtccagaaacactgaatacctttacaaatcgctaaatattgttcaaactgtattatcaaaacccgataagactggtatcatagtacaggctgagacttgaatgcacagttttgcacatgcggactgtcgtaaataaggcgttgatgttgcgccaatagacgtgtgttttcacatgcgatacatataaatggaggtagaactaatggcaatcattaatgccaatcaattgaatcaaattcgtatcaaccctgatatgtatggtggttcaaaaagtacaccaacccatgccttacaggaagccgttgataacggaatcgatcaaattttaattaaaaaagcggaccacttgtggatcaccttccacgaggatgggtcatattccgtttttgataacggtgaaggaatgcctgttgaagttgctgagacggcgaatggcgataaaatgccaaccaaccgtatggcatggacggtgccaaatacatcagggcactatacacaacaagccacgacctcaatcggaaaaaacggtatcggaaccaagtttgtgacggcgacgtcaacgaagacggtcggtacgattttgaaggacggtaagtggtatcaagatatctacacgttggatccagaagtggcgccagcatttaaagataagagtgataaagccgctaagttgttgagccggtcaccattgatctacgagactaagttgaatcgcaatcaccaattgccaagcaagacgttgacgcaaaagttatacattcatggtcaaagtcatggcacagaattgcgtttctggccagatccagatatctatgattcagtggccatcgattggacggcctttaaggaccgcttgcaccaacaagccttcttgaaccccgaagcatcatttacgttgattaatgaagctactggcgaagaagtgtcatatcacgaacctgaaggattgaaggcgtatgttgaatatgtctttgagtcatcgaaggaagacaatgaaaagctgattacaggcattcatggtttctctggtcggattgagacaaacgagggtgagtggattggtgcggacgttgcgtttgcttggacagacggggcaacaccacgccaacggtcattcgttaactcagtggctacgcctgatggtggtacccacgtttctggtttcaatgctggtgtgcgccgcatgatgaacaattatgctgacaaacttggcttgacgaaggattcgattgattcgcgtgatttgcaacctggtttggtggcgatcatttcagcgaaccacacgaagccccaatataccgggcaaaccaaggataagctctcaaacgttgacgctaagacggcaattgataagattacctacgagcaaggtcaatttgagtgggataagtacatcactgatgttgaagcagtgattaagcaagcgttagagcgggctgctttgcgccgcaagattgatgacttgtcaaaaatcaagttagattcaaaggacatgaaggccaaggtatcaaagaagttgaagccagccaagaagttgcgtggtgcccgtggcgtggaacaagctgaattgttcattaccgagggtgactcagcctctggttctttgacgcgtacccggattaacggggaaggtggcatgtatcaagccattttcccaattcgtggaaagattattaacgcgttgacgtcaacatcagataaggtttttgcgaatacggaagtttcaacgattttcagtgcgattggcgctggaattggtgataagtacgatgagtcaaagttgaactacgacaagattatcatcgcatccgactctgactccgatggtgacaatatttttgcgttgttgattacgcttttctcaaagtacacgccgcaattattggaaaatggtcacgtctatcgtgcccaagccccattgtttattaattacgatgaaaagggcaacacagattacatctacacggaacgtgatcaacaagtttacttggaaacgcacgaccctaagttggttgaacgtgccaagggacttggtgaagttggtgacccaatgacgcgtgaaaccttgattacaccaggaactcgtcatttaacgcaatacacgacgaatgatattgaagcctcaacggaactagttgatttgttgatgggtaaggaagtggcaccacgtcgtgcgttcctaatggaaaacgctgaatttgcacatattgaggaataagaaataatggcgacaaaaaagaaaatcaagattgatttgaagcacgacaagccagttgttgaagacctcgatcaatcaatgaagcaagcatttacaaattacgggattgccgttgcttctgatcgttcagtgccaaatgtgctggatggtttgaagccggtgcaacgtcgtattttgtacgccatgacaatggcaaagttgtctccaaccgcaaagtttaagaagtcacagacggtggttggggatgtgatgggaaactggcacccccacggtgataattacgggtcagttgattacttgacgcaaaatttcgtcttcccattggcaccaatcgaaggacacggttcatttaccgacatttctggtaacccggccgctgcggcccgttacacagaagtgcggttgtcacgtttcgggcaattgatggtgaatgatctatctgaaaagttggtcccatacgaagataattatgacaatacgaagcggatgccacgggtatttccggctaagttgccatatttgttgattaacggggttaagacaggtatcgcggtcggctttacgagttcgattgcaccacacaacccagttgatgcgacgcgtttgttgaagcaatacatcaagacgccaaagatgacgcttgataaggcgattagcattctgcaaggacctgatttgccaactggtggaaccttgtacggcgatgtccgttcatactacaagactggtgtggggaagttccaaaatgccgggacaattattgattctgacgaagataagaacacattgattatcaccgaagtgccataccgcatgggtggatcaattaattcttacctcgataaggtgaaggatttgattgccgatggtaagttgaagcccattcggtcaatcgatgacttcacgacggacgaggatattgccaacaacaaggtccgaattgaagtcacgttgcagaacaactatgaccacgaacaagccaagacattgcttttccaaaagacggatttgcgtcaaacgtactcactcgaatggatggctttggatggtttgacgccaaagcgctacacattgatgcaatatttgcagacagtggcaaacttccaacacacgttggttgtgcgtgagtacaaggcggatttggaaaaggcgtctgcacgccttgaaattgtcgacggtctgattcaagttcctgacttgattcaagcgattgtgcatgctgcccagaatacggatggtaaggcagacttgatgcaagtcttgcaaggcttgaagacaattccggcacaaatggcatcatttagcttcacggaacgtcaagctgatgcgattgcgtcaatgcgtgtttaccaattgaaccgtgtggatgcgcaagcgttggtggctgagaaggctgatctggaagaacgtattgcgatggcaaagcgttatatcgaagaaccagatttgcgtgtgcaattgttgtctgaacgtttggatgaacaaatcaaggccttgaagaaggacggctttgggtcacgacgtaccacgttgggtgatgaatctgagttgaaggctaaggtagcgaagaccgtcattattaaccctgtgacgattacgattgatcgttacggttacatcaagatgaccgataagcgcgaagttgaaacggacgatgaaatccaatttgtactgcaaacaacggacgatgattggttggaaatgtttacagctgacggacgcatgttgcaagttgggctatctagcttgaagaagtacaaggcacgcgataataatcgtggggatgcagcgatggctgtgtttgccgataacggatacactggtgatgaccgtgtggttctttggacgacgcgtaagcaccttgatgaagctggtacggaaattgttatggtttctaagcgtggtttggcgaagcgctttgcgacggctgaatctaagctaacgaccaagacattgcgtaagacggtggaagcttatccggtgaaggatggcagtgatgaattgctgttcgtacaactggtcagccaaactgaaattaagagctttgatattatcgccattcgtggtgaagaatataagcgtattaagctatcagccgttaagttacaagcttcagcggccggtgctggtacacagacatttgtggataagaagaactcagctgatttggacgctgtttacattctaaacggtcctgaaacagatttgttgaaggttgccggcgtacaattgcgtcagctaccggttctacgtgaatcacaaacgttcaaaaagatccaataataataacgggtgctaatcagttgattggcaccgtttttttgtaaagactaattttcagttatgttcaggtttcaggattataataatcatcgaagataaagatgagggggttgtagaaatgacagctgtttatcaacatggcacattagaagcattaatagctggtcaactaggcggtacaatgccgcttagtgagttactaaagcacggtgacacgggaatcggcaccttacatggcgtcgatggtgaagtggtaatcctggatggtgaggtttatcaagctgacgcaactgggactgtaaatcacattaccgatttaacggccacaacaccattttcaacggtgcatgacgggcgcgatgtgacagatcgaatcacgctatctgatgtaacgatggctaatattgatttaattgagaagcgtcatttggcgaataacttctcagcgattgtcttacatggtgtgatggaccaagttttagttcgcgtcgcaccaaaggcgaatgagccattcccatcgttactcgaattaactaagaatcagccaacgtttgaacgggcacacgtcgcgggaacgttagtcggctactattccccagaattgtatcaaggtgccacgtcagctggttggcacgtgcactttattagcgatgatcgccaatttgcgggccatgtcttggaatttagcgctgcagaattaaccggcgaattaacgatattcgatgatttccagttgcacttgcctattagtgacgcatcattccgagcgcatgaagcagtcaatatgtcggaattggatgccgacattcacgccgccgaagacgagcaaccggaaccggtattgaacaagtaaacacataaacaaatcaaacgacgacgaatttccaatagagattcagccgtcgtttttatttgtaggttatataagagatattaatgatggaaatgcacaacttaagaactcaccgatttacgatgtgttaagctatttggtaaggagattatagttatgacggataaattattttttacatcggaagtcattggtgataagtactcaactgatccagacagtgttggcaagtcacgcaagttttatgcaaaatattgggaaaatacattatcaccgaactgtaccgactatagtacggctggtaaagcaatttatcgtggtgacacgacgatatcttttaatacaatcgccggtagtgttttacgacttgtcatgacggcagatatgccgcagggtagtttcgcaagattacaggcaatccagtcatccgaactaattacggatgacctgaagagacagtttacggaatttcaaaagctatatcattcattagccaattttttgccgttgcccgatgataaatggcatcgtcatacgaatatgaataccgctaaaggggcatcagccgcctatcatgattttccggatttgttctaccaagcggtccatgatcaagtgtttggtggaccgaatgcagtggttacggaaccggtcttcacgaccaacaagagtctagcttatttcaagcggtttaatggtcaatggcgtcaatttgtggaacaaaattacttgcaagatttctttacggacgatacatataatgaatttattcgcttagctccaactgataccgatattgtgttgtacagggcgagaaaagtggtgacgccaatggacagagaaaatggcatggcttatgcccaatattttttaacgacagcaataacgattttgaataatcgtgctagtcgtttggctgacagtaaaaaatagtagttagtaaggccgtaggtgatgcggtcttttttggtacatcgcttcgcagttaggctgcctagaactcttaagctgctgcaaggtgggtgggatgtttccggagcgctcaaaaccttggcaacatgccgcatggccggcgctatccggataagcccataccgacctggaaggcttacggggaattatttgcccggctggatggcgtccgcgccattcggttgccaagttttgagctttgtcggaggagacgtcccacccaccttgctcgtgcgctagcacgaccggtgcaaaacgacagaaaaaagcataccgatcacccggtatgctttatcgcttacttcaaactgttttcaactaacttaacaaacatggctgaaccaactggcatgcaggcctcatcaacaataaacttcgggtggtgattgataaactcataaccatctaccgctaacccagagcctaagccaaaaaatgtacctggccgaacatccgtgtaggcggagaaatcctcaccagccatcaatggtggcattggatacatccgttcttcaccaaccacttcacgtgccgcatcaatcacttgatccgtttgttccttgctgttgataacggaaccgtaacccttttggaagtctaggtcatactcagccccgtacatcgcacacacatgcttgataatgtcgcaaatcatgcgttccatgtcagcgcggacctgtgggttgcgcgagcgtacagatgctttaatgtgtgcggtatgcgggataacattgttgacggaaccagccgtgaactgtccccaagaaaccaatgctggttcatctggtgcgacacggcgggcaatcatgttattgatcgattgaataatctccgtaccaattgtgattggatcgattgattgttccggtgccatcgcgtgggcaccacgccccttaatcgtcaaattgaagaggtcagatgatgctgttacgggaccgtatgcaaaaccaactgaaccggttgcagtatctggaaagacgtggagtccaaatacttcatcaacgtcatcgagcacgccagcttcaacgagggcaattgcaccaccaggtgggacttcttcggctgcttggaagatgaacttcacgtcaccgtgcaaggcgtcacgcgtttccaccagcgcgaagagggccccaagaagaatggcggcgtgaacatcatgaccacaagagtgcatcacgccggggttcagtgacttgaagtcaacatctgctaactcgtccatcggtagggcatcgatgtcggcacgcaaggcaagggtcttgcctgggtgaccaccgtgcaacgttgcgactaaaccagttggtgagggcttggcaatggttaacccaggtacatcacgaagcaaattttcaatataggctgtggtttcaaattcttcaaatgagacttcagcgtgttggtgcatccaacggcgccatttaagttgttcagaaactggaatgcgtgttaggactgtttccatattaattcacctcgttttcaactggcttgtgcttgggaatgaagcgtgacaaaacaaacagtaatgcccccaaaatgacaaagtagataaagaccatgaagtaggcaccgctggccatatcaaccagtaaaccaatcaatgttggtgacacaatgccccctaagatgccgccagttgcgacaatggcgtatgatgggccaaacttgtgggctgcaaagcgcttaacaggcaatgacatcaacgtcacgaaagttgtggcacagaagaactcaccgagtgatagggcgactgtaatcaacccagtatcggttgacattgaggcagtaaacaaactcaacgccccaagcatgccagcaatgccaatgactgtcttttctttaccgaagaagaacttaccaacgatatatgaaccaccaattgcaccgaccaagaaggccgcgccaccaatagccgtgatatgtccttgcacgattgtactcaaaccaactgattgaatcagataagatggcatccaattgagcatgccgtacatcatggcgttaatggtgaagtttaagacacccagtaaccaaacaaatggttcactaatgacttcccttagcttagcggctggaacttcttctgcaaccgcggcatcatcagcgttttcagcggtgagatttttcgtttttttgtcgcttggcaagacgaagcgaaggattatgccaacgataattgaggcgcctgcaatcatccagaaggcgcgttgccagccgtaatccgccaaaactggtgataccactagggggacaataatccctgcaattcctgaagctgaaatcaggattccttgtgctagcgtgcgctgatccagtggtaacttagtggcgacctccttcgcagcacttggcgcataaccagaatgggcaatcgctccggctaagaaacgaatcacaatgataaacatgacggccttggcaaaaccagctaatgtcgcaaaaacagcaatggcagccatcgcgaatgtcaaaattggctttgacccaagctttgtatttaaaattccggccggaacttgcatggcagcgtatccaatgaagaaggcggacattaccattcctttttgaacgttactgaacccgaagtcctgttgcatgctgaccagaatgattccaatcgcatttttatcaaagtaaatcatgataaagcctaagaagagggctgcaacaagcgtaattgtacgggcggaaacctttgatttcgctttggcagccggcttttcgacggctttaggaaggactctttcatcatccataatattgtctactcctttgcatggctgaatagtattgtattgctttcaatttacctgctgactttgtgtaaattgtgaaaatcaaccgagagatatctggttttgtctagaccaattagaaacgcaacggatttttcacaatctggtcagactgtttcaggtttcgcctactgcattttcacgtttatccggcatcatgataaaaatgatatttggaggagtattttgatggcagttgatatttttaagcaccaaatggatgatgaaacattgcagggtgttcgtgctttacgtgtttatggagacgggttgcaacaatacatggctaaggaagcaacaagtgcattgcatacccagaatggagatgtgatcctaggtgaaattttgtggcgactgatggcaaactatcgcaatgacgctgaaatggtccaacagcgcgttaagcaagcgctagctgaggtcgatgtgaccgttgataatgaccaagatttagcagccggcttagacttgttggaccgtgatgaatacatgcgcaacaagttaattggtgatgtggccgagatgtttaaggaaaaggggtacagcattaagctagcccgacctgaggggtatgtcctgcaaaatccaatggaatcaaaaatttctgataagtaatctaaaacaggcgttcatcgaatcgaatgaacgcctgttttgctgtggtaaaataaatgtctgagtaaaaaagagatgaggttacgagatgcaagagatgtatgaacaagcccgtagcctagtgaaagcaaaagactatgcgcaagctagagagttattggcgaaaatatatgatgagaatccgcattataagtcggtaggttattattatggtcgtgttgagtatgaattgaaaagaaatacgcatgctggccagattttggcgagttatgtccgtcaaaagccgatgccaaaagtaaacgtgaataatgcttattattatatggcactgttggccttgcgtgatgaggacactgatacggcacagaagcttatcaagcgagcggctgcccgtggattaaagaatgagcgtttagaaaaggtgcaaaagaaaatatggcagttgcgcacagacgaaacgaaggcgctcaattctcgaatgcgggtcaggttagatcgcattgcctcaaatggtaatccaattgtaacgacaactgaaaaagaatatcagtcagcgtacatttttttggacggtttaagtttagaacaaattgctgaactcggcgatcgagagtggcatgagtatcgactaacaacaccaagatctactaaaatttatggttatttatcagcttctgttgtagagtcgcgtacctattacgaaaaatatttaccttttatgtcagacattcgatatatgtcagcctttaataattatttagaggagaatgcgtactttcaacaaaaatgggagttatcaaaagtttttgctctgctacagataccagagtttaataaagcaattgttgaacatttgttggatgaaagtcgccaaacagatggacaagttctaaaacatttagcggctgtagatgatctggtaatgctgaaaacagcgggtgaagtattaccagttagtcgtcgaaaactattccattctttggagttaatgcagtctccggaattcgggtttattaacagtgatgaatcatcgggctacttatttttaaatcaaaaactagctgctgagcgaattgtccggaaagcattaactgatacaactgatcagaaatttccgtttcaagagagcgattattgggaatttacaccgattggagaacaaaaagaatttattgattggatacaaggtgaaaatcgtcgaattattgccttgttaggtgtgggtggaagcggtaaaacgtttgtgttgggtaatattttaaatactgctgatgttgtagcgctggccccaactcataaagctaagttgaacttagttgataatggatttaaaacagttggaacagcccaatcagttgttgctaatacagatgcagctcaatccttcaagtcattcagtacagtcatcgttgatgaggtatccatgatgacgatggatatgatggcaagtttaataaagttttttggccctaagacacgctttattttaatcggtgatgatgcacaactaccaccggttagtttagatgaagatgcattgtctgttactggtgatttaatgggtatgttacgcaagtttggtacaggatttgaatttcgaaataatcatcgagcacgaaatgaacagttacgtgaatttattgcgcatgttcgagaaggggatgctgaatatatccgtcaaactagaaactaccatacagatacgtatacgagaatgttacaagaaaaaatgcagcatctcgagttagatgacacgatgattctcgcgtatacaaatcagcgcgttgcccagataaatgagtacttttttaaccacctatcagctggtatggacgacatcatcccatttacgaagcgtggtaagtatggccgtggtggtttctttattggcgcgaaggttatgttttataacaatgatcaatcacatcaattcgggtacacgacgagtgaatatggtgaggtgaccaatctgcgccagagtaatatggccggtgactatggtgaagtggaagtaaccattccagcaaccggcaaagtgtataagttaccgatttggcaggcgcgccaagatttattgctggcctatgccattacaattcacaaagcgcagggaagcggggcccgtaaggtttacgtgatggaagcagccgactatggcttagcgtatacggcggtttcacgtgcgaaagaagaacttgtctttgtcgattatgatcgcgaaatgttgattcaagcgttagcgaccccgtcaccaaagaaaattaatttgtatcgttaataaaggacaacatgatgaaaaaatttgtggattacctaccgtttatcggtaccttagcctttttgattgggtatatgtatcatatggaagcattgaatatcgtcatggggctgagttacgtgctatggggtattttgaaacggcgtgagaccaaaaaagtagcgtttacattatctgcattactgggtatggccattatttttgttgaacttgtcgtcatggctcgttggcggtaaatgaaaagtccgaaacagcattttgtttcggactttttgcggtaaatttatttttcggtggtctcgctgaccttaaccatgccaccatctggaatatcggcgacattaatgacgttggtattcgtctgtttgatggttttgacaaccttgttatgcttatctaatacttgcacctttaaccagccggactgttgttcactggttgaccagttggcttgccaatttgcggcagcacgcgtaccaaaaatggttttaacaattggtgttgtgccagcttcaagctgttgcttaggcacaaagaacaagccggcaacaattgcaatgacaccaatcaaaatagggaaacgagattttgcgtcagattttgtgttataaaaaatcatgccgattaccgcgacgatggcggccaaaataaatagactaagtggcatcatatggacgaaccctttcttatagttagttttagtatatcgtaaatttagtttagcgacgtattttaactttcaatttgtcagaaatgttacaacgtgtcataatattgacataataaaagtgtgaattggggatgaatgctatgaagatgtggcaaacaagtttattggtgacgcttgggattgctggcttgattggaacgactacgccagtggctgtacatgcggacggcgcgcaaagtagtcaatcagcaacaaccgcaacggtacagtcgaacattaactatacgttggcgggggatgccattgcagtccaaaagttgcggttgggtaaaaccatgactgacggcaccaccttggttaaaatttactacgtgaaggctggtgaaacactgaagctgtcaggcccttataccgatttgggtggctacacagtgacgtcaaccgacttgcctaagattgatacagacaagtacgtctacgtgttgaatgatgagggtttgtcacaagatgggctgacattgaaccatcaggatccagcaaccaaaatgtcgaaggacgaacccaagtttagtcagtacagccaaacctgggccaagcatttgtcaaagaagcaagtcgctgccattaacgaatacagtaaaaattatggtgatatgaataactggttacgcggtctggataagcatgcctcaaaagcaactaaggccgaaattaagtcaattgacacggcgttcaaacgatttaagaatcccaaggcaaccacggtttggcgtggcttgtcgacggatggctttaaggccgggttgactggcaagttacgggttggggcaacttaccgtgataaagggtatatgagtgccacatttgaccaagaaattgctaagaagtacggtacgggtatcgtccttgaaatcacgttgccaaagggcaagtcaacaggggcctatatcggtaacttgtcagattggaagattgagaaagaatatttgatcaagcacggtagtcggtttaaggtcactgggattgctgatttgggtgataacaagttagttagtctgaagtatgtgaagtagtataatgagtgagaaaataacgtttcaatcattagatgaatttatggatgcagtaaaaaagcttgaaacggattatgcaaatgcctttggtgagcctattcctagtaaaatattgggatggtgggatccgcttcatttgcatacgtacagcatggcagagttagcgacagcgtatgctaggatggcacgtgatgtgcaagctgcaattacaacaatgcacccaattatgccagtgtcagacaagttgtgggacatgacaattttttaagcaatggacggggtatagcatgaacgaaaaagtattaacggctgccaaagtgttatatgactttcatcatcaagaacgacctaccaatcacgcggattttatcctgacgatgggatcacacgacctacgtccggcggaacatgcggccgagctatttctgcaaggtaaagccgacttcattgtggcagctggtggttttggtaaaattactcgtgatctttggcaaattccggaagctgaaaaatatgcagagatcatgcaggcagctggtgtaccggctgataaaattttcattgaaaatgagtcgaccaattctggtcaaaactttcaatttacgaagcgcttgttggcatcgaagcagattaccgtccgaagtggcctgattgtcagtaagacgtatctcggtcgccgggcgatggcgacagcgcaacgacaatggcctgaggttgattggtatatcgattcaccagccatgccatttgaacaatatccaaccgctgatgtaccgcttgatcggatgattgcgctaatggtgggcgatacgcaacgtttgttgacgtacccggaccagggtttccaggttccagtgactatgccagatcaagttctaagggcatatgaatacctaattgcgcagggttatacgacctatttgcagtgaatttaatcattttaaaagggtgtaacctgtcgacttgccagcgacggttacaccctttgttttagttattattcagtttgtggccggaaccataagtaagcaccatagagcccattaatcaaagtgctaatttgcagcaccaacatcgatagagccgcagcgccaccatgacggagttgtacagcccaaatgatgacgttaatgacgtccagaatgatccaagcaacccactgtgaccggtacccgtaggtcattaaaatctggccaataacacccagcaccagcaatgaggcatccaaatagatttgattaccgtgtagtgcatgagatagcgcgacgtttgcaccatataatagcagtgaaaagccaatagcccaaatgaccatcgtgttggtgagccgtcttggtacaacggcatcattttgcgaggcagcaattgaccggtgccaaacggcaatacctacgaactgtgcgataaaatagaacagttgtgatgatatgtcgccaattaaccgattatgaaaggcaattaccagccaagtactggttgagattaagccccaaccgtaattcgttaaccgcccccgatcaaccagaattaagttgaatgccgtggcaaacgaggttaataagctaatccacccaattgttgagtaatcgcgctggaaagcaaaggcgataaccgaggcggtcaacatactgccaagtaacaggtgctcccgtcgatttaaggtgacgagttcccggaccattgtgaccgggttgatagcctcccacaattggtgaggtgctgggatggtgcgacgcattgccaatgtggctgatgcgagcgagtgatatgagaacataggtgttcctccgattgttgaaaacccaccgattcggtaacgtgggcgcatgcgacatgcgactggtacaaaaattgtaccggccggtttgttttttgagaggcggttgtatcccgtaaaaccctctgagctgtttaacgacaagctccggtcggcgttgctaaaatgtcaacgtggcataactttaacgccaaagggacataatagcaagcgtgaatttaataagtgaaatatccgcttttcaacacctgaaaaagtgctagactgtccgtaagggggtagtacgatgttttttaataagcaacgccgtattgatcggcttgagcgggcccaagttctcgatgcagtgatgggactgcagcaggtattgaacgaagccgatgtgattaatgaacttttgctggtggcccaacgcgtggcaacccgtatggaacgcggtgaggacgcccgacggtgggcgaaccgtttagtggcctatattgattttagtgttttcaaccgcactttcaccttgccggatggcgctgcaccttatgtggcgcaattacgtgaaattggtaaactggctggtgtaaacggtgcttatcggacagattacgggtccgccgcccaattctaagcaaaatgaaaaccgcgtactcatttggggtacgcggttttgttagtcaaattgtgttaaatctttttgaatgagacgcttcaaggtttgcagttgcaactttgatagaccagccgactcgatcaaggcaacgatttcttccatgtcggtatcaatctcagtaaattcgagaggtaaggtttcaacactgttatcacggctgtccgtatagcccagcaagtaattgactgaaacgcccagtacgttcgcgacggcctcgacgtgagcaatggtgggctctttaaacttccaaccgtaaatggtgtttgtgcctaattcagccacattattaatagttcgaagggaatagccttgttcatctgcaatttctttaatgcgattaaaagtaatgggtgtgaatgctgccatatgaaagcttctttctagccgaatgcgactatgtgatacttctattgaaccccattagcggtggatccgtcaaacgattatacagcgaacaaggaaataacgccattttttcggacttttgcccatttacttacaaaaagtattaaaataacatgagggagattaaaagtgttatcacccatttaaaatgtcagtcacaaagtcatgatccgcaactgtggtaggttgtgaacgtgacttttcgtttttggtccattggttgacagaaagtattaagcaacacgtttcgacgtgtgcaaagagggatttaatatggcaaactttgatgcatcaagcacaggaattggtaacaaccactacgggttcacgaagtcaacggggattgacacggcacccgtcattgaaacccaagggttgaacaagggggcgtatcatgcgcaattggttgaacggtatacccaattgttgacgcaacgtgaccacgtgtcatacgcggccattcggcaacaattgcacgttgatgatacgacgattcaccaactagcgcgtgaaacaggactctcagctaaataagggttgctgtcgttggaaggggatgatatcggcatgactagacagaacgatcgaaaaaatcttgaaaaacgacttgctgacttagagaaagatcgcgatgaaatggcggctgaactggatttgaaatcaaatcgagggcggctgttggaacatcgtgatgcattgcgctttgactacttagagacgcaaaatgcgttgctacttaatcaacaagcggaactgttgacgttggtcacaacgctcgaaaagaaactggcgcaattgacacaagacaattaactaaaagcaccggactcacgcagttgcgtaggtccggtgctttttcgcatcaagaatattgtgattgttgagattatagaaggtgtggcacgatgcggaagccactaagtaagtgtacgccgaatacacgcggttacggcaaagttccactattcaggtattagtcagtctaacaacaacgtattccagacatctgtgccacgtgttctggaaaggactacactaatggagggttcaaaacatgccgtcaaattgtgtcgctttgccaactgacttttctcaagcagcatgatattgaaccgttattttgggatgaccacatcaccgtgcacagcgaggccggtaatgtggtctttttggtatatgcccaaagacgcaacttctgccaaacactggggtggcgtgctatgctagaaatagtgattttcacacatggtgtttggcaacaccgcaagagaataatgagatttgagggtattgagatggcaaaggttaataagaaacaactgaaacatttattacagcaacaaacacaagtgactcgtacgactaaaacgacgacgccacttgcacaaacggtccaacacaagttattaaacttgcaggagttaatgggccgatcggtagctcagaaaagtgtggtccatacgaaagcagcgattgtcttgcaacaactgcaagagacactgatggctgcatttccaaacgaggagaagacacttgcgttgactgaatatgaggtgaagccacatttgggtcgttacatggtcacgcacgccgaccgtggcgatatcatgatggaatatgaagacttcgcaaccgcggtgtcaatgatggtgaaagggacgcgctcgtatgctgatctacaggcgttgctacagattgacgacgcgatgcaactcgaagattatttcgaactcagaccagatgataaggtgacacctgcacgccgtccagctaaaccgttgaagcgccggttgactgacatcgcggttgctcaggacccccagccggataccacagcgacggatttgcaaagtgaaatcaaccgattaaataaggccaacaagactttaaagaaggaagcgcaagccaacatggccagggctgtcactgctgaaaacgaagcagatagtcttcgccaagacctggccaacgtcgagacatccgtaagcgcgacaaccgacgaccaagtggcgttacaggcgcaacttaagcagcaagcgactgagcttgacgctgctaataacatgttgatgacctataaaaagcgtctcgatgaatttgaaattgcggatggtgagcaagacaataaccggcgcgaaaatgaacagctccggcagcaagtgcgtgaattggcaactagtcaacaagcgttgcaagctgatttagcgcaagcacaacaggaaaacgaccggttacacggtgaattagcccagacggctgttacccaatcacaaccaacgatgacggcaacggggctgtttaatgataccaatgcggtgaccattatgaatgtcttggcagagaaaatctcaacgctgcaacaaggtgtgccggtgacaccggtaaccgaaccagctgaagtcgcaagcgaaccaacgccaacggaaccagtaccggacgctgttaccccagccacgttgacaaaccgggagatgatggatttactaatcgcaaacttgtcagcagatacggttgctgattatgtacggcttgatcgcttggttgataagtacaacacgttaactaatgatgaaaaatcactttggcagcaggtgcaggggcaattcgttaaaaacgccggctattgggattttgtgaccctgaatgatgtgacgtatagcagtttggatgaccagattgactataatgggattgatacggccacagttgccgaacatgttatttattcagctaaggtgcggtcagatacaaatgtggttgtcatcttgcggagtctccgggcgattgatgaatcagcgaccaaagtaaaagatgagccggccgaaccggagacgcatgatactgatgaccgcttagctggtaaacgggtgatgattgtttcctggtttggtcagtcagccgggatggctaagcgccgtatcgaagaatatggtgcggcagttgactggattgatacctcaaagattggtgagggcaaagtcaatgacatgctgtggaacgacaagtatgatttgaagattgtagtaatgaatggttcgcatcaccatacggtctgggaagcttacgaagtcattcgcaaggatcctgaattgaatgtgcgggtggaggccaacccaggtgtttcaacgatgctcaacatggccttagccttagctgactaaaagtttggatacccggttttggaccggttctcggtataatgacggtaaacaaccgtgaaactagaggaggacggtctaatgacaccaactgagttagaaaaattaaagcaagcgcaacatcagccggatttaagcggcttggctgtttcaggaatcggatttgcgcatggtaaaaatatgtcgttacttgacgacgttgttttggatgatgctggtaacccggtcattcactcgaaagatcaattggcatttgctttggatcacaagttcggcaagtttgtgacacgtggggaagcgaacgatgtcatgtgggcatttttcaatgacgaacgggttcagaaaaatgcgaccacgacatacaatgcccaattggggatggcggccatgaccttgaacacggccgctttggaaaaagttgtgaagttgctacgcttgttcatcaaaattggcggactgctcgttaaacttattcgggaggccaaaaatattcgggccgaatttgcctcagatggcgtgaataacacggtgacccctgatgaaacaacctggaccgttgattgctaaaaaggccacacgccaacatttgattaaaaatgttagggtgtggcttttttgacagtttgcataaaattgtctcttgtatttgtagacaaagagcgtactattaaggtgcaagtggaaacgcttacaatttaatagtgttttttggttttgctattttggggaggcataacatgtcagaacaagcagagatgattccagctggaatcgcaatggttaaggtactggaagcctggggcgttgatcacctatacgggattcctggtggttcgttcaactcaacgatggatgcattgctagctgaaaaggacaatattcaatacattcaagtccgtcacgaagaggttggcgcgatggcggccgctgcggatgcgaagttgactggtaagattggggtagcgtttgggtcagctggacctgggggaacccacttgcttaatggtttgtatgatgcgcgtgaagatcacgtgccagtgttggcattgattggccagtttggcacgtcgggtatgaacatggatacattccaagaaatgaatgagaatccaatttatgcggacgtctcagtttataatgtgacagcggtgaccgcacaatcattgccacacctgattgacgaagcaattcgccgtgcgtatgcccaacatggtgtggccgtggttcaaatcccggttgatttgccatggcaggatatcccagccgaatcttggtatgcgtcagctaatagctatcaacaaccattactgccacaaccagatcctgataaggtaaagcaaattgcgacgttactcgaacaagctgagcgtccggttatttacttcgggattgggacgcgtggcgctggtcaaacgttgcaagacatttcaaataaattcaatattccattgattagtacttatccagctaaggcaatcgtaccagacgatttcccattgtacttgggttcaacgttgcgagtggcccaaaagccaggtacggaagcgttggcaaatgcggatactgtacttttcgttggtagcaatttcccatttgcggaagtcgctaattcattcaagaatacaaagcactttatgcaaattgatattgatccggctaagttgggtaagcgccacaaggctgacgtggccctcttggctgacgcgaaggcggccctggcagcgttgcttgatgtcttgccagaacgcgctgaaacgggttggtacaaggccaacgcgcagaacgtggttaactggcgcgcttacttgaacaagttggaaaccaagactgaaggcgacctacagttgtatcaagtttacaaccaaattaaccgcgttaagacggatgacgctatcttctcattggatgttggggatgtgaaccaaacgtcaaaccgtcacttgcacttggctgatacgaatcgtcacttcacgtcgaacttgttcgcaacaatgggcgttggaattcccggcgcgattgcagcccgtctaaataacgctgataagcaagtttggagtttgagtggtgatggtggcgcagcgatggttatgcaggacttggtgacccaagtgcaatacaagttgcccgtgattaacgtggtcttctcaaataaccaatttggtttcatcaaggatgagcaagaggatacgaacaagggttacattggtgtcgagtttaacgatatcgatttctcaaaggtggccgaagcagttggcatgcaaggtttccgggtaacaaagatttctgagttggctgacgtctttgatcaggctgttgcgcttggtaagacggaaccagtattgattgatgcacgtatcagtggcgatcgtccaattccaactgaagcattgcaattggatccgacgacgaatacgccagaacaaatcgcagccttcaaggcccgctttgaagcagaagacttacaaccattgcgtgacttcttggttgccaatgatgttgtggttggggatgcgaatgttgaaaacggtggcttttaatttagtttcatgaataacggcatactgacataaacaaaaacgtctatcatacgattttcatatcgcgtgatagacgtttttatgttagttatcatccaaatcgtaaacgaaattgttgtattcacagtctggacacgtccagtatgggaaatcattgttatcgtcttcccaggctaaaactaggttcaagtcgttagtgttgaattcactaccacaattttcgcaagttactaccattctgatgccctccaaatgttttctttagggtatcaattggatgtgatgattcttggatgtaagacttaatattagcgtaggaaaaatttagattctaaaatgattagtagaggtggacagaaatgattgaaaagaaactacaagaaatgcgcttaattgtggcgcaattagcatcggaaactgaacaactaaataaaaagctaaatgcattgctagcaaccctaagcgaagatactggcacacagatgttgtcacaggatgaaggtgtaaaaaaactaaaacaaattctgaatgaaccagttagtggccattttactctagcaattttggggtctgattttgaaagccgtgagaatttggtaaatcaagccgtggagacagatgattttaagcgaatcatgcaatcggaatttgctgacaactatattggtgcaattcaaaaggggcaggaagccacgaccatgtttaagtctgaattactcgaaccacaagtacttgaacttatggacattcaagagttttcgcgtaaagataagttagggcgattgttggtagacattgcattggaacgtcgcattaagggaaaagttacgattttatctggcaatcaatacgcaaaatacttaattgagaacgccgcattgtatgagttaattgatggagcgacgacaattaatttaacggactaggagtatttagttttgagttttaaacgtaaggtggacttaacagccttaaatgaggttgatccagatgaattaagaaatgattttgcgatgatggttgcgcaactggggtattttgcagcgaaatacgcattgtttaataatgacaacgaaatagttgggtatcgtgacgggcttggtaagctttctgaggagtggttatctttgattgatgcagcatttgatcagcttaaagaagaaactagccaataccgtgtggcgtggtttgtttcaactgagatgttagaatacgtcgcgaaaaatatttatcctggtcaggataaggaagttattctgaatcagttattaaaacacaaacggttgggcgatcgaacaaataaaaatacaaaacgtcagctgaaaagtagtgagggtgtccggtataaaaacattgaagaatcaaatgcaggcctgggggatgcaaaagtgaacggtcattttacctttatgattgagcatgcgtaccctcgactcacatttgcgcatgatgtcatgcgagcaaacaaaagcggtgtcaatattgcaggtacacaggcagtattggacagggtagggctcgtttggattatggagagtcagcatgctattttagaaaaaacgggacgtgattcagaaagtttgttgacattgttaaatgcctatcaggaaaataaatcaggcgtgccaattaccttgttaggaattgacgagaattaaaaaatcaccaatcgagagttcgattggtgatttttgcgttagttatatttttatactcctaattcaggaacaggttcatggatatatccctttgaataatcgacgggaatacgggtacgaataaaacgaccgacatatccttgtcgttcgtaccaattaagcgctaagtggttacctgaatcaacggttgatagccaccacgtacgtccactagttgcaccgacgtagtttgggtgaccaaaataatcgtgtgcttgttcgtactgatcaacgattgaccaaaaataatggccggttgctgatttttgtgcatcggtagagataactgcgtgttggaaatatccaatgtatttcttatcagtggactgtacaattgtctgtgctgatgtgcgacggccatttacgttttctgtccaaccagcggcttgtgtgcttgtcactgatagtacactgtattgctgactttgtgcatcataacgataccacttaccctgtagttcagtcggaaagtgaccgatatttaattgtggtacatcagtgcttggctttgagtgtataccaacgctacgtaaataaaatgtaccgttattaccaaagtgcaagtattcgttactgaattcgtgatcaccttgaattgtccgaccatcactacccacgtagtaaaccagaccaaacgctgttacaaacttattttcctggcgaataccattttggaagtaatagtaagctcccatgtagttgcggataccggtgtagggtaagccgttttcataccacttccagccttgtccagcatccgtgtacccggcagttttcccacgtaaaaagaatgtcccgttgttaccaaaattataggcaacaccgttaataacacggttgccttgcacagcgcgtccattggcatcagtgtagtacgtcattccccaggcgtgacgccagccagaatcttggcggacaccattaataaaccaataataggtgcccatgtaataccgaaagccagtgtagggatgtccgttttctaaccagcgccacccaacatttttcacgttaatgtaccctgtttggctagctgcctgcacggggtgcgcctgtgcgaattgtgtggcgccacctaaagccaacccaagggcactagttactaaaatcttcttaaacatgttcataaaccaaatctcctcataaaccatattatgccttttctacaggaatgcggataaatagtttccagaatggcggtattaaggactttaaatagctgccgaaacgttctgtagaatgctagaattaaacatcataattcttttcgaggggcaaagttatgatttgggactggacgatcttgacaagacggttggaaacggatttctaaaaagttgttgattaaaaatttgaattatcttctcagaaagtactggttggagtgggcttatgcaggggaaaccgtacaaaattaacgttgacaaagcaacgctactatttggaaaaactgaaatctttgacacaataaatgattcgaatcatctaaatgaaatagttgaagatgagtttggcaatcgttatgtagtagtcaaaatcgaaatatttcataattctgttgtccgagggtatttgttagatcgtgtttttcaaggcagcgttcttaaattcacaggagaaacagattctgaatgggccgaaagggtttgggcaaacattaaagataataaagtgccaccgttttaactgtgatgaattttgtattctggagcatggatttagcttttgccacaataccggactttcgtgtttatttttagtaagcgagttaagatgtaagcgtaacatacacactagctgagaaacggaaggtcgaagtgatgtcgattaattttgcagcgttctcgaaccaggatattattgcggctttgcaagcgcaggtcgcaactggtgatgtcttaactgatcaagacacattgtataagtatagtgatgatcaatattcagtggttgaccaagtaatcctgccactcgccgtcattgaagcggccacgattgcagatgtgcaagcagtgctgtccgtcgcccgtcagtaccacttggcggtgattactaaagcaacgggtaccagtgtggtatccggctcacgaggccggtcaggtgcagtgattttgtcacttgatcgcatgaaccatattttggaagtgaaccccgatgactctgtagcagttgttgagccaggggtaattaacaacgatttggataaagctgcccgtgaagttggcttcttctacgcgcctgacccaggctcaaagaacatcagtagtattgggggtaatgtgtcaacaaacgctggtggtatgagttccgtgcgttacggcgtcaccaaggataatattcttggcgtgaaggttgtgcttgcggatggtcgtctagtgacgttaggtggtcgtacgctgaagcaggcgtttggttacgatttgacacaattgtttgttgggtcggaaggaacgttaggtgtgattgttgaaatcaccgtcaagctgagtccaatcccagtggggacgcccttaactggtattgcgttctttaaggatatggctgatttggccaagggaaccggggctttgcgtcgttcaggtgtctacccaaccatgctggaagcgctcgacgcagcaactgtggctgctttggaccgttttgaaggcacgcactacgctgacaaacacgcgacaatgctgattttcaagttagatttctcaacacctgaaattctcaacattagtgagcaaacgctgacggcgaatggtgcttttgacgttcaggtaacggatgatcctgagcaggcagcggcattacttaagttgcgtcaggacatgttgccagctattttcaaggataagaaccacgtcatggaagacatggccttgccgttgtcacagatggccggcatgatggattacatcacgtcgcttggcgagaagtacggtcttgagctatacgttgctgggcatgctggcgatggtaacgtccacccatcaattgtttgggaccaaaatgtgaccgagccaccagctggtgcagcggaagcaattagcgatatgttcaaggaaacgattcgccgtggtgggacgatttcaggtgaacacgcggttggtttgcagaaaaatcagtggaacaattatgaacttggcgagacggattatttgcaacaccaaatcaaagccttattggatccaatgggcctattgaatccacaagtaaagattaattaatcatcaaagcgtgcaagttgtaacattcttgcacgctttgtcatttttctctcattttcactggagaattgggaccgattaggcgtataatttggtcactcgggggaggggattattcatgagattagactttttaacacaccatgattttatgaatcgtgagttaagttggatggcctttaatgagcgtgttttggcgctgagtcaagatgcgggccagccacttttggaaagagcaaactttttaagtatcacgcagagcaattttgatgaatggtacatggtccgcatggcggatttgattcgtgatattcaagctggggatgataagaaggatccggcgggcatgacgccacaacaacaaatgaacgcggtgcgccatgccattcgcaaacagttgcgacaccaataccagagctatgaagctttgaaagttgccttgagcaatgtgcatttaccgattttgccggtggcggatttaaaggcgcatgaccgggcagcggtccgccaaatttttcagcagacgattaagccacagttggtcttaaagacaatggacgcgaccagcttatcagaagtatccaatgggacgattaactttgtcgttggtcatacgggggatgctgactggacgacgtttgccctaccagcgacgacaccacgatttatccgcgtgccaggacctaacagccgttttgtcacgacgaccgatgtcatgacgacgtacattgccgatttagcgactaacatggctgataagaaggtctatcaattccgtatcttgcaagatatgagcatgcccattttgccaaaatcaacgactgatgtggtggatgccattcaagcagaggttgataaacgggcgacggcgccagcaattaatttgacggtgtcggcgcagatgccagccgaattaaaacgccatttgcagcaggttttgggtgttgaccggctccacgtctttaaggttaagggcccactagcgtatgattttgtgaccgaattaaatgacttattgaaacaggaagaccaagctgctgagtttgccttcttgcattatcacccataccagccacaccaggtgaaggcgctagcgggggctgatatttttgataacattgtggcgcaggattaccttgtgcatcatccgtatgacagttatgatgcggtattgaatttcttccagcggtccgcgcatgatgacttggtgtcagaaattggcatttccatttatcgggtgtcgcatgattcaccaattgtggcggcgctcacgcaagcggctcaggcgggtaaacacgtggtggcgctggttgagattaaggcccgttttgatgaaccgaacaatttgaaattggtcgatacactacaagctgctggcgtgaccgtatttacaagttttccagcgatgaaagtccacgccaagatggcctatgttgtccggaacggtcgcacgattgttcatttgggaacgggtaactacaacgataagacggcccacttttacacggactttggtttgtttactgccgatgagcacatggcggctgatgttcggcgtgtgtttgcttatgtgacggggcaagcatcacaaccgcaagaactgactgacattcgaattgcgccaaatatgttgcgggcgaccttgattgaacagattgatgaaatgattgtcgctgccgatgctggtaaacgtcccgaaatctggtttaaagtgaattccatttcagatcaggcgttgattgaacggttgtatatcgcgagccaagccggggtgcacattcatttgctggtccgggggattgcaacagcgatgccgaacctgcctaatgtgagtgagaatatccaaatccgttcaattgttgggcggttactcgaacattcacggatttatctgtttaaacgggacaaagaggatgtgacggtgtatctggcatctgcggatgcgatgccacgtaactttgaccggcgcgtagaactgctgtttccaattcacgatgcggcgttgaaacaccgtattcgtaaaattttccggcagatgtggtcagaccgcgcgcaaagctttaataaaactcgtaatgggcggtatgtccgccgcaagttaaaggcgtattcagatccggtaccggtacaagaacgcttattaatcgccgctgaaaatgaaaacgactaaaactggaggagagatattatgcctacattagcaattttggatcttggttcaaactcggttcgcatgatggtcaatcgcattaatgcagatgggtcatatgaagtattagaccgccgtcaagaaatggtgcgaatgtcagcggggatgggcgatgagaaagtgattcaaccagatgcaattgaccggacaatggtggcgctggctgaatttaaagaaatttatatgacatttgatgaacaggtacacgtgcgggccgtggcgacggctgctgtacgccaggccagcaatcaagcggaatttttggcccgctttaaagaaacgatgggctttgacctgaccgttatctcaggtgatcaggaagcggtgtatgacttcaaaggggttatgaattcgctaccggtgaatgatgcgttaattttagatactggtggggcgtcgactgaaatgattttggtgaagtccggtaagatggtgcaacgtatcagcgtgccaatcggggcagtcaatattacggaagcccatttggaaaaagacatggttagtgcgaagagtttgttcaacgcgttgacggctacgaataaatatttccatgatattgcttggttagcaaatgcggtgaacttgccgattattgcaattggtgggtctaatcgaacgttggctaagattatgcgtcaccgtcgtaatcagttggacttgcccgtgcacggttatcaaatgaccaaggacgaggtcgatgatatttttgctgagttgttgggtgataacaaggcggaacgcattgaaattcgtggtttgtcgaaagcccggggcgatattattatcgggggcgttttgccaattgtgacgttgttgacgattatcgatagtaataaggttattttctcgcagtcaggtattcgtgaaggcgtgctatttgcgacgattgaagagttgactaatcagcatgttttgaaccctgaggcgcgtcaattaacgattgatgccgattaagagccatttttacgccacctattttggacgggtgtacaccagtcgtaaataagaaaagaaggcaagaaacatgaaggcagttgtactaaatcggttaggtgatttcgattcattagttgatgcagaggtccgtgatttgaaggtgtcagctgatggaattttggttaagacgcgcgcggttgcagtggacccgattgatattaagattgggaacggtagccgtggtggtcgagatggcatgattttgggttcgtcggtggctggggatgttattgcggttggtcgcaacgttcgtggcttcaaggttggtgatcggttagccgccaatgtccgtggtggtgaaacctacgcagaagaagttttagtgccagaacgattggcggcacacattcctgataatgtgacgtacgcagccgcagtgtcggttgtgctaggcggccaaactggttacagtggcatcgtccgaggattgcaggttaaggctggtcaacatgttttggttcacggaggctcgggttcagttggattaatggccattcaagcagcacttgatgctggtgccgaagtgagcgccacggccagtggttggggcttacaaatgttgcgcgagaagttcccgcaagtgacggtctttgattataagacggatgatgttgcaactaacggggctgtgtatgatgcagtttacgatacagttggttcagatcgggtgctgacggcttcgtttaaggctactaagcaaaatggtcatgtcttgtcgattgtggcacgttcacatcgtgatccacgctttgttcatttctttaaccaagcgagtggtgaaaccgtgcagactttgttggatggattgagcaacggtcgctttatcagtgtgattgatagcgaattgccattgagcgctgataatgtgcggttggattatgcgcgtctgcaacagggtggcgtgcatggtaagttgattttgacggttgaataggaatatcgtttttacggtaattaatcttaaatatagatttttatttgaacaaacccccgtgagttggtgtaaatcaaaattcacgggggttaattattcgtatttgagaaatttactcgcaatgtattattagattatttatcggagcaggaaatgctaatcgttaagaaatcaatgttttcatattgatgcatggtaaaataagtattaacagttaaagaaaatggggttatgaaatggccgagtttccacaattcattgataataatcgaaaaaatttgtcagatgtacttcgacaaattgcacctaattacaaaacccttagtatagcaacaggatactgggatttacctggtaccctagaaattattaaggaaatagagaattacgaatctattaggctcttaattggacaagagcctttaggacaccatcttcaaaaaagtttcatttgaatatagacaatgatgatgagttgtttccagatgcgtacataaaagatgatttggagtctgaaggtaattccagcgaactagaccaattacgctcaactgctaaaacaatggtaacacttataaagcaaggcaccttagatattcgtgtttatcgtcaacctagattacacgcaaaagcatatatttttggtaatctcggcgatggacattcagtggggataattggttcttcaaacttcacgaaagcaggattaacttcaaattctgagttgaattttttgacagatgattacaaaatcgtagaatttgaaccaaaaacggataatcaagaaaatggacatttaacatggttcaatgagctttggaattctgatggagttgaagattggaatggggactttactgaaataattggtgatagtccagttggtgacaaaacatatggcccatacgatgtttatattcgaacgttgatggaagtctttcctgatgagttaatagaggcagaaccttttgacgaaagtattgaaaaaatactccatccgtttcagaatcaaaacgcactaagtttaagaagaaaattggatagcatgggagtggctatgttatccgattcggttggtcttggaaaaacaattacagccgcagcgattatcaagcagtatattgaagatggaaaatataatattgttatcattccaccggcagcactgaagcagcagtgggtggatgagctggagagtgatcgttggaatttgatagagcatcgagactttgaagtatactctcagcaagatggtgacagaattcagcggttaatcgataagtctgaaaagcgacagggaacacgtaatgaaattgatttattcgtagtagatgaagctcataatttaaggaatgcaggtacaacccggcataatcaaatactaaatctttttcaggaaaatccgaatgcgaaggtgctgttacttactgctacgcctatcaataattcattgatggattttgcaaatcaaatccaacttggttcaaagggagacttagtatcggttaacgtgccttatactacgggtaaagggagtctagaatatatcgattttttcgaggcgcttaaacgcattcagtcggaagcaactaaagctgataaaaaaggtgaaaaatatgactggagtaaacataagaacacgttaacaacaggtatcaggcattacttggtgcgtgctacgcgacagggagtaatcaagaggaatgcgatgaaaccgatcaacggtcaaaaaaaactatttcctgaaacaaatgttcgacaatttgagtatggctatttggaagatgatgctaagctcatccgttcggtcgttgacggccagattccatttgcttttgccggattgaatccactgaaattgaatttagagtttgctagtcaaataacacaaaggactaagcatccaatagacttgttcaaggaaattgataggttgcaaaaagaaggccagcaacaagtagttttggaggagaatgatatttctgagaacctatcaagcgaatatctgtttgataactctcaaaggtcagagtccgtaatttcatcaatctacaagataattaactttcttggatttgctccgtataaaccagatagttacaacaggacggtttatgggaagacaataccccagattaggcaattaaatttgacagggagagcggcaaatagtttacgtgtacaaattgctattcataatatgctacatgtgacatggttaaaacggttagaatcttcgacacacacattggcgaaatctgtcgaaaattattcttcaagaattaccatgttcgaaaaatggttggacaagggatttattgttagtttgtctgatgcgacattgttgggcaaagaatacggtgaggacatcgaaagggcttttgatgattatgacgaatatctaaaagagctggatgatttggtcgatggcgatgaaacaaacctgaaaaaaaggggagtggaacgtaaagtagcagatgagaatgtttttaatattaatcaacttaaagaagatattaatcgggataaattgctagtgtccttgttagaaaaattgctgggcctgttgacgaaagagggacatgatgaaaaattaaatattctagcaaacagaatggtagatttggctagccagaaaaagtacggtgaaaaattattggtatttagtttcttttctgatacggttaactatttgcgtgacgccttgcctcctttactcaaaggaagaattccaaacttcagtgaacgagcggcatttgtttctggaaacaattcacacgttgaagatattgcacgcctgttttcaccgaagagtaagaaatattcattaaaaaaaggcgaattggaactagattacctatttgctactgatgttctttctgagggtcaaaatttgcaagatgctggtgcattagtaaattatgatcttcattggaatcctgttcggatgattcaacgtaatggtcgtgtaaatagattgggttcagactatgatgaggttttgatagctaatgctcggcctactgatgatttggaaatgtatctaaagcttgttcgacgtcttgaaaataaaatagaagcaattaataatactgttggtaatgaccaaagtattttgggtgagaaagaaaaccctattgaatttaatgatttaataaaagcagatgacatatattcaaccgatgccaaaaaggcaacggctgctacaaaagcgctagaaaaccaggacgacattctagattggtcagatgattatgctttagagttgcggaattttatagataatcatgcatccgacagagaagtagaccgtttgaaagccattcctcttggaaaatggaactatcttcctcggaaaaatcaagagttaatacctgatacaaatgaaatttatgccttgtttagcgcaaatggtagaatgactggcacaaatgaattagtacatgatacaggattcgtaaggataacaaaaactggagccaatagaggcccatttagtcaggtgcgagcgtcatacgttgatgaccaggatgctttggtgaagattaaaaccgttccagatgataatgaagtggggatggatttaataaatgtggatagacaagagtatctggaaaaaggtcgtgttgaaatcaatgctcagtttgaaagcaatcgaactttatttgatgtgaaaccatcgcaagctaaagcgttatctttattgggagagtatttcaagcaagatcttttaaacctaattaggacaggaattagaaaatcaaacgataagcgtacgtttgaaaaattagtaagaaaagttaataaagaagttaaagagaatggaactatgaattctacaactgtacacgcatttgaaaaattcattaatcacttattggaaatagaatcacaagaaaaaaagctagaagaagcaaaaggagcattcccacgcacaatgaaccgtttgtggccgtaagctaactaataaacattgataaaccgttgaaacccgttgatataactggatttcagcggttttctttatatgtttttatctctcaaaatataaccagatgtatcaaaaaatttgcgccaatttgcgccaaaatagatgtttttaaaaagatttgcgccatatttgcgccaaaaatcagtctatttcgtcgagaatatttagtgtcttagtctcttcggattgttgcttatcgcgtaataagtgtgcataaatttcttgtgtaattgtcacattagaatgaccaagccgcttcgatgcataattaatatcaacaccttttgatagtaaatatgaaacatgtgagtgacggaggccatgcacagatacaatattttcaaagccgagttcaatttcaattcgttccaaccatgtattattgatggtagcccaacgacgaccatcaaataattctttggcatcattccattctgactttgcattaacaaattttttatagttaccaaagaaacgatctggcatagcaattgtccgaacagatgacttggtttttggggtcgttgactcgccagagcgttgcttggtctttgtgacgctgatagtatgtgcatcaatatcaatatcatcacgggtcagcgctaaagcttcaccagcacgtaacccagatagtgcgattaaataaatcatgaatgatgtacgccacttaattagcttatcgctcttttcgatgtaattgagaagcttgttaaattcatcaacttgaagaaatttttcatcatcagacttcgactccgcacctgggataataacgccataggtgggatcggcaggtattaggccatcgtgaaatgcttgcatcaatatttgtttcatgatttggtgacgtttcataaccgacttgcgtttcatacctttagaataatcgtttaggaacgcttgatatttttgtcgagtaatttggtctaatgttgtgttattgaagtagacatcaacaacaaattttcgaacagcatgccacgcctcacgactattttctttaagtccagcaccaaaacgaagttgctggtactcgtcaaaataatcactgaataaggtgagggtaccttttttaagtgttgggtttccattggtaacagagtattcagcagcccatgcctcagcttctttctttgtcttgaaaccacgtttaccttttttacgatattttccagaagcgtctttgaatgatatttcaacgcgccagccagtattggttttatacactgacattagtttaaacctaaccttcctataaaagtaaaaggcagtttaacgacgtacccgggtctatttctataatattaatcgaaaacaaaccgagaacgtttcaagaggtccagttttgttgaataactgattggcacattcccggttttagcgatagaggggatgcgcctttttattgagcaataactgccattttttctatgaatgccaattttgtgtgacggctagcaaataggaattcattgaattttccgcgcttattggcggtgtaatttagtgaataagcgtatttttgggaagcctcgttataaatatcggctatttgtggcgcgttatcgtaagtagtaatccagtagtagtcattcattgccaaaatgtttttggacagagttgcatgttgtgaattgtttatgaaagaaaggtataagttttttccttgaacatagtagggtggatcaaaaaaaataaatgtattattgggttcatagtctgaacttgtaacgatgacgttaataagttcgttcgcatccaaattgtataggtcaatatcagttgctctatcagaaattgacttaattttcctaattaacgtatttttattaaatctagcatctagttgatactttccggactgccttcgtccaccaattggcccgccactgattatgccgctaacattcatacgatttagcatcaatgtagtgaaagcattttctatcgataatgggtcatgatgggatttttcatgacgacttttaatgtcatcccaatattgaattaattgagaaggggttagtacgttcggcgttgtatagtcgaatggcacgtcagataacctgtttataagttcgcgtgaattgttgataacggcgtgccaaacagcgtgaatgctagggtcaaagtcgtttataacaattctttcaacttttcttttaaggagaagctcaattgcaattcctgctccgcctgcgaacggttcaatgtaggtgccagatatattgttggccaacagtgtttcagctacgaagtcgaaaagctgtgacttgccaccagggtaccgaagcggggttgaggttcgtgtttgtgccatgattaatacctcctttctggtaattttaacaatcgataattgctttggccagagtgagcgttacttctgaattcggttgattgttgaacttaatctgccaaaaaactcagatacagcatctttgttttcgggcatggttgaccacttaacgagcaatttgttcataaacaacatattatcctcaaaccaacgttttatcttagcaccgtcttctgatccgccagcatatttttcggaaaaaggtccgttattaataatgaattgtttattcaaattgtgattcatcatgaggtcatcaaggaagaactggtcgtgggcatcgaggctatttatgaagttccacattgttttttcaattcgctcattaccgggaagaatgaggatgtttctgccgtaaaaggcggaagttgatagtgcaatatgatgctctacctcctcgcgtgagagctctgagtcaacaattccaatcatgttcgaaaattgtgaaccaccggtagacattatctttaggagctttacccaatcgatgtttgtatcgatgaaattcagttttgagatatcgtgccaaccacgagcatgtgcaagggtggatataaaccaccgagcgactgcatcttctgtaaaaacagtcacaggttctgaaatttctgttgttgtgctgtaaaggtcacttaaattagctctaaaaaaatcgggattttgtttgtctaaggcttgtacgcgattgtcgtttgagtaattgcgagtcaggtatttaactgagattggctcatggactttttgaagctttactgcgtgttcgagcagtgtaattgaatggctagttgcaattatttgtaggttaagctgtttggactttttaactaaataatctaatagtctgttttgtgcagcagcgtgaagcgtgacgtcaatctcatcaataactagaagtccgccaatgtaccctgggtattcattacttaacctttcaaatgactggactgccatgattatttggcttaacgtactttgaccaacggagttgctaagtggtccatatgagggtgaatttataccggcatttttaattgactgatcatttaaggaaacagacgccatacttatttcattattgtcggtcattcccataatttgcttaaatgctgacgttaacttggcctgatcatcatctggtaagattgtagtcttagctgaggtggcttctcctgtgggatatgaacgcatcattcccaaatataacactggccattcaatttttttctcattcggctttgtctttgtctttacaggcaagaatcggaaacgtttttctgacactacacggtcttctttttcgtatagttctttatcagacaatttttccatttgtgcagcccaatctggattagattcgctcgattcgataatgtcagaaggacggatttttttgaatatgtgttttcttttttttatgttttgtaaaatgggccttagagccagtttgtcaggataatcggatgaatctggtgtgtctgagaacgaaatagttgcacctggattgtcttcgtcggttaaaattgcagaatctgatatttcgtcaaataggattaagtcggccaaatcacccctaaaattacgtccgtcaatagacttataaccttttaactctgacgtagcagataaaagagcaagtatggttgatttacctattccgttttggcctgaaattatggtgacgccttcagcaaaatcaaccgaaaagcttggcctgtatgctctgaaatttttaatcgaaagattgtttatgtacatattatttcctttcaagcctcactcaatcgagtggggatttttatgtatcccgcagagcgggtagggcattaacccaaaatgtcagcctttttcttgtcaaaatcttcttgtgtgatgattccgtcatcaagaagtgacttaagttcgcgtaaatcggacaagttactatttgaggatgcctttgtttcaggttggggcttctttgcgtccatgcgttcctttaaagtagggtagttatcaattgcagagtgaacgtttggcaaatcgtttttcacccattttgcaatagctaggaatgtatacatgatatgttcagttgattttccgtcagctgaattaattaccagtttttcgccgttaaacatgagacgcccattgatgaactttgacttcttataagaaatcacgcccagatcagaaagtggaatgaatttgtcattatcggtaaattgattcaccatgttaattcccatgaacagcaatccatcttcttcaaaactaattacgtatattttgtttagtaatgcgttccaaccaccaatcaaatattcaagcttattgcttgtttcgacataagctaggcgtgatgtgtcgccagaataaccaagactgactttctttgcagcaatatcttctagttttaaggcacttgccatttacccaattctccttaagcttttaacgtcaatcctgtctggacgttgtgtcacgcgtgacgtacggattcctttacaattgcttcaaaatcactaggcaagttaaaccaattcataaagtcgtagtaattgcgattttctaaggggatgtcttcatagatgattttagctagtcgccaaaccattccgcggttagcgatacgctcagcattgtttttaaaaccgatactaaactgataactttttgctgagccatctccgtctaatacgtgagacaactcgtgagccttacgggcaacaacagggacgtcactgtctgaaacgatattaatcactattaggggacgtttgttttctctaatgaatacgacgtcgggatcatatgtctcgaactcgtcatacattatgttgatgccagctgctttaatttgtgcgtcaattctctcttctaagtctttaaaatccatatggtctaatcctcgtcatcatctactatctttaggatgtcgaggatttttcttttggccttgtctgagagttccttaccttggaattccatgacaacaccttgtttgcggagtgcttcgtctaagttgatgtattcaggacttttggtttctgtggcatcaccaatcaactcgcttacagaaattgagtaaatgtttgcgagttccttggcaacatccattcttggtttggcagcacctcgttcccaagttgaaacagtcgtctttgccgtgtgaagaatatcagcaagttgttgttgggtgtatccgtgttgcttgcgcaacctttttagattttctgcaacggttatatcgttagccatttgtatgtcctcataactacttttgtttattattataaaactaaagtactaccaatttgaacaaaagtattgactgtacggtttattcgtactagaatgtaaacataccttaagaaaggaggcggacgtatgggatatacgttagctcaacttcgtgttggtaagcgttggactcaaaaagaagcggccgatgctataggcgttagcttagcttcatgggctaagtgggagaaccacaagtcgtcgccgacccaacgaaatatcgataagatactcacatcatttaatgtcgcttatgacgacattattttttaaatcaaagtacggtctacttgtacaaaacggaagaagtacggaaagagaacgtaacgatgaaggaaaccttgaaattaaagacggttgaacaataacaaatccgaaggaggctatttatggcaaatgaagtgcaagtatttaatttcgaacagatgaatgttcgaactgtaattattgatggtgaaccttggttcgtcgggaaagatgtagcagtagccttgggttattcaaacaccaaggatgcgttaaaccgtcatgttgatgatgaagataagcaggggtcgcgtttcacgacctcaggtcaaagtcgcgaaatgacagtgattaacgaatctggtgtctactcactaatttttggcagcaagttgccatctgcaaaacaatttaagcgctgggtaaaaaccgaagtcttgccaagcattcgtaagactggtggttaccaagcgataccaatgactttggatgaaaagttggctttggcacttacatcagagcaagacactcgacaacgagttggtgcgctagaaggaaaggttgaaacgattatcatcaatcaacctctaaatgcgactgattatgatgctgttactaaagcggtaagtgatcgtgttcatgattgggctcgtgcccaccgaattccaaccaagaagcgtggccctttgttcaaagaccttaatcatcagattaagcaggtaacgggtgctggcaatcgaactcgaattaagtcgtcgcaatatgacgttgttatgagcttcattgcaacatggcaaccttcaagcgccacggttattcaagttcaacagatggaactggaggtgtaaacatggcccgcttttctgaaaagacagcaaccattgaagagcttgagcaacgccgaacggttggtcaaacgggagcgagtcgattatttaatcgttcacctaattggtttacgacccatttgaaagggtcaaagaagttcatgcagaacgtgcccaataagacgccagatgcatatcggccaacatatttagtttcggatgtgttgcgttaccgcaagttaaacgattggtggtaatcagatgatttatttttttttggtggtggcggcattaacgacactaatcgcgtacacagtggtcgtagtaatcatgctgaataagttaggccagcatggcattacgttacgaccacgagatgttaagcgcattgaggcttacacaaatgcacaggcaaaaaataagtatatggaggattaacaatgaatgacggatctatcttggtcatgatttggatggttgcggcggcggttggaacattcgtgatgttggccttgtatgagttgggtgaatgtttcattcaacgtgtttggcttaagtcatggggcccacgagtatattttgctggtcgggccttgattaagggtgacgtgaaggttgctcgtaagtaattgaataaccgcatccgtcgttcaactagggtgtcgagttactgcaacgaaatgttttcataagtgatttcgtttcgacatccgagttgagcgacggacagaaaggtggctcaaatgttttatgtattaaaaaagccattaacgactgcaatcgctaatggcttgggtaatgaatttcgcaagttcaattatccttcgattttatcacgggaggcgagtgtatgactagctatgaaacatgggcggtgcttgataccggcaaagttgttaagacaatcgaaccggtttatcaccctgaatgggccaaagcgccggatacaacgtacatcaagtttcaagagcctgtaacaacggaggattaaaaaatgacagaacaaaacttcaatgtaacgacgacgcagacacaacagttgattgcttcatccgttgcaaatgattttaagggattggttgaaacacaaggtttcaaggttcctgaaaactaccacgtggctaacgcattgcaagaatctgtggcaatgctgccaacaatcaagggaattgagaacgtgacaccagattcaatcaagaagtcactgttcgacatggttgttcaaggactgagccctgcaaagacgcaagtgtacttcattgcatacggtcgtcagttgcaaatgcagcgatcatacttcgggactcaacaagttctgaagcgattacctgaaattgcaaatatcgcagcattcattgttcacgaaggtgaagacttccaagtcgattacaacgaagacggcgaattgattgtcaaagaacaccacacggatttcatgaagctggataacccaattgttggtgcgtatgcagtaatcactaagactgatggtacaaagcaatacgaagtcatgactaagaagcaaattgacgcttcttggggacaatcacgccaactgaatgtgcacaagaagttcccagaagaaatggcaaagcgaacagtaatcaatcgtgctgcgaagaacattattaacacgactgatgatgaaagtgcattggtaaatgcaattaacggaaccactgcaaatgagtttggacctgatccacgagatgtgacacctgaagttcaggaaaagccaaagggtgcatttgctcgtatggcgaaaaaagaccccgtgaagagctttgaagaagctcatgaacaaactcatgcagaagagccagaaaaggcagtggaagccccacaagagccagcagatacatcagagccagaaggaacggacgaagctgttgctccagaaggtagtgtgacaaacgctcacaccgttccagaaattaaggcatggctagaggaacgtaatattccctatccaccaaaggcaaacaagcaaacgttgttgaacatggctgctgagtatgaattcaacatgacaaatcgtccaacaacagatgatgaagagctggacatgccagatgaacaacctgattgggttcctgaagaaaatacacaaacggaattcagcacagctgacttgttccaaccggaggcgtaatcatgacagaagaatatgactactatgatccacgtgacgcattcgttcatatgcatgcttcaacgttcaagaatttcttgtttgctggtgaagccgaagcattggctcaaatgcgtggtgaatatgaaattatcccaaataagacggctttgttagtaggtaactacttgcattcatactttgagtctgctaaggcacaccaacaattcaaggaagaacaccctgaaatcatttctactcgtggtgcttcaaagggacagctaaagacggaatacaaacttgctcaggcaatgattgaccgtatcgaagctgatgaaaacatcatggcacttgtagatggcgcacctgataaagagtcggttatcgaaggtgttattgatggtgttaagtggcgtggaaagttagatgcggtcaatttcgaagaaggatatttcgttgacttcaagacagttaagtcgttgaaagagtaccacagcttaatcggtggtgaatggtcagagcactatggcgaatacgaaaacttctttatcggacgtggttatcacttacaaatggccgcttatcaagagatgctgcgccaaatgactggacgagagtttgaggtctacattgtggccgtcagcaaggaagatgagccgttggctgatgtttatcagatttcacaggaaacgcttgatgcgggtctggaagaagtcaggacacatcaaccacgaattgttcaactgattaacggtgaggttgaaccggacaatgcgaacacttatagccgactatatcgaaccaacttccgagttgatccagaaaatgtagtgacgatgtagtgaataaggacgctgacttaatcagccgaatggggtgagaggcccagaaaggagtaaagcatgggtggaacattcgacatgacggaagatacagccgtcaggtttgctgaattgattgcatctaagtcggatacgaagtttgacaagcaacaatttttggaaaacttccgtaaaggtgcggcctcaacggctgaggatattccagaagttagtggtgttcttgctgataagattgcgcgttttcgtaagactgaaacacgccggtattatccaatgtcgttgttcgtttcagaagatgtgaagttttttgaattcaaggattggaaagcgccaacgcaagagcatcacgatattggtaaaaaggcagtcattgctgctaagaaacttgaacaaacagcaggcaattacgtattagttggacgtgctggaacgggtaagacagctttatcagtagcaatgctgaatgagttgatgaaagttaagtcagggttgtttgttaatttagtgaatttgcggtcgttgatgttgatgtcaatcaatgatgagcgtgccaagcaagactacaacatgatcattcgtggaatgaaggaagttgatgtcttagtgatggacgactttggaaaagaatctgggtctggcggagctactgacaagatgacggaaatcttgtacggcattgtaaacgctcgtatcggcaagacaacaatcatcacaactaatgacaatttgactgagttgaacgctaagtatgatgaaagccttactagccggctcattcctaaagacaaggacaaaatcatcatcttccaaggtattgatgattatcgggaggcttaacaatgcaggacacattgaataatgcattagagagtaacttcacgcgaattccaaattcggtaattgtggaccctgtattcaacggacgacgtgatggtgcttttagggcatgggtactcatggctagtaagccacaaggatttcaattttatacagaagttttggcccgtgagttagatatttctcgtcaagctatggctgatcgaatggattatttggttgaacatgactatctcattaaacaaccatatcgcagttcaggtggtcaacgtgctaatgcttggacagtggttattccggaaatagccatgtcaattcgaaccaacatggctcaacccaacatggttcaaaccaacatggctcgacttgacactaacaagaaggaccctaaacaagaagtattaattaacaagatagataaattagcaaacagtgaacgtcggactgacaagacagacgataactatagtaatagcgctgtaacagctatgtctgtcatcagtcaatcgattactgataacggtttggactttgtttatgggccgttacaacggcaacaactgcaagaatatgtcactaacgacggtatggatgcagaagttgtagctgatgcaattaaggtcactcgtgaaagcaaccaaaactcattcaagtacacagacggtattttgaaaaatcgcctagcaaaacatttgctgacaatgagtgccgtaattgataacgagaagaagcgtaactacgcctctgataagtatggtgacaagcagcagaaggagatttggtaatgggtgacaagaagttccacgtagtggccaacgtgtttgatgatcaacgctattggggcagctacacgttgcaagaagctggaaataagttgcttgaactcaaagaatcgtttgagttaagtgcttctgaaatttggctagaacaagcgtactagacgctgagcgacacaagagtagtgcggagtaactccgcgggtatgggtgggcaaacgaggtaaagaagatatggaacaccaaactattattacgttggccattgaaaattttgatgagtggcaagagttggcaaaaaaagctcagaaacaagcttctgagctgaatgatacgttaaatcgcattcaagagtttcgaccaatcttgaatacaccaaagaacaagtgattaatccttttgcaaagcaaccaagttaaaggcggcatcatctggaaaacgatatgagtcaaaagttagacctgactcaaggaacttaacattataagcaatattgaaagtgttaagtggttttaaactcttatcggtgtcgtttacgagagaaatgatagcgttgattaaatgttcatcatttggaactgatgagcgtttggtaaacgaatctaaaaatgtttggaaatattttttccgtagatcgattacttgataatcagttccttcttcaaaatctgtgaaacgcacagtctcttcttgaaatcgactattgtatttcaattcttttgggaaaaaatcaaagtcatttttaagaaaatttgccactaacaatttcccgttatattcaacgataggtcggtatgttggattgttcatgtcttcggaaattattgataatgcgtaacttgtgttttgtaaatcggtaaagttcataaaaattctccttaagtgaggtcagtaagttttaactgactagatgtctataacaaggcgttagcaatcaatcggactaattgctaacaagatgattatagcatgtttatggaatgtggtcggagggggtcaaattgatactaagtagttggataaatcagcagctaaaacaaaaaaacaagtcggtctattggctcgcacaggaaactggcatcgccaccagtacgttgtatgcggttatgaaccaaaataacaaagcgctcggattggaacggttaattaaggttgcgattgcattagatgcggacttgaacgaattaaaaaaataatcgtgaaaagaggtggtgacaaatggctaagaaattaccaaagtacattgtttttaataagaatgcgggctaccggtctccataccataagccggttgatgcgagtgatgatttgaaaatgttgcgaacttattacagcggtgacgcgtacgaaattatgcgggttgttccgttggttgaacgagaggagtggtaagagatatgtggattgttaagtacaacacggcgaagcgtcgttggttccgaactgagaaggttactcaggttgaggtgtttgcaacacgttcagaggcggcaatgtatatgtacgcattgatgaagaatggctatcacccatggttggaacgtgttcaaagcgagtcggttgaacgattgctgacatcatcagttgagaatgcgttcaattgggcccggggatcatttgggaattctgaactggctagtgtgtcatctgtagcgattgcagacgcctggtggaagagtggtgaagctcagaatgaataatcgtttagttatcccgatgtcagcattcgaaattaaatggcatgataaaaagtcatctccatttcggatgtcaccgttgacgcttaataagtacgttgaaattagtgggttaactcgtggtcggccaattcttaatcggcacaaagcagctatccagtacaaaattcaaccaatcgtcgttgaagcaatcactaacggacttgagattgagtatccagctcaatttagtttcgaatggtacttgaaggacaaacgaacagacttagacaacattgctttcatgcacaagttcgtttttgacgcatttcagaaggtttcggtgcaagataaggaatttatgccgggagatggtttgaagttcgtggcgggcctgtcagacgtttttgcgggtatcgacaaaggtaatgaacgggtagaaatcacttggcagcatgttgattcaaagtgaggcataagtcatggaagacaaacgaggtgaaccatggacggttgatgacgtcgacaggctgtttgttttgctcaatcaggggcttaggaagcgtgacatgagtttctatctgttgcgaactgaaaacgccatacgagccaaactgtggcgaattatgaaagagcatcaatggaagaaggaacggtttatggatttacctgaaacaacggtgcggggatggttcatgattttgaccaacaagccactgtttaccgaaattgaacgtgacgggtacgttatcaagaatatcggccccaacatgatttcagtgattggcaaagaaacggttaacaaagaagttggtcaatggttattcaggagcgacttcattgaaggtgatccgcaccaaaacaaagaaattattgaagataagcaagcaaacgaaacgcagttaagtttgttctaggagaaggatatgtgggaagtatattggcacacgccatatggaacggttgagtacgttgatgcagatactgattacgatcggttggccggaaagtatcacggcaagatgtttgaaatcgtggaggcttagtaatggcacgagaaatcaagtttagagcatggtacacaccgtttagtggaagtaaattcggccagaaatttgtctatggaaacaaagtgctttctttgcaaagcatgaatccagaccgctatgtattagagcaatatacaggcatgactgatattaacggagctgaaatctacgagggagatgtgctgaaggacgttgatgatggatttgttattggcgaggtgaaattcttggatggaatgtggcttgtggctgataacttcttaagcgacgtgcgacttaatgaagtcatagggaacattcacgaaaatctggacttaatcaaggcggtggattgatgcaagcagttaaaaaggcgattccggttgatgtatatcaatttggcaaaaatgcggcagtacctgattggtttgctaaggcgttgagtgacagacgaattgttacttatacgaatgatgaggcaaatccgttcagcaaatcagacgaggttgaagtcattacgttagaaggcgtaatgcacggtaacaagggcgattatgtcttacatggaaagaatgatgacatttgggtagtccgcgaagatattttcaacgacacgtatgaggtgatcaagtgacaacgaaggatgatacgtacaatacagtgctagcacgtcgattaatcggtgagttgaggaacgacaagattgttgtggatagcatggaaatgaaggcgaatgttgaaaagaacgtcaaatcacgagattactggcgtggatacaacgaagcaattgatgatgcaattagtcgaattaagcgagtttgggaggtgtgatatgggtttgaattactcatttaccaaaacagtgaatacgtcggtagtgattgagcgccaagggagcggccggacaaatctaacggatgttatgaaggtatctatcgataagattgagcgacttcataaggcacatcctgattggtcagcctcacggttatcaaatgctgcgtcagccacacaaaatttggtgatgcacgttgctgacatgcacggttggcagcttaagagttctaagacaaaccatgtacctaacttctctaaggcatagaaaaaacgccagacactaacttaatagagcccagcgcttatgttttcgtagcagataacattttagcatacgggggcaggttggttatggcacttttgagaaagctgaacgagaaggcaactgaagcagcagttcgcgacttctttgaatctgaatttaagcacattaaagcccaggcacgcatcaatcacgttgatctaaagtctccggtgattagtgacatgcctggtggcccaaaaaatggtaattcagttgaagagaagctcacgaaccacatgcaagcgaaggtatatatggaacaggtgaggcaggcaattaacgcaatgccagagccagagaaatatttcttcaagtatcgctatatagacgatatggaatggattgatatttctgaattaatgaatatgacaccaaggacgggacaaaagtacattggccgggcattgcgatatttcgctgatgcattctctgatgttcacgactttcgggtattttacgcagacgatttagaactttgagttggttcgcatttgcttcgcatcgggttcgcatttgtttcgtttttaagtcgcacaggcttcgcacgccccgttgtattatgttagagtcgaatgattaggaaatgcaggaacaggcgcctatcattcgattaacttgttggtcaatcaatggcatacgaagttactcctcgaatatggtaagtgacaaacaatacaatggttgttcgtaaagcgctgggtgggcgccgttcggttcgattccgaatgtcactattaaaactaaatagtccgttgctccacaaagcgatacggacatcttggaatatatgcgaatggaaagcagacgagttgctaactcgttgctggtaacacagttgcgggttcgagccccgtgtattcctttacatagcaaaaataaatacaaaggataatcttccggttcgtaggtttaccgttgtattcgttttaaacgacatgtcagctgctatgtctggcgtacatactcaaaactattaaggatagactttgatagttattaccggggtcaggacttgtatgtggtcgctggtctgtacatatcaataaagaaagcgaaggacaattgctttctaaaatcaataccgggttagggtcgtggatatgccgatgcctaacatttgaaaccagttatcagggtgcgacctgacggctggtttttattttgtcattgcaagtacatattttggagggaagagattatgagtaaggaaacggcagaagtgctaaccagtttgaaacaagaatacgttgagctaaagacaaagattgcaggtgcagaagctacggtgttgattaaggcgcttgatgttaagccaacggaattgttgcgtgaccaggtagaggctatgaagatgtatgccgaagcgttggaaacacgcatgaagtacatcgtcgcaaatccggagtaattggctatggttcatgatccaggttatcgacgtgcagagtcagccattattggccgaatagtgaatgaagagaagaagcccaggaagaaacacgtgaaagtcatcaaggaagttaagccacgtactccaaggacgcaagtagcacgttattgataagggcgtgtgagaggcggtgagttgagtggcaagacagagaaatcctaagcgtgatgaagctaggtcgctgtgggaggcggacagggaccgcccactgaaagatattgctgatgaactcggtataacaagtagcaccgttagaaagtggaagtcacaggataattgggagaaactcacaactacagaatcaccaccgaaaaaaagaaaatccaaagagagcgctccgattgaaaaggagcgctctctttcacttgaagaagctattgaagaagttgatgatagtgaacttactgacaagcaaaaagcctttgttatcgagtatgtgcggacttttaatgctacccagtcatacatgaacgtgtatggagttgattacagtacagctaaaacgaacgcatctagaatgctaacaaatgctaacctaaaatcagaaattgaacgagtgcgtaatgcgagacttcaagagcttggagccaacaaaaacgacgtcttggcggatttgatgaagcaagcattttccgatgtgggtgattatgtcgagtttggagcgactgaccaatatgcgactaaaactgtgttcaagggtggcaagcaggaagaagaatacatacttgatgtgaatggcgaaccaatcatccatcatcagtcttgggtgcagctaaaagataaatcagtggtcgatacaagcctgattaagaaagtgtcgattggccgtgatggtgtagtgcttgatttgtatgacaaacagaaggcacaggaacgtttattggctgaaatcagtaaatcacagcaggctgaacttgaaagcgcccgtatgcgccgtgtaatcgctgacgcaatcattgcagaagctaaggcggctgctattcaaacaactggcgctgaacaagagcgtcaagatgaacaaattgatcgtttgcttgctggtatcgaaattattgcgcaagaagaacgtagaaaggcggatgaagagaatggctaaaacggtagagaacccaatgttcctaactaagaagcaaattcaaaccattggctttcttgctagagacgattggaacatgatgattaatcatggcggagttcgtgctggtaagacgttcattgataatctgatgtttctatatgagattgagcgtgttcgtaagattgcaagtaggcaaggaatatcgacgcctatgtacatcatgtctggtgccactgctaaaacgattgaaaacaacatcattcaaccgcttggtgaagtgttcaacatctatccaactgccgataagtacaataacctgtacattcgggacgtgaagattgttctggcgtaccacggttcaattagtggtttgcagtccattcgtggtatgacggcttttggagcctatattaacgaggcgtcattggctaactccgaagtgttttctgaaatattgaagcgtatctcagctattgattcggcccgtgttctggttgatacaaacccggatattccgtctcattggcttaagaccgactacattgataaggcaatcaattctgacagtgtgagatacacacctgaagaaaagaaacacagccaaatcattcagaatcagttcattttggacgacaacacggcactgagtaagaagaccagagataacatcaaggcacttacaccaagtggcatgttgtatgatcgggcaatttatggccgttgggtgtctggtgaaggggctgtttatgctgactttgacgaaaacaagcactttatcactgagggcgaattgccagtcacaatggaccgatatgttggtggcgttgactggggttatgaacacgcgggtgttattcaagtttggggcgttcttggagacacatactacctggttaaggaagtggcaaaacaacaccaagagattgattattgggtcggtgtagcaaaagaggtcattgaagaatacggaaatattgtattctgggccgatactgcccggcctgagcacattgcaaggtttgttaacgaaggtatcgacgctcaatatgctgacaagaagaagctaaagggtatcgaagatgtggcccggcaaattaaagccgacaaattatttgttgtgcgagataacgctaaagagtttgcatccgaagtatttgcctatgtatgggaccaaaagaagggtgaacccgtcaaagatagggaccacgcaatggatacggcacgatatgttattcacaacgacctatctgaagacaatgaagtacaaattttacgaggtattttctaatggcaatcaattttaatagtgaacggttgtcagcagatgataaccaggtattttattttgaccaacttgatggggatgcactgcttagtccagatgagttgagcagcttaattagtcaacatcaaggacatgaactaatgcatcgatacaatcggttgcggaagtattatgttggtcaacacaagattttaaacaagccacgcaagcgacaaggaaagccagatactcgattagtcgtcaattttgctaaagaattggtggataatgaggtcggatatttcgctggtacgccggtaaagttcgattacgttgagaatggtgattctaacgaagaaattgacaagcaaattaacgagttcgttaataacaacaatttaactgatgttgtcgcagaactcgctaagcaggttgatatttttggccgatcatacttgttgatgtatcagaatgaagaaaagcaaacacgagtagcaccggttgagccacgcaacgcatttgttgtgtatgcgaatacggttgatgccaagccgttgtttggtatttattacacgacacgaaacaaaaacaacggcgtttctggcatgctatatactgatgattttgtgtataacttccaaggtacaaatggcggagatattatcattgatactgaaactgccacggaaaacttgttcaaggctgttccaattattgagttctattcaaacgttgaacgacaaggattgtatgaacaagtaatcgggctaattgatgccgttgatgaggcattgagcaacaagaacaatgatattgagtatttctcaaacacaattatgaagattattaacgccaatgttaagcagcaaacaatggacgatatgattgataaacgcgtcattgtggtccctgcggttaacccggaaaccccggttgacattgatttcttgaataagcctgatgccgacaccattcaagagaatttcttggatagagcaattgatatgatttacaccaagtcaaacgttgctaacttccaagatgaagtctttggcacggcgtctggtaccgccctagagtttaagctgcaagcaatgagcacggcagccaatatgaaagagcgcaagtttaagatgtcgttgagcaagatgtggcgtctaggctttaatgtcggcgctacattgccacttgatccaactggtcagcaagccaataacattcaaatgacctttaagcggacagtgccacacaatattcaagatgaagcgactacagctaaggcgttgcaagatgtcgttagtcgtcgtactgctatcagtgtgttgtcgttcgttgatgaccctgatgctgaattgaaggcgctggaagatgagcaacaagaggctgctaaacgaagtcaacaaatgatgtcgttggcagatgatgagtcggactctgatttcaacaagggagatgcagctaatggtgcaactgagcgataaagttcatatgcttgagaccatgaaacatgatcaggatattaacgtgaagcttgagcgcaaagcagacaagcacacaaacggaatgagcgctgaattaggcgctttttttattgctcacgttaaggacgaccacatagacaagcaaatgcttaagcaggcgcctaattctgatgatgtagcgcgtttgcataagtggtcgagaatacccaagagtacagaaaaggctgttaaacagcgaaaaatgctgtatttaggtatgggtgcctcagacatggaaatgtatgtgcaagcaatggtggggatgttaatgctcccgcttgcggttgaatcatacaggttgatggaagcgacgctgcatgatgagtttgttggtgaatatcaacgtcagagtgacgaattaggactgaatgctgacatttcagacagcaaggtcaataagttgtctcataaatcgtttgataataaaacgccacagaaagccttctggacgacgtttgacaagtcggttgctaatgtatcgcttgaactcacaaaagccattcagcaagacgtcagtgccaaagaatggtctattatcacgggaggttagtagttatggatgaagattacgaaaactacactgatgatgattatgttgatgagttgaaacaatacgctcaagacattaagagcgagcaagcacaagatgaggcggaacgacgcaaacaattagccgagatggtcggtggttatatgggcctttggtggtatttgcgttcgttcagttctagcacagctcgtaacattcgaacttatgctgcagttgccgatcgtgaagctaagattgaagcgtggaccaatggcacaccagaggatagcaagtccgctaagttatcagctgctgccgaagaacgtgccaaaaagctggcgccatttcgtgatttatctggttcgaaagaccaaaaggtgatgctggttaatgagtttggcgcctgcgctgtatgtgcgccctatgttggcaaaatatacacgcttgaagaagcgcaagagttggttccgtttcatcctaattgtcgttgcacactggttcgtgttgaaaatgattccaagggtgctttagttgcgggaatatcagttggagcattccgctaccaggatgaaaagggaccacaattatcagagaaagatattgcggaattactggattattttgatacgcctgatagcgtattagctcggggtgaagatgtagatggacacttggatagtaaagatgcgcttggagtaacttgggacgaaaatactatactaattcattcgcaagcagatagagccacgttagctgaagaattgtatcaccgaaaacaattgatggaaggtgcaaagtttgacacagcgcatatgaactcaattgaaattgaagcaaagcaattccttattgataacgctagtgtgttaaaattaagtcaggtagaaatagatgccacattaagtcaaatgcaaaattataagtaaggagtgaccgttatgaaatatgatgttatttcaagttttagcttgaatgggaaaactgaagtgactttggatgttgcggtgactgatatgcctacttataaggctgcattagacgctgatggtaatttattcaaagttttgagatttacgtttccaaaaaccagtggcattccaaatgcctcactagttttagaggggatttacaaaggcaaccaaattgaactattaaattaaggcaaacgcttagctagaaatggctaggcgtttttattatgcccaaaacgtgctgattggcttaaaaagctgcaaggaattgagaggcgacggccttaaaacggaggtagaaacatggctgaagaacagaacggagcacaacccggtgcaggtacacccggtgcagctgacggtggtcaaggtagcgttgagtttagcgaagaacaacaagcacgaattgatgtaatgattgctgaacgagtatcacgagccaataagagtgcagaagcgaaggcagcacaagatttggctgatgctcgtgcaaagtgggaagcggatcaagaagaggcggctaagattgcccagatgtctgaacaacaacgcaaggaacacgatgctgaaaaggccagtgaagaacttgtagcagctcgtaagcgcgctgacgaattgcaagcggagctcactcgtacacaaatggtcagtgaggcaagcaagatgttagctgacaagggccttgtggctgatgaagacacattggactttgtagttcgtgatacagctgatgagacgactgcagcagtagcagcgttcaccaagttgattgatgaaaaggttgaagctaagcgacaagagtcattacgcggaaagacacctaataacccaggaaccactggggcaagtggaaagtctttggggcagattgccgccgaacgtgctaacggtactgtttcaagtcatgtcgcagacgatttctttggcactaagtgataggaggatgtacgaatgaagtacacgacgacaaaggttgaccaagtgaattggttggcatcttcaaagtttcaagcgtttactgagtcagctgataaggaatatgactcaggtgctgtgtttatgaaggatggtgctgttgcaggtttggttgttaatcatgttgttggttcaactgatgatccaatgccagcatcagtaatggttgaagggtatgtattgccagaccgattgccagtagctttgactgctgaccaagttactgcattgaaggaaatcggtattaagttccgcggtgaaacggcggcgccggcaacgcaaagtggaacggacaccgcgacttctgaaaactaatttaaggagatataactaatggcaaatattttggatttgttccctcatcaagatgtgttggattacaccaagacaattaagacgccagaccttttgggggcgaagttgttcccatcacgtaaggtgcaatctaacgacatcaaggtattgacgtcaggaactacggcgccagtaattgctcacgttcacgcatttgatactgaagcagagattggtgaccgtacagcacaagtaacggaaactgcaccactattcctaaagaaaaagatgattcttaaggaagatgatttggttaagttgcgtacacctcgaacgactgaagaacaaaactacatcattaacaatgtatatgatgatttgggtaacattgttcgttcaattgatgcagcaactgaattgatgcgaattcaagcgttgatggctggtgtaatcaatacgaaggatgctagcggaaatgcatacaagattgattacaagattgataagtcacaaaagggtaccgcagacttcgcggatgctaccaaggacccaattgaacaaattttggaatgggctcaatctgtttcagtaacaccaacccgtgcaatcatgtctcaaaaggctttgtttgcgttgcgtaagaaccctaatgttgttgccgatatttttggttcaaataacggccgcactgttatgcaatctgatttggacgcatttatgacgtctaacggattgccagttttgcgcgcatacgcaggcaagtataacgaagttgacagtaagggaaataaagtgctcaaaaattacgttgcagataatcaatttgcaatgttcactgacgaagcagtcggtgaaaccgtgtatggtttgacaccggaagagtctcgtgcggttgctgctggagatgttgaatcatcacaagttggaaacatgtttgctgaccgatacgaagagacacacgatccaattcgctcagtaatcaaggtttcaacaatggttgttcctacgttggcacaagcaggtaacatcttccaagcaactgttttgtaagggggtgatttaaatggatgttgtcacagacaagaataccgttacggaaatcaaaagttggcttgatgagcacggtattgaatatccgtcaggcgctcaaaaggctgatttgttgaagttggttcccggtgaacagcaagatgatattgataaggctgaaattgaggctgtagaggatccacaatcagaagcagatacatcttcaacaaccagttctgccagttctgcaccagtcagtgaggctagtgtggctcaatctgatgtgccagaatcatctagtgcagctgtacaaccagaagcgccagcagaggtagaaccagctcaaccagaagcaccggtgaacaaagacaattcaggctatgaccctaacattccaatgtgggagcaaatgttggttaaggagcctgagtcatacgtaccagaaccagttgtccctacttacatcgttaagcctggggacaagttggttgatattgctactaagcacaacatggcttatgcacgcttgaagaagctgaatggcttgacggttgattatgtagcgcctggacgtgtgttgaagttggcttaggcggtgacttatggcggacacagctaaggtaatcgcacgtattaagcggaacacaacgctgactgataatgcgttgttgtctgaaatcgctaatgatgcattgatgagtgccgaaggggatggatttactgacccacaactagaagtagctgcgggttggttgggttcacaccttgcttcgattattcagagtggaaatagttcagttaagagccaaaagttggccgttatggaagttacctatcgagataacgcagacggatcatcaacattcttagctgaatacaaccgtatgctggataagctcaatggtggcggtgtcaatcgggcattctttgtgtaggtgattggtatgaatgtgaatttcaacacgactgtcgagacagatgttgacgaattagacgcagcaatcgctcgtctagaagccttagacggtaagtcaacggaagctggactatttggtggcttcgctgccaaaaaagcaatgtggcaagaatatgggacgtcccggggtattccggcacgtccttttttgcgtaacacaatgtatgagagttcagcaaagtggagccggtcagtcagtgaagatgtaatggcggtatttgagggagatttaccaggaggagcagttgttcaacgattgggtgagcaaatggtgaaggatgttcggcgcactattgacgctggaaacttcgccccactaagttccactactgttgctcgcaagggtagcagcaggccactgattgatactggtgatatgtatgcgtcaataacgcacagggaggcgtaagcatggctttttatcttgatatggcgtcgttgattgatatgttcggtaccgacatcacagtgtttgagaattccgacgtgaagagtggtgagtggactgacggtgaatggcatcctaatggatcggcagttggtgtggagttgcacgaaccgtttttgccgtttgatgtttattccaacgtactagccggagtgctacaagctacggaagccggtgaaacccaacgtgataaagcgtattggttttcaacgcacaagtacggccggggaacaattgttgtttacgaaggtgtgcgttatcgagtgattggtgtgaccgattacaccggatactcgaacgttacgcaatatgagttaggaacggaggttcaaaacaatggcaacattcaatgacgtgaatagctatgattatcgcaagttaagcaagctatttgctggcattgcaaaagatatgctgggcctaacacttattgcttctaatgtgcaaggaaaccaacccgaggcgccatttgtcgtattcgatattgtcagtccctatattccaattgatgagttcctagacattacagaggaagaagcgttcgaagcggtcgtgagctttacagtgtttgatgataataagttggacgctctgagagttgcacaagcgcttcgcaagacgttgacgcagtttgatgttgaccttcaactgcgggctagtgatgtaatcctagttgaattgatgccgactaacgtgcgttctgtccctgacaatgttcaggaagctcatatggttggatttgatgtaagactacgcctcactgaaacatatacggatagcaccgttgaagtgattgaggacgtagaagtaaatgaaaagtgaggtaaagcatggctaatgatattctcgacgttcaagtcattttggacgttattaacccggcttctccagttaatttggggaacttggcggtgtatgtagtcgctgactcagctaattctgaaacagcaattgctgacgtgaagttgcgtacagcaaatgatgtttcaaaccttggcttgacggtgaacgcagcaacgcaagcgattattgatgcattctttatgcaagatgatcacggtgattatttgtacttgtatggtattgattcttcagttgaccaatcaaagacgaaggcaaagatttccgaaaccatcactgacggttgggagtttgcgacgattgtttcaccaacagctaacgattctgttgaattggctaaccaagtggaaaagtatggtcgtaagttcgcagtattggggatgaagacaaagggcaccacggcgactgttgccgaaattcaagcaatttcagcatcaccgttttacggaaacgaccgcacgattgtgtttgttgctaatggtgcttctggcgataacgcacaatacgctgcggttggtgcgttgattggtgctcttggtaacaaggctccaggttcaatcacttggaagtttaagacgttgaagggcactacaccatcagaagtgaatggttcaggcttgggtacggctactgagttggggttgattttgtacgtcacgaaggctggtaacaaccaaacgtcagaaggtttgaccactggtattaagtatattgatgatttgcatgcagatgattgggtgcgttcatcaattgagagtgaagttcaaaacttgctccaaacgacagccaagttgacgtatggaccagagggtattgcacaacttgaagcggttgtaacaactgttctacgtcaagcaaccgacaacggcatcattctaactgacgcggaaacaggtgccggaaagttcaccgtttctgctggagcacgtgaagaccaagcggcttcggacgttgcaagtcgtaagtacaatggattgtcattcgagtacacccgcgctggtgctattcatgatgtgaccgttcacggtaccattcaaaatatttaagaaggggtgattatagatggaagtaccaacatataatgccaaggacaccgttgtcactgttggtggtgtagttgttaagggtttccaagacggtgatatggtttcatacacgcaaaacgagaaccgtgtaacggcagaagtagatgcacaaggatttgcctcagtatctatcaacaacaaccgtttgggtcaagttacgatcaacttgtctggaaattcaccatcacacaagtatcttaacggtattgcgaatgccaacaagagtgttccaatcgtgattaagacacctagcgagaagatttctgctactcaagcgtttattaataagccagctgacgggcaatttggtaagcaaacaccaaagcgaacatacacgttcgttgctcttgatatggatgtttcagttactaagtaacaaatcaggcgtacaaggttcgactccttgtgcgcttttagtttgcaatcgtgcaaacacatcacagggccggtgcccgcacaattttggaggattacatcatggcagaagaagtacaagtacaagcagcagaacaagtggcagcagttgaagcacaaccagcagtgcaagcaccagtgccagcggcaccaacgaagaaggtaagccgatttggtgagcaaaaggttgttgaaattaagcaagaagacggcagtgttgagaagttcacgttgcaataccctggtatccgtgtggtattggacatctacgataacgctcaaatggctaacggaaacttgtcacgtactgcattcgctgatcaagcttttgctgaggtagttgttgacccggttaagttggaccttgattacttcgacgagcatgacggcttcaacgaattgttggaccaaattgccgaatttcttgcataaggcaggagaagaaaaatatttaacagatgcgcacttggatgaagcaattgaagaagaatgggcattcatttatccagttgcggaaggtgtagcaacgagagaagaggtagagacggccacgttgaaagggttacaactcttgaacgggctggctagtcgtaagactgaggttggggctaaggctttggcatatgagttggctaaggttctaagtgaggatgacatatagcagaggtggtgaattatggcaggatatagcacgacaattaggtcggacgttgaagttagtggtattggcgagcttaaacaggctagtgctgccttaaaggaacttgcggaatcagcgcgcagacttaacggttcaaacttctccaatatgggtggtggcttcgcaaatgttgaagccggagcgaagaaggcagctgaagcaaacaagttactagccaactctgcaaagacggcagcagaggcacagaaaagcgcttctgccgctggtacatacgccaaacaaattggtgaaatcaataaaataactgaagcatacgcaaagatggaagccgcagctaagaaagctgaggcggctgaaaagacgcgtttcagtgcgacacaaagcaactatcagcacgaacgggaacaatcaggtaaccgaaactttagcactccgaactactctgagacgggaaagaagctaggtggctcatttaaagaagctgcaggtatgttctcacttggtatgctgggcgcaaatgcagttatgggcgtgtttgacggcgtaaagaacatggtttctggtggttgggaaactttgaacgaccgccagcgtggtcaagctatgtgggccacgtcaatttcagatgcccacggtacatctggtagtgcactgaccagtcagtcttctaaggctaatgatcagattatgatgacggccttgaaggcaggtaataactttgatgaggcaaatagttttgccaagcagatttattcatctgacgctggtgtctattctggtagcctgggtaaaaccaatcacatgttgaagggtatctttaatatccaggatgcgaacgctttgaatgaccgtgaaatggagcaattcaaaacggccgttggtaacgtcggtgacacgggcaagatgtcaggaacgattgccaagagtttcaacctactggacggtaaaatcactcgtagcattcgtaaggagtacgagaaagagacaggacacgagcttggtaagaacaagcaaggtggctgggattgggcgtctgttagtgctgaaatggcttatcgtggtattgataactacggtaattctggtggaattgctaaggcttctgaacgttacaattcaacgctacctggtgttattcgttccgtgaaggaaggttctaaggactacatctctcaagtaatgaagacgtttggggatgaagttgccaagggtggtggcttctctgatgttctggggaagattccaaagcgttcactagcaagagcttgattaccaatgctgaccaatttgcttctaagttatccggtttagcaaatgctttaggaactggtatcaaggaaatagcaccatatgctaagacttttggtagtggcctcatgtctggcgtaaagggtacgttcaacatcattaaaatgggtgttgatcaacttaaaagctttggttcagcaatcggcaagatgattccggaaggttctcaaaagcacatcatggacgccgtacaagcggttggtaaatttgcgggtgtagctgcaacagtagccgcgtcaatgaaggttctaaagggcggagcaagtctgcttggtgatgccggcaagggtatcaaaggcattctaacaggaatcactcgaagcaaaactaccggtgacagtgtgtttagtcgcgcaactagtcagtttagtgctgcggttagccgatttgctggtgctagtggtgtaaagaatgcagctggtatggccggtgactcattgcctggcgggttcagtaaggacgccaagggaaagtatcaccgagcaaacggtcaatacgcctctgatgcagaaattgcgcaactagagatgaggaccggacgacgagcacttgctgcggaagcagaggcatccagtgggctgtttgcaagaattggggccaagggagctgcattgcaaggcttgactgcggctggcgaagtcgatcgagccgcaaagagtgctggatttttcagatcagctacaggaaagttactttctggcattggttcagctggtatggctgcgggtgcaactaaattcggaacagctctatctactgctacaaaggggttatcgtcggctggtaagttctttggtcgaggaatgccactgcttaacggtcttttgtctggtgtggatgtcatgtcgacaatggcgacgacaaagaaaggttcacttgcccgacacaagggagttggtggcgccatcggtaatggtgtaggtgcgacgattggtggagctttgggttctgctcttggaccatttggtacagttgctggtgcaatggcaggcggctggctcggtggaaaagctggtacatggattggcggattaaccggtggaaccaaggacaatacaccaaagcaaacaactgctcaaaagaaagctgaggccgttaataaggctcaagcagaagcgcaagcaactatggcaaagcaagactttgctagcaatatggcggcctatggttatgacaagaagaatgctaatgagttgtattcacagattgataagggaactaaatcaaagtctaaggcaaagcaaattgcagcggctagaatgcaagaagctatcgacgctggtgacgcagcagcgatttctaagtggcaatctaagctgaacaagcaaagccacattttacctggtcaagaaaatgtgaatgaccgtccaaagcgaattaagtctcaggaagtttctgtatctgggaacaagcgtactcgaaagcaatcagctccaaaggttgataccaaggagaacaagaaagcatttgcagcgcttaataacgacaccaagaagggaatgaacaagaatgttgaaactcttcgtaatggtgctaaaaaagttaagtctgcttctaagaacgtttcgaaaatcaagtctgataaaaagggatatgacaagttaaaccgtgacgcaaagtctggtatgaacaaggtcacgaagactgttaagtcaggtgccaagaagacgcaaaaggccggaaaagatgcctttaagtttaagacttctaagagtggctttcacaagttaaaccgtgatgctaaatcaggtatgaacaaggttaatcgcactgttaagtccggatcgaagaaggtacaacgttctggcaagaatatgttcaagttcaagtcatcaaagagcggcttcaataagctgaattcacaggcaaaaagtggcattaataaggttgctcgaacggttaggtctggggttaagaaggttcaaaacgctggtaagaacgtctttaaatttaagagctctaagagtgggttcaatcaacttaacagcactgctcgtagcggaatgagccgtgtagcccgaacggttaagtcaggtgctacaaaaattcaaaatgctgcaaagaatgcgttcaagtttaaggcggcaagctcaggatttaatcagctgaactcacaagccaagagcggtattagtcgtgttacaagcacgattaagtcgggttcttcaaagtgggactcagctattcaatcatctttgagtaaggcagcgtcaaccatgtctagtcagtttagcaagatggcatcaacggcttcttctaagtcgtctgcgattgcatcttcaatggctaaaattggaacggctgcttcggccgctgcaagcaaggttaacgcattacaaagcgctattgatcgtcttaagtcaaagacaatcacaattactgcaaatgtaaccggtaagggagctgcaaagcttgctactggaacgcctggtgcgaagtcagcgttcgcttcattggtacctcgttatgctaagggaacgacgcaaggaggccacggtggcggtttggcacttgtcaatgacgcaaagggagcaaactggcgtgaggcattcatgctacctaatggacttgtaggactgttccctaataagcgtgatttgatgatgccgttgccaactggtacgcaagttttgaatggtgatgataccaagaagatgttcccacgctacgcatctggaacagacggtgctaagaaggcatttggtggcggttcaatgggcaacattaatatcacggttaatatttccggtaatgctagtgctagtgatgccaatgtaattggaaatacaattggtgagaagcttatgacaattttgaaccctgaaacgatttaggaggtcgttatatggcaacattaactgatgcacacggccacacggtcgaaatatttgtgaagagtgaaaatgaatcaattgattctaacgtttctactcatccgattgagacgggttcaccgattacggaccacgcacaacgtgaaagcaagacgcacacgtttagtggcctgatttacggaaacgatcagtcacaagttgacgcccgttacaatcaattgatgtattggcagagtggtggagacttgcttcaatttagaggtgcaatccgccacaatgatttgctaatttctcatcttgaaaagacctatgatgaaggcggaaaaaagaatgctgtatcgttcaacattacgctaaccactgtaacattggttaatttgaaatgggataaggcaactaacacaggaaagaagcaagcagcgccaccagtagaccctggggtttatgtaacagtagttgccggtgacacttattggggatggtgggtcaaatacggcacatcaattgaccagttaagagcatggaataattggaatgattacctcattcctattggagcaagagcgagggttaaataatggatcaacgagcattgattgatgtagatattggaagtttaccggaggaatttgaaatcgaattagcaggaagcaatgtatttctgcggtttgattataatggccaaggtccatttttcaccgtagacctatacgacaatgcacataatccaattgtgctgggcgaaaaattagtatacggtcggaggctttggggtgatttcactaagccaagtattccacgtattgatgtagtaccttatgatatatcaggcaaagaaaataccgtcacactcgaaaacttcgggcggacggtgtttttgtatctaatgacatttgcagatgacggggtggactaatggcaattaaaaggattgtggcgtttggtgattccattactcaaggttgggacggtaatcgtggtgtaacaccatggactgctgaggtatctaagcaactgagtgttccggttgataatcaggcggttggtgggtcaacgatgtcaggtgacaatcgagatcataactttgttcagcaagtgcaaaacacaaacctgtcgggctatgatgtcgcaacaattgcttttggtacaaatgacttcgcttactacaattctccattgtcagcggtcaaatcggccctcactaatggtatcgatacgattaagagtaagaacccgcatattaagatgattggtattctgccaattcagacatggaagggtgctactaacctagataccagaaatggggcaggctattcgcaaaatgatttgctagcagccgaacggtcaatctatcagcaatacggaattgcggttcttgattggcgagatgcaccattgataactgctgctaatcataatcgtacgttgggagatggaattgttcacccgacggctgaaacatacgtcaaaatgggtggccggattgctaagttcatcaaggacaatacagcaaccccaccagcaccagctccaaaaccggcaccccagcaagacattaagcctattactgcgaccgggcaattcatgttcgagatatacatggatatttacacggatagtggtgtgctccattacgtgcataatgctgatcgtaatttttcactggatattgagttctctttgccgttcgataatacgagcgaccgaagcgttggtgagattacaatttggaatatgtcgcagattagtttcaattgtattcacgaagggaatagagtggttgttaatgctgggtatcacggagatacaggaattatctttgacggtcaaatctataaaactaccgtaccaacaagagaaggcggagacttgaattacacattgcgtgtggttgaaggcaccgattatcgaaagttgaagcacgtgtcgttgacgtttggtgaaggtaccgacgctacaacaatcattaacaagattgttcaagtgtctggtatcaatctaaacttcgtgtcattagggcgtaattacgtgtttaaggaaggctacacagtagacggttcaccgtttgatgcattatcagatgtagctgaccaaacgcgttcagcattgttctatcgtcgtggacagttgacgttgcggtggttatacgatgccgaagttaccggtaattttacgttggatagtaagtcggggttaatttcttcaccaacaatggaacgacgtgatgatgattggattgagtcagatgatgatgacggtcaaggtcgctatgaatactcagctgactcaattctgaattaccgcattacaactggtgagcacgttcatttagttagtgagttcgttgatgtgtgggctgcagtattgagtggtgagcatacttttgatggtacaaacccaacgacaacgttggagttaggagttaagtaatatggcaactactggtatgcgtcccaagaagcgggacaatgatgttgcgttttttaccaaggttctgccggatacggtaaaggcgcaattgaatgtggcacgtttggccaaagtaacccgtttatatgacgacaagacgaaagcagaggttcagcctcttgataagaagtcagatggaagtagtcgggcgccgttgattggtgttcacgtcggcaaaacaaaacgagatgttattgaggttggggatgtagtggttgtcttatttatggaccgatccattgctaacttcgacgggtcaaataatgaatttgaactgtcagcgaagcgaatgcacgacttgaacgacagtttcatagtggaggtctattgatgagagatattgcgttagatgaagatggagcaatcgattttcatacggtggtaagtgataccaacgaagttatgcagtcaatacgaatcatccttgaaaccaagctgggagagatggtagaggcgcctgaattaggcttggataggacggatttgttcgaaaagaatttcaattcacggtatgcagctgaagctattcgagtggcactagaacaggatagtcgggtaacggttactaatgtttcagtgacagctgattttaatcacagaattgccacagcacaggttgatatgtccattgacggagaagcaaaaacaacggaggtagcgttagatgttggatgataacggatttacacgaccaagccagttagagctggtcagcaatttaaccgctaagtggttggaacttttcggcagcgattcggacacctcagaacactcggttgctggggtgtttattcgattgctggcgtattttttgaatttactctatcaattggcagaggttgtctataattcgcagtttatcaccactgctactggtgtctctttagaacgactggcatctaactatgggctatatcggaacccggcaacccaagcaattgcagaattgaactttaccggaacaccaggttttgtcattcaagctggtgcgttgtttaagactgctgacggtttgcaatttcagctagcagccaacgtcattttatcaagcgctggaacgggttctgaatatgcgtatgcggttgatacgggtgctcaatataatgttgcacaagacgcaatcaagtatcaggtagagccaactagcgatattttcacagtcggaaacaaagcagttaacaatggggctgacccagaaactgataaagaactagcaaaccgtatccgtattgcgaatgatacacggccatcaagccctgagaacggcatcatctccgctgtaatggcggtaccaagtgttaagactgttcaagtcgttcagaacaacactatggaagttgatcaatacaacaacccgcctaaaactatccacgtttacgttgatggtggggacgagactaaggtggcggatgcattgtttaattcggtctcagccggtgtgcagacagttggaaccattcagaagcaaatgactgacagtgccggatttagtggcaatatcattgcctttgactttgcacaaaaagacacgctattcgtgaatatcagtgttacaaccaacttgaattttgaaacaaccggggttcaacaaattcgagatgcaattaattcgtatctatcaactgtgccaatgggtgggattgtgcggttctcgtatctgtacaagtacatctatgacaacgttaatggaattgatgtggcaactgtgaaaatcggtttatctgagacggaattggccgctaaagatgttcaattggctcagtttgctgtagcagtaacaggtgcggaaagtatggtggtgacgacaaatgaatgattttaaagagacattcttatcgaaactgccaagccccattgaccgttatgccagtaagacagtggcttttgcggagtggttgcaggcgatttttacaccaattacagatttgctcaaaactattgtctcgtttcgtgagattaataatgcgggcggcaaggcgttggaccgcattggtgaccagttcaatcaacaacgtggtgaagctaatgatgatttttatcgcatcatgattcgttctaagcaggcgactaatacgggtatcaccactgttaatggcttgctcgacgttatatcaaggtcgctaaacatcagcaaggctggcatcacgattgagcctttgcgtcattatgttgacggtaagttaaacgacggcgagccattaacactaaaaatcagcaatatcccgcttgagtgggcccgttctgacttcgaacagaactatatcttagatcgtattaaaaacagtgtggcggccggtgttcgggttgatgaggttagcttcgttgatagttcaagcactacgctcaatatccggggtattgcatcatcaactttgacttatgaaatcgttggggaggaaaagaatggctaataaatttacgaatttcattttcactacagaaggtaaggacaccattacacaggtgttggcagcgaagaaagttgccgcggatgcacagttatccatcaatactgtatacacgttcgcaaccaagctgagcacgtcattagtttatacgcagattagctcacttggtccaaagcagactaagccagttggaacagtgacaccgcaagataatgacacggttgagatgcgcatccaattggacaatgccgatttaacaaccgggtataacttacagggtgtagcaattgtaggtcagtacaacggaaacaacttcgttcttggatacatcaattcaaacgaaacaactaacattccgccttacgacggcccccaggtacaaacggttgcgttggatgtgtctttcgcaatttcagacagcaatatcgttacgattaacacccaaacagcggggatgctgactgttgatgattacaatgcactggtgaagttgctcgaaacacgagtttccccgttagcgactgattctaaagtagtccatctaaaaggaaatgagtcaatttctgatgttaagcgtttcaacgagacgattattgggtcagttgacggtaatgcaggtaccgctgattatatgaatgttcatacaatcagttcagatatcaatctagacagcattagtagtaatggtaactacttatcaacatcaaagactaaaacaacatctggcaagccaaatggtacgtcagagcaatatacgttggtagttggtggaaatattcaactgtttaatgatatgagcactgacgcactttatttgcgtaaccgcattgatagcaagacgctgacgccatggaagaagattgttgaagatgttgatcagacgttgaatgctaaatacaactatgcgcaattgccaactgtaaatggttctggtgttgcgttgcaatctgatttggcagcggagacgaattctagatcagtggctgaccgcgacttaaaaacgtcaattgcgctggaagcacagacgcgttctgctgccgatattgcgtttggctcttcgttggcagcagaagtagcagcgcgttcaactgctgatgcttcagctactgctgctatgactaaagaacaagctgctcggtcaactgctgatgcatctattactgcaaatctgacgacagagacaagcgcacgttctgctgctgattctagcttgcaatccttgtacagtaggattaatagcgattttaatgacgaaaccgctacacgttcagcagctgacagtttactgttaggttcaacggctgatttggcctcacaaatcgctaaagaacgggataatcgggtgttcaatgacaattcgctggcatctggccttgtaagtgaggctgccaaacgtgatgaattgtttggatcaatggccgattctattgcaaaaaattcagcggcgattaactctgtaaacgcagcaacaatgcacctttcaggcagtgagacgattactgggaagaaaacgttcagtgcaggaattagtacaacaaatcttgatgttagtgacacaactaatttaaaaacgctgaatgtcgcaaatcctatcaatggggcaataagtgctcgaaagttacctgctgatgcttacgattttgcggttcttgctagtaatgtgactaaatatcaaggaatttggtacactgacggaactgcaatagctaatggaccaaccgatagttggtcgtggaacaccgtcgaagtgctagggggatacggtaatggtagcggaataattaggactgctggttttggatataatcaagaatatataactaccgttaattcaggaaaaatagttggttggaatgcagttgcttcggttgctaaatctgttcaaaagtcaggcgatactatgacaggcggactgaagggtggtcaaataaacttacccgcatcaggtgacttaaacaacctgacggatacaggtaagtattatcaaaccatttctgtgaatactgaaaattgggtgaatcgccccagtaatgcgccatctctagcattttcagttgatgtaattggtcaagctaatcaagcgctagtaacccaagtgtactatgtccacacaactagtcgcatgtggattcggacaatgtggctaaatggtacaactattacaacaagtaaatgggtagaattggctaatgacgaaaaggtagtccatcaatccggggaagaatcaataggtggtacaaagacgttcacggctggaccaattgttaaacaggatacacctggtctttggttcaatgccacagggtcgcctgacggaaaccaacagcttatccgccttggaagtacaggcacaatgggcgagaacattggatattttggaaccaatcagcttgcagtattcggtggaggggaaggtgctgcagcccttcaaaaggatatatacaccaatggaaaagcaaaaggtgatttaagctttttggatgccactaaagaaagtgcagcgttagtcggagatggatcagtttacattattactcacgccaacaattaccaaaatggtacatattcagggcattcagtaattgagtttacatccggtggagatattctgatcaatggtaaatcttatgatgcggactcggtccataaaagcggtaacgagactgtcaatggtgataaaaatttcactggtaatatgactggtactaccaaaataaatcaaattctcacttcgttaaatggtaatagtgtggtatccatgcgtccggatattcaagcttatgaatatagttcaaaggggcttacttttcgatttagtaaaatcggaacaacagcgtttgttaacatttcaggacaagttaccgaagatattacgtcagaagagatacttatgagttttggggacggaagtaacgctaaggcatatgcatctccttattgggcaggtggtgaaactactggttataaaggtaatgcaatttcattaggtcaggttggttccttatcaatttgggatgacggtagtataagaattagctatcgtgggccaaaaataaccaagggaacgtgggtagatgggagtattaattatctgtctaactcaccgttaccggctaacacaattttacataatagttgaggaactatggaggaaaaggtaagtgggagattatctaacgccactcattagcttgcaacattctgatatgttggctgtattaattattgtgtctattttggatattattttgggctatgctaaagcctttactttgaaaatagtggatagttcagtaggaacggccgggatattgaaacatatcctcatggtcagcgttccattactgatctacccactttttttcttgggtaacgcattggctgcatggaatgcattcgtagtttcgattattgcttcgaatactgtaagtgctatggaaaattgggttcaaatgggcctaccgtttccagacggcttcaagcaatatctgcgtaacaacaagaagaaattacaacaatcgttggaaagtcaggagaaaaagaataatgaataaagcagttaagctggtcgccgttggggcggcctttttgtttggtgcaacatttgctggcaacgtaacagtccatgctgattcgccacgttatgacatggttgatgtgtcaaaccacaatggacagatgacgacacctgaattcattgatatgcgagatgcatacggtgttaaggcggttacgaccaagatttcagagggtacaacctatcatgactggactgcggctggaaacattcgcgctgcgcaagaagctggcttgtacatcaacgggtatcactatttgcatgcaacaacggtagctggtgcgattgctgaagccaattatgctgtggctatggcgcaggctgacggtttgcctgtaggggcagttttggtggctgatgttgaagaaccggcacaaatggcaatgggttcaaatatgcaagctgttgtgactgcgttcgaaaatgaggttcaaattaagggtgggttccgtactactgcttatacaatggggtctcatcttgaagtaacgccatacggtgaaaagtcatgggttgcctcatacccattcacgccaacgtcaactcaaaactggtattcagaagagcacggctggcaatttgactcaaaggctacattccgcatgtcacttggtgtgtttgatgtaaatcagttgtacgataatttcttcactgcggatcaagcggtaatcaagaagaaccctggtgatggtgctacggtgtggtcaaagggtggcgtatggtacacggacaagtcattcaagcacaaggccaacggcattaagaagcatatgggttcatattggtcatttgccaacggtaagctaatcaagtctaactggacgaactcatgggggatgtactactggtctggcggtgacggtaagcttgttcaaggaaaaggaacttggaaggggtacacctgggactttggaactgatggtacttactatgttaagaacgcaactccaaagagcctgaataagttggttgaacaattgaataagtaaactggtcgaatttaaccagttttgcgaccgacaataatgagggtcgcaaacagataaagcccgctgtacttggattaacttccttgtctggcgggctttttattgtggtcactttggtcacttgccaataatgcgcgtgcatatatcgccaaagcaaggcgttttatgcaagatatttgagtgatatttatcagtttaagcgatgtatatattgttaggttattcgattgaattgcttagttggctttttgttttgttttaaaatattgaaaatttatgtaaaaaaaattaataaataagttattatagtagtaatgactataagaagcggagaatctttatggggagtaaaactatatatattgatgaatccggtaatttcggaagtgatggaagatatttcacaatcgctgcagttgaactagattctcaagacaaaaaacacttaaaccacagaatgaaaaatattactaggattgttaaagaaaactatccaaatgttgcaaatcaaaacggtgaagttaaagccaatcgttcgaactgtatcgttcgtgaatatgttttacgaaaggttcaaacggtttcgtttaatattagatacataacagtagacttaacacaaatttctagtagattattaaataatcaaaatgttttgtacaattatttagcgtcttttttgattaaacccttggtattatctgactcagaaattgaatcgattgagatcattttagatgaacgtacaaaagccgttaaaaatgggttcgatattaatgggtattttcaaaaccttatttggcttgatatgaagagggaagagattgacctaaaaataatttcagctaaatctcacacaacttatggaattcaagtagctgattttatagtacatgctatccagactaattttgaatatggtatagacagtcatgtcttgcagattaaacagcgcattgtaactaggcaaaattttccatacaagacttttggaaaataatgtttttcgttgacatctgttaattcattatgtaatataatgttatagatatgtaaaccaattcgtgtcagggttacttttgtttttacctcagctgttgtgcacaagtcggcgaattgttgtatctaatacataatttaaaaccccaccaggtagagctcattgctctatctggtggggttttattgtggtcactttggtcacgcgctaataatactcgggcatgtattgcgcatatatgaccaaaacaaggcgttttatgcacgatatttgagtgatatttgtcagtttacttcctatacaagttctcaactgaaaactcaaataagttgagtgcggatggcacaacgatttctaaactgattagtacgctatcgttattacttgaaatcaaagagattcagcaggtacgtctcgatactagaatggtagaacatgaaagtaccaatatcgtcttgcataatgatggtttaatcggtttgaaatttacaaattacgctggtgttttggaaggtagaactaactatgaaaagcgaacaaaattattgttacacgtttattgggttgttttgccagttattcttacgcgagtacactgaatccagtgatgaaaattggggaccaaaagaaatttcagaattcattaaccacattaaagagcaactttcagacaagattgattctattaacactaaggttttggagcaacaagaattgttaactagtaaataattactataaaatattaaaaaaattatctcgatataaagcgaaggatagctggtgtggttacaaacaacaatgctaaccctggacccacggattaagagtccgttgctctaccaactgagctatctgcccatatttctatgccgttgcctcaacaacagaaactatcttaccaagtctatgaatgttttgcaacccctttttgcgcaaaaaatgaattgtatgactagaaagttacgaaaatcgtctgaaaagttacgaaaacgctgtaacatgatataattactaccagagacccgccactgggaggatgaaaactaatgagtaaaattttagtcgttgatgacgaaaaaccaatttcagatattattaagtttaatttgacaaaagaaggatatgacgttgtcgtggccatggatggtcgtgaagcgttagatctatttgaaagtgaagatcctgatttagtgttgttggatcagatgttgcctgagcttgaaggaaccgaagtgttgcgtcaaattcgtacgaagtcacagacaccagttattatggtgactgctaaggactcagaaattgacaaagtgcttggtttggagatgggggcggacgattacgtgacgaagccattctcaaatcgtgagttgttggcgcgcattaaagcaaacctacgtcgtcagacgccagttgtcggtcaaaatgtgatggatgacagtggtgatattaagattggtgctttgacgattcacccggatgcttacatggtatctaagaatggtcaagatatcgaattaacacaccgcgaatttgaattgttgcaccacttggctaagcacattggtcaagtgatgacgcgtgatgacttgttgcaaacggtttggggctacgattactttggggacgtgcgcacggttgacgttacggttcgtcgaattcgcgaaaagattgaagaaacaccaagtcacccacaaatcttgatgacgcgacgtggtgttggttactatttgaaggcgtctgaagaataataactaaacattcgatagagtggctgttagctactataaataacgtacgtaacaggctgatgccctgccgattggcatggcattagccttttttagtcaaagtgggagattttaatggctgaagatatgcaagagccgaagaagtggcgacgttttttctcgtcgatccattttaagattgcattagtatttacgctcacgttgttggtgacgcttgagttagttggtgcctttttcgtaaagcgtttggaacaacaaaacctggcgagtttccgaacccaaattgctttaccggcatatgttaatgattcattaacacaacaattaacaagtagtgatcagacaaaagtgaatgcggatattcacacgattttgacatcggtgaataatgcgtcaatttctgagattacagttgttgactcctcagggattgtacgtggcacaagtgatattaataatcaagacgaagtgggtcaaaaaacgacggatgccaatgtgaaagcagcgttggctggcggtaaatataccaagaatccggttgagcagcgttcgggcacacggtaccaagtgatggtaaagccactggttagttcatcagcaggcgaaagtaacatcgttggggttgttgaggttcgggctagtttagaaacggtttatgacaatctgaatcatatttcactgatttacttctctgcgtcgttgctggccgtgatgttaggtgtcgtgatggcggttattatctcacgcagcttaacgaagccaattgcggaaattaatgatcgaacaactcggattgcgcaaggtgattattcgggtggtattttagttcgctcaaatgatgagattggccaactggctgaaaatgttaacgccttggctgttcgaattgaagaaacaacgaattcgacagagtttgaacgtcgtcgattggattcggtgctggaacacatgacggatggggttattgcaactgatcgtcgtggtagcatcaatatcattaatacggcagcactgcagatgacaggaattgatgacagtacggttgcgatggggcaatcgattctggaagttctgcaaatatcagatcgttataatttgcgtgaattgcttgataatcaagaagaattattgcttgatttcagtacggatgagcgtcaattgattattcgagcgtactttagtttgatacaacgtgcgtcaggctttatttcagggctggtcattgtgctgcatgacgttacggaacagcagcgaattgaattggagcgtcggcaattcgtttcaaacgtgtcacacgagttacggacgccgttgacgtctgtgaagtcatacgttgatgcgttgcaagagggtgcgattgatgatcctgaagtggcgcgcaatttcttggcggttgcacaagatgaaacgacccgtatgattcatatgattaatgatttgcttgagttatcacggatggattcaggcacgatgaagcttgaaacagaatacgttaacgtgggtgagttgtttaattatattttgaatcgtttcgacatgattattgcgaacgatgataaacctgaaaagtactacacaattaaacgtgaaattccaaaggtacaaatttgggttgagctagatacgtctaagttcacccaggtaattgataacattatgaacaatgccattaagtactcaccggatggtggtgtggtaacggcccggatgattgataatcagaaggaagttgtattgagtatcacagaccaaggtttgggaattcccaaaaaagatttgggccatatttttgatcgtttcttccgtgtggataaagcgcgttcgcgtgcccaaggtggtacgggactgggattggcaatttcaaaggaaattattgaacgttttggcggccggatttgggtagaatcggctgagggacagggctcgacgttctcgatttcattgccatatgaaccatatgatcctaccgatgacgagtgggatgacggagaatgggatgattaatcgtctacattttcgtttgaaggtgttgatgcgccgtttcggccttgtcacggcgttgatacttgcaattttagtaagtttaattttgtcggttggtttgtggcggagtccagggcgcgatttgaaaaacgcgtcggatgcggatgccactaagcaggttgtggcggccaagtcagtgaccggactgtatgatttagatcaactggtgtataaccaaaaagatggacaatacatggttgtggactaccgaccaacaacgactaagatgattaaacggttagcggattggcagatgacgtttgataagaaggagcggttatcgaataagggttatctgaaagctttggcacaatcaaacacaatggtaatggcatttccagatgcggttgcgggtaacattgtggatgacatgctgagcggtgatttagatttgccgacgaatgctgagattagtcgtattcgcgtgccgatgggtgatgcgactacggtagcgttttttgatgataaaaaacgcgtggtttatcgttacaaggtgacctctgctgctaagacgatggcttcctttaaaatgagctctgaaactgtgccagtggcgtaccggttaaacggcaagcatcttttgacggatacgttatcagatgtgtcgctacgttcgtatagttatctaatggagacgaatgggacaaataattatttgtcttcgctatttgctggcacgaccacaccaagtgcaacgcgtaagggagatatcctaacgtataatgatgggtcatcacgacaaatgacattgaatacgaacagcggtgtggtacactttgacgcctatgacgttgataatgtcggcgatgacttcaatgagcgaatgcgaatgggctacgattggttagtccgcattcatcagattccggataacatttatttctttgagagccacgatatgggtcgtaatttaacgtaccgattatacgtgaacgggttaccgatttataaccaaacgacgtatggaacggttcaaattaaacaacatgatgtgcgacacgaagaaattgatttttcacagtactcgcttcaggtgccactaccagcggacaatgattcgcgggccacgctttctgattccgctgcagtttacaaacaattagcggatattggcattagtaagaaacaagttgttgatttagcatatggttatcgttgggtgtctgacacgactgaaaatgtggtgactttgcaacctgagtggtactttgaggtcggcgacaaatggcaagcggtgaaggatgcgattgctgatgcgcaacaggagggcgacgactaatggattttaaaaagatattagcgacttttctggctgtgtttgtggtgattgatatttttttagctgtgcaatggtttcaattacatcagcctgcttccaatccaacgtcatcagaaagtattctcactgagatgcgaaatgatggcattaaggttggtaaacttggtcagactgagaagacaggtgtctatcttgcaggtaagagtggcgagacgtttttgcgagatcggttatcgacattaagcaagacgtgggatgcgaagctgacgaatgatcaattaaccgttacgcctagtcgcacgattaatctaggtaagtcacgggcagatgtgcgcgaagcaattgataagattgttaacgatccacgcaaggttattgccgggtcgcagtatcgctatgatgcgaagttaacggagtatgctaacaaaacctcgacagagtcggacgttgtggtttatgcccagaagatctccgattcacggtcatttatgtcgcaacgggcgcaaattagatttgtgctcactgcaaatcatgaattaaagagctatacgcaaagctatgttgaaaatccacaggtgctgcgtgactcaacgagtttgatttcagaagagaaagcgttgattggggcatatcagtacaatgagattcctaataatggcacggttaactggagtgagctggggtattcaccattgacgacggtacatggtgatatcatttttgtaccagcttggattttttcagtaacagatccttctgatgaaacgacaattttacgggtcaatgcgctaaatggctcattgatgaaataatcacgtgttagaatagttaatgacgaaacgccacatgacatttttgtcgtgtggcgttttttaacaggtgataaatacgattaagataggggatgcacaaagtggcaagtgaatttagtgtgtcgatgttggcttcgggtagccaaggaaatgtgacctatattgaaacccccacgcataaggtgttggtggacgcagggttatcaggtaaaaagattgatggcctaatgtcccaaattgggcgatcgttacaggatgttgatgcattgtttgtgacacacgaacatagcgatcatattgcgggtgttggtgttttagctcgtaaatacgggtttgatatttatgctaatgccaaaacctgggatgcgatggccggtaaaattggtaaggtaaagccagaacagatgaacctgtttgaagcgggggatacgaagttatttggtgatttagacgtcgagagtttcagcgtgtcgcacgatgcggctgatccacagttctatgcgtttcatcacaataataaaacgttcgctatgttaactgatacgggttatgtgaatgatcgcattgctgggacaatccgtaatgccgatgcgattttgatggaagcaaatcacgattatgaaatgttacggatgggtggttacgcttggtcattgaagcaacgtattttgagcgatcaaggacacttatcaaatgaagatggtgccttagcattgaccgaaattttgggtgatcggactaaaaatgtttatttggggcacttgagtcaagaaaacaatcaaaaaccattggcacatttgacggtccagcaagtattggaagaacatgactttggtgttaaccatgattttaatttatttgatacggatccaacggtagcgacgaaattgttcgaggtctaaattagcgaccttaagccgtcttaaagggtttatttctataattacggtacaataatcggaaaatagacatggaggggaataaccatggacaacggagataagcgagagaaaagtatgaaaaagacatcaaccacaaaaatagcaattatcggaattgttgccgggctagtcggcggtggtgccgctgctggtggcgtaacttacctgaataatgccggcactttttcaacagtcacgactggtaagacgacaccggtaaaggtaagtaactcgaacgtgaagggcgaatctgatgcaacgaaggcctttaacaaggtgtcgggcgcagttgtgtcagtgattaacttgcaaaagcaacagtcactttcagacagtggctcattatttggtgggttgtttggtggtgatgagtcatcgtcaagtgatagcaagtcaacggattcatcagaccttcaaacggcttctgagggatcaggagtggtttacaagaaggatggtaacacggcttatatcgtcacgaacaaccacgtggtttcagggtcaaacgcgttgcaagtcttgttgagcgatgggactaagctgacggcgacgttggttggtactgatgagcaaactgatttggctgtgttgaagattaatgcaagcaaggtatcagaggtagctgactttgctaactcaagtaagattgagccgggacaatcagttttggccatcgggtcaccattgggatcagagtatgcgacgtcagtgacagaaggaatcatttcagcaacgaagcgtgaagtcgatgccacaaatgagaacggtgattcactcggtaaggccacggttatccaaacggacgcggcaattaatcccggaaactcaggtggcccattggtaaacttggccggtcaagtcgttggtatcaactcaatgaagttggcatcgtcaactgacggtacgtcggttgaaggaatgggatttgcgattccggctaacacggtagtcaacatcattaacgagttggagaagaatggaaaggttgaacgaccagctttgggcgtttcaatggttgatttgactaacgtctcaacgacggatcaatcaacaatcttgaagttgccaaccagcgtttcaggtggtgtcgtggtcatcagtactgaagatggttcagcagcagcgactgcgggcttgaagaagtacgatgtgattaccaagattgacgatactgaggttactggttcgggtgacttgcgagatgctttgtataagcacaaggttggtgacacgattaaggtaacttactaccgcgatggtaagcaaaagacgactgacgtgaaattgacgaagacaacgagctcattatcaacgaagtcagaagcaaatcaaaactaaaaaacgtgaaaaacagggcacattttgcgatgtgtcctgtttttgcaactaatttcttactgaaagttagttttgttaatcaattgaaacattctatttacataaaattcatacgaattggctattatatattcatccactgttcctagtggatttcattactccccaaagtacatgaagcgtcacgcagttccccaaactgcgtgacacccccctcgctggttgcgatagtagccggcggcggaccatcgttgcgttccccctcttgcacgatggtctttttttgtacaaaaaataaggttcgatagcataagctgtcgaacctttttcgttagtattaattaacactaaattccaaacgtaacgtatagtcaccaagaactgtttcgccagttaacaaagaataagcgatttcaacaataccactgtcgaaagtatcagccacgtttgctgataaagttgttgtttgaacatcaagtagcattgaaccttgggctgtggtgtaacgagtggggatggtttgatcggccataaaccgcaaatgagtggcgctttcgccagaacgctttagcgacacttcaccatctggacgtactttgaacgtgactggggtttcaaatcctgcttggtgctcggtatagcgtaagtaggccgtgccgttcatttcgaccagggtgccggtttctgtaaaagtaaaggtctctttatcaccgtcttggtggatagttgtttgtaattttactgatacgggtcgttcgttgttagtggcagacatataaaatctccttataaaatcctattgaacctattatacaggcttttgtacgttataatgtaagaaacaattgatctgataaatcagaaaggcgttgtggcaatcatgatgacaacagtaaaagagaaagttttccgcgacccagtgcataactttattcgtgtccaagatcaggttattcttgacttgatcggcaccactgagtttcaacggttgcgacgcatcaagcagttgggcgttgccagtgctgtcttccacggtgcggaacactcacgattttcacattcattaggggtctacgaaattgcacggcaatttgctgatcaccttgagaagtttttcccttctaaggaacctggggatggcttgtgggatgcaaacgaacgattggtgttgttaagtgcggcgttgctacatgatttaggccacggcccatactcacatacgttcgaacatatttttaatactgatcacgaagcttatacgcaacaaattattttgtcaccagaaacagaaatccaccaagtgttggctgaggtggcacctgatttcccggccaaggtggcgagtgtgattgccaagacctatccgaacccgcaagtggtgcagctgatttcaagtcaaatcgatgccgaccggatggattatctgttacgagatgcttattattcgggtgccacttacggtgaatttgatttgtcacgcattattcacgtgatgcgtccttatgagggcggtatcgccttcgatcaaaagggcatgtatgccattgaagactatgtggtctcacgctaccaaatgtacgtgcaggtgtacttccacccggtttcacgttcgtttgaggtgttactacaacatctactagaacgtgcgaagttcttgtacgatgagagtcaggcagatccacgtatttcggcggatttcatttcgccggccttacaaccgctcttcgctggtgaggtgacactccaacaatacttgatgttggatgactcagtcatgctggctaatattagcgaatggcgtttggcggatgatgcgattttagctgatttggcaacacgtttcttggatcgtaaaccactgaaatcgattttgattgaagatgatgcacgtagtttgctgccagcaattacgaaactgatttcatcagctgggtttgatgagcgttattacaccgcagagaacgatagttatgacttaccgtatgatgcttataatccgcgtgataaaaagccacgaacccaaattgaattaattcagccagctggtgagttggttgaattgtcaacgcaaagtgcgctggttgaagcgatgacaggccgcatctttggtaatgcccgcttcttcttcccacgtgagatgatgagtgaacatgctgtgggtgatggcatggcgccgctttacaatgaattccagcgttatgtgcataacgaaacactaattgcaccagtaactaaataaggtaggccgagtgctgccagacgaaaccgtttatgggggataaacatgacgattaagctaattacaattgatattgatgacacattggtgaatacagccaagcaagttacgccacgtgtgaaggctgctttgaacgaagcaacagcgcaaggcgttaaagttgttctgacgacaggacgtccattgccgggcgtgcaagaatacttggatgaactgggattgaacaatcgtgacgaccagtatgcagtgacgtataacggtggcgttgtgcaaactacctcaggtaaggcgctgggcggtcaagagttgtcgtacgacgattatttgacgttgcgtgaagtggccaatgatttgggtgcgtacctgcaagttgaaacgttggatgctgcctatacaacggatgacacaatcaactattgggcaagtcgtgaaaacttcttgattaagatgccgttgcatgtgacggatatggctgagatggatccaaatgaccattatgttaagttcatgtttattggtgacgaagccgacgtggatcgctggcgtgaggcattgccccaagccattcgtgataagtactatattgtcaagtcaacgccccaacacttggagttcatgcacaaggatgctacgaaggggagcgggttgttggcactagcagaattgctgggcatcgaccgatcagagaccatggcgttgggcgaccaacaaaatgatttgacgatgattgaggcagctggtttgggtgtcgccatgggaaatgcagtgcctgaagtgaaggcgattgcggacgttgaaaccacgacacaaaatgaagatggcgttggtgtggcagtcgaaaaatgggttcttggtcgagatgtgccggaattggcggattaaccgagaataatatttgccgaaatgcctgaaatattgtaagataagacattgagtaagaccgcgaaaggacgtgcagtgatttggcattaacacaatttgacggccaaaataaggctgagctttcaatgattgaagttgctcgtgcgattttgtctgaccgtcatgacaccatggcgtttagtgatttgttgaatgaagtacaatcattcactggtaagacggacgaagagattcgtgcgcgcttggcacaattttacactgatttgaatattgacggttcattcatttctttgggtgataacgtttgggggcttcgttcatggtacccaatcgactcaatcgatgaagccgttcacttggatcttgaagaagaagaaggtcaaccaaagaagaagaagcgtaagaagatcaatgccttcttggcagacgttgcagatgatgacgatgttatcgactacaatgatgatgatcctgaagacgatgacttcggtgacgttgaagaagaagacgagacggcagctgcatcagatgatgatgacgatgcggatgacgacgatgacgacgattcagatgacaacttcggtaatgacgaagttgccggcggaatcggtgaagaaatcggtggcatcgccccagtcgacgacgactatggttcaggtgacatcgaacgttaatttttaattaacaataaaaacgcatggctgtgatggctatgcgtttttttgtgattgttaaaacgtttttgcattttcttaagaattcccgtaaactggtaaagttgcttttttagaggtaaccgcgagaaagccctcgcgtaataaagtaaagcgtgcgcggtaaaccgcacgttaatcaagaaccggaagagaggtattcattatgaatgcaccacaaacgtccccaaagttttcttgggaacacgtcgctaaaatttttaagccatcatggtatgtcgaacagatgaagggctgggcaacagcctcatacatgttgttgatgttcgggtttggttttctgattagtcaaacgattgctaaccctgttacggggatggctgtttggacgttgattgccgccttgctaggatttacgacaactttggcaattacgaatgcacgacctgtgaacggtattttagggttgatttcggcccttgtatacatcggtttggcaattgaagcgcacaacccggcagatgcaattttgcaattcgtttatattattttgttggatttgccggttattttaatgccatcgtggtcaaagaatgtggccatgaatgtacgcaagattagtgaagtaaaagatcgtggcgaaaaaatgacctttgctaagacgcggacgttcttcgtcttggtctttgtcttgtcatttgtggccttgtactttttcgaaatttacatcacacactcgccacgtccattaattgacgcgggtgcagctgctatcggaattaccggggcagtgttaacgacgctccgcttttcagaggcttactacatgtggttcctacagggaatcgcacaagttgtcttgtgggggatgaccgccgcacaaggggatgcctcattggtcttgttctttacgtacatgttgtacatgggaaacgacgtcatcgccttctttgcctcaccgtggtttaagaagagtttgcgtgtggcagataaagaagactaggaatgtcggtggtttttaaaaccgccgacgtgaccaagtcgcccttatcaggtgcgtccttgttcttgattcctggccaaagccagggatcttagaacaagagctgctgtggcaaagattaaaataaataatattggcacttaatattgacttactttgaaaaggtgtgtattattaagttccgggctcttgtatttgtttaatacaagacgtaatcaaagttgattaacgctcccaacgctataattagcattgggagcttttttagtttttattgctcctgcacaaagaactcggaggattatttttatgacagctaagtacgtctttgttaccggtggtgtggtttcatcattgggtaaaggtatcgtcgcagcatcattgggccgcttgttgaagaaccgcggtttcaagattgccgtacaaaagtttgatccatacattaacgtcgacccaggaacgatgtcaccatatcaacacggtgaaacttttgtcactgatgatggtttggaaactgacttggacttgggacactatgagcgtttcatcgacattaacttgaacaagtattcaaacgtgacgtcaggtcgtgtttactctgaagttttggccaaggaacgtcgtggtgattatgatggtgcaactgtacaagttattccacacatcacgaatgcattgaaggaaaagatgatgcgcgccgctgaaacaacggatgctgacatcgtgattactgaagttggtggaacggttggtgatattgaatcattgccattcatcgaagcattgcgtcaaatgaagcgcgaagttggtgctgaaaacgtcgcatacatccacacgtcattgattccatacttgcgtgctgcaggagaaatgaagacgaagccaacgcaacactcagttgctgagttgcgttcattgggaattcaacctgacatgttggttgttcgtactgagcaaccaattacgccagagatgcgtgagaagttggcattgttcacggacgttgcgccagaagcagttattgagtctttggacgttgacatcttgtacgaaattgctttgaacatgcaaaagcaaggcatggacgatgttatcttgaagcgtttgggcttgacggctgaaccagctgacatgactgaatggacagccatgattgaaaagatccgcaacttgaagaagaagttgaagattacgttggttggaaagtatgctgatttgcaagatgcctacatttcagttaacgaagcattgcgtgccggtggttacgcggttgacgctgatgtagaaatcaacgccatcaactcagaaaaggttaacgatgagaacgtttcagaattgttggctgatgctgatggtgtgatcgtgcctggtggattcggagctcgtggtactgaaggtaagatttcagcaatccaatttgctcgtgagaacaatgtgccattcttgggcgtatgcttgggaatgcaattggcttcagttgaatttgctcgtcacgtccttggttacgcggatgccaactcaattgagttgaacccagacacagatgcgccagttatcgctttgatgaacgaccaaaaggaagttacggatcgtggtggtactttgcgtcttggtttgtacccagctgacttgaaggatggtacgttgacgaaggcaatctatgagggtcaagatgagatccaagagcgtcaccgtcaccgttacgaattcaacattgattaccgtaaggaattcgaagatgctggtatggtctttgccggaacgtcacctgatgatcgcttgatggaaattattgaattgccagaaaacgacttcttcgtggctgcccaataccacccagaattcttgtcacgtccataccgtccagaacctttgtacggtgcctttgttaaggctgctttggacaagaaggaagcttaatttagttaatgcaagagctcgtttccaatgatggggaacgagctcttttttatggggactggctttctcaatatttcgtcatagaactaaccaaattgataattttaaagtaatgtttacgccttgcgccggaatggcaagtttccttgttattggtgtatctgtactgtaaaattgacaaggaatgttatccaggtgacgaggaaacgtcctgatcggcgatagtcgattagtaactgcgataacagacaatagttaatgaaatgaacgggcctgaacgggcgtagggggcaacccctgttaataaaaagggtgaaaataatgaagaaattggttatccatggtggtcgtcgcctgagtggcgaagtgactatcggtggcgcaaagaattcaacagtggcattgattccggcagcgattctagcagaaacgccagtgaagtttgatagtgtgcctgatattttagatgtatacaacttgcaagtaattttggaatcaatgaacgtcacgtcaacatttaagggtggcgaattgatgattgacccaactgaaattatcgaagcagagttgccttcgacggcaattaagtctttgcgcgcctcatattactttatgggttctttgcttggccgttttggtcgcgcaacagtaacgttccctggtggtgataacattgggccacgaccaattgaccaacacattaaagggtttgaagcgcttggtgcgaaggttcgtgaagaaaatgatacggtctacatcacagccgatgatggactaaagggcgctcgtattttcttggatatggtgtcagttggtgcaaccatgaacatcatcttggctgctgtacacgctgaaggaacaacgattctggaaaatgcagcccgcgagcctgaaattatcgatttggcaaccttcttgaacaacatgggcgcacaaattcgtggggctggtacggatgtcattcgcattaccggtgtgcctaagctagagtcaaagaacacgcacacgattattcctgaccgtattgaagcagggacttatttagcattggctgcggcgcaaggtgatggggttttggttaagaatgttattccagaacacttggaatcatttacggctaaaatgattgagatgggtgtgcaattggatgtacgtgaagatagtatttacgtaccaaagtcggaaaacttgacgccaattcacattaagacagcgccattccctggctttgccactgacttgcaacagccaattacgccattgctaacattggctgatggggaaagtgtgattacggaaacgatttacccagagcgcacacgccacattcctgaactacaaaagttaggcgtggcaattgaaaaccctgaatatggtcaaattacggttactaagagtaataacttccatggggctagtgtggctgcggctgaaattcgtgcgggtgcttcattggtcacggctggcctaatggcagacggcattacagaagtaaccaatgctgagcacgttttgcgtggttacgatcacatcatccacaagttaacgatgttgaatgcagatattcaaattgcggaagattaatttacgttaatcacagcatttaatttaaaaaatttaaaccgtcttcacgaccggagtgacgcgtcgtgagggcggttttgttatgattctatgaattttctgctaccgtgttacttgctaattacttgttaacaggataagatagataagttacaaaaaggactgttgccaaaatcaaacgcagtatggatgccggattgtgtctagtttgaattttgttcgtagttcgcgatatatagagcgcgattgactccgcaatcgcaactggaggaaatattttgaagttttcagagttgggtctatcacaagacctattgacggccattgagaagcatggctatgtagaagccacgccaatccaggaacaaacgattcctttgactttggctggtaaggacgttatcggtcaagcccaaacgggaaccggtaagacggccgctttcggattgccaatcttgaacatgattgacactgacagcaaccaagtacaagcacttgttgtctcaccaacacgtgaattggctattcaaacacaagatgagctattcaagttgggacgcgataagcgtgttaaggtacaagctgtctttggtggtgctgatattcgccgccaaatcaatggtttgagccatggtgctcacatcgtcgttggaacacctggtcgtttgatcgaccacatcaaccgtggcacgatcaacttgtcaaacgttaagactttggtcttggacgaagctgacgaaatgttgaacatgggattcttggaagacatcgagtcgatcttgaaggccgttcctgatcaacgtcaaacgttgttgttctcagcaacgatgccacctgctatcaagcgtattggtgtgcaatttatgacggaaccagagcacattcaaatcgctgccaaggaattgacaactgatttggttgagcaatactacgttcgcgtgcgtgactttgaaaagtttgacacgttgacgcacatcttggatgtacaacaacctaagttggccattatgtttggtcgtacaaagcgtcgtgttgacgaattgacacgtggtttggaattgcgcggctttaacgctgctggtatccacggtgacttgacgcaacaaaagcgttcacaagttttgaagcaatttaagaatggtgaaatcaagattttggttgccactgacgttgctgctcgtggtttggacgtttcaggtgttgactacgtttacaactttgacattccacaagattcagaatcatacgttcaccgtatcggtcgtactggtcgtgccggtgctcacggaacttctgtaacgttcatctcaaatgctgaaatggactacttgaaggacattgaaaagttgacgaagaagcgcatgttgccattgaagccacctactcgtgaagaggcgttggctggtcgtatgtcagttgcagctgattcagttgaagcagttattgcagcaacttcaggatcagttgattcagaagttatcgatactttggttgaaaagtacgatgcaaagactttggctacggctttgttgggagctgttgcgaatgtttcagaaatggatgctgaattcacgttgtcacgtgagcgtccattgccacgtaagcgttcaggcttcggcggtggttcacgcaacggtggtggataccgtggtggtcgtcgcgacggcggttcacgtaacggcggtggataccgtggtcgtcgtgaaggtggtcgcgatggcgaacgcggacaacgcgaacgtcgttcattcgaccgcggtgcccgtacaggttcaggtgatcgttcacaacgtggccgctcaggcgcaccacgtcgtcaatcacgtgactttgtcatcaagaataacgattaataaagaaggctggttgtataaccggccttttttgcgcaaaaattttgaatagcaaaccggacttctcagcacaagttctcttttttatgcaccgtaatcggggtataatgagacaatgatttatggactgggaggtcgattataatgattatcggacaaggcatcgatgcacaagtaattagcgatgtaacgcgtttggcagagcgtcgccctgagtttattgatgtcgtgttgacaccagcagagcgtgaggtgtttgacgtacgtaagggtaagcaccaaatggaatttttggctggtcgtttttctattaaagaagcatatagtaaagccattggtacgggcattggatctgaagcccactggcacgacatggaagtattaccaaatgaagctggacaaccagtcatggtcaagcaccccaagcaagacgaggcggtggcacatatttcaatttcacacacaggtgataccgtacatagttcagtaattttggaatcgttggcgtctttacaccaaccggtcagtgagcgtcgcccatcttggttggaaatttcagccgaggctttggcacataacgtggcctacgtgcgcgagctgaccgaaacgaaccggttctttgccgttgttaaagcaaacgcatatgggcatggattgccacaaattgtgacggcagccaagcgtgctggcgtggatggctttgcagtggcaacgattgatgaaggagtttggttgcgccaatttggtgtgaagttacccattttgattttgggtgtgacgccagcgacttatgtggctgacttagcaaagtatgatttaattcccgtggtagccagcgagacatggctggatgatgcgctaagtcaacttaattccgaagcaaccttaacggtatccgttgcagtggatactggcatgggccgaattggtattcgcgatcgcacggaactcgagcgggtggttgcaaagttgaatgcagctgataacgttgtattccaaggcattggcatgcactttgcgacagctgatgggaatgatacagtctattttgaaaagcaattagccaagtggcacgagttgacagacgagttggatttgccagccgatatttggcgccatttggccaactcgggtacgtcattgtggcatgagcagccaagtacggatgcagttcgcgttggggcggccatgtatggattcgatgcctcacagggagccttgccaaatcgtgagttacaaccagttttgtcattgaaggctgagttggttcacgttaagcaggtgccagctgggacatcaatttcgtacggggcaacttatacaacgacggaaccagaatggattgggacagtgccagtcgggtacgcggatggctatccacgtgctctgcaaggcatggatgttttgctaccagatggccgtcgcgcagaattagttggccgaattgcaatggatcaatttatgatccgactaccagaagagatgccggttggaacggttgtcacgctgattggtcaggtcggtgacgaagaaattacgttagttgatttggcaaataagatggatacgattccctatgaaatcgcaaccggattgtcaccaagattaccacgtcatttagtgaagtagagagagcgtatggcaagtcgacatgatatcaaacgaggtgacattttctttgcggatctgtcacctgtggtgggatcggaacaaggcggtcaacggccggtggtgattattcagaatgatgtgggtaatcaacatgcaccaaccgtgattgttgcaccgattaccgcgcaaattgcaaagcctaagatgccgacccacgtggggttgccggctgaattagaggatacggggattgctcgggattcggtaattttgctggaacagattcgaacgattgataagcgccgattgcaagataaaattggccttgtcccaggtcacctggtggcaaaattagatcaagcgttggtcattagtttaggcttagtttagccccttatttttcggaatagttgcgaatagctgttaaaataatagcaataaataaaaggaggagtggtgctcatggaacactttaatgtgggtgttattggttcaggccctgctggtttgtcagcagcctttccattgcaagcagctggtcaatcagttgtgattgtcgaagagtatctctggggtggtacctgccctaattatggttgcgatcctaagaaggtcttgttggcggctgttgaagctaaggaacaagcagaatggatgcaacacacaggcttgatcggtcacaatgagattgactggccagccttgatggaacacaagatggcatacacggatcctgtgcctgctcgtaagattgcgggcttggatgatgcgggtattacacacaagtacggacatgcctactttgttgatgagcacactgtctcaacgggaacggaaacgttcacggctgataagtggattatcgcaacgggtgcgcgtcctgcgcgtttgtcagtacctggtgatgaattattacacgacaatgaagacttcttgaacttgcctaagatgccagaggaagtggccttcatcggtgctggctttattgccatcgaatttgctggtattgcagcggcagcgggcgctaaggtacacgttgttgcgaagcacgatgttatcctacgtgagtttgatcaagatttgacgcaagatttgattgcgcaaatggagagtaagggcattacgttccactggaactttgataccgctgccgtagaagaaacggcggatggtcgcttcgatatcgttgcagcagatggtcgtcgtgtaacaagcgatatgccatttattgcagctggtcgtgcaggtaatacagaagacttgaacttggaagcagctggtgttgaagttgcaggtaatggtatcaaggttatggctgatttgcgtacaacgaaccctaacatttttgcggtaggcgacgttgctgaatcgcctgtaccaaagttgacgccaactggtgcctatgaggcgcgttatgtggctggcttgttgactggtacagagccagaagaaatttcataccctgctattccaacgatggtctacggatcaccaaagttgggtcaagttggtatgtcagctgttgaggctgaagcaaagggtatgcgtgttaactcaattgacatgacgccttggctagcatactggcgtcacaaggaaccaattgctaaagcaaaggttgtcttgaacgaaaagggtgtcattatcggtgcgactgttttgagtgctgaggcggatgagttgttgaactacttcacagtagccatcaaccaaaagcaagacaagtgggcaattaagcacaacttgtactcatacccatcaattgcatcagatatgggcttctttgcctaatcatataaataatgaaaagccattgatgactttaaaaagttgtcgatggctttttcgttttatggcatttttttgcatcgcatcaccttaaaataacattacaatgagaacggtgagttgttctctcatattgttattgaactttgctgtcaaataaaatagttttttattattttcggccagctaaaaaaatataaaaatatttgttaaccgataatacgtatttttaatatgtgtttaaggttgcgggtttattttaaggtacgaaatatttgtcatattgacgataagtaaatttaaaaaaagttacacaaggagatagacatgaaggaagaacaggatgttcgcaagacaaagcctgtgatgaagtttattggacagaccgtattttatgcattggttatcctggctttgatttacctttatggttattcaggcttgggacagggccactttatttataacgaattctaatttgagattgtttgatttatagaaagaagattttgagattatcatgcaaattacaaacatgcttgcaacgattgatgactatgctaagacgcaaccagatatggctgtctacaacgtccttggtgacacgcacacatacgctgatttgaagcgtgattcagatggcttggctgcctatgttgattcattgggcttgcctgagaagtcattggtaatggtatttggtggccaagaatatgagatgcttgcaacctttgttgggttgagtaagtcaggtcacgcctatgcaccagttgacgtgaactcagctaacgagcgtctaacgaacattttgacgattggtgaacctaagttggttatcgctatcgatccattgccaatcgatattacatcagtacccgttgtgacgctggatcaagtgcacgaagcgtttgcttcaaaggctgattatgagatgacgcacgcggttgctggtgacgacaactactacatcatctttacgtcaggaacgaccggtttgcctaagggtgtgcaaatttcacacaacaacttgttatcatacacaaactggatgttgaatacggatgattttgatgtcccaacacaaccacaaatgttggcacaaccaccatactcattcgatttgtcagtcatgtattgggcaccaacgttggcaatgggtggtacgttgtacgctttgccaaagcacgtcactgaaaacttcaaggaattgtttgcggctttgcctgaattgccaattcaagtttggacgtcaacgccatcattcgctgatatggctatgttgtcagaagactttaatgctgaaaagatgccaaccattaagtacttctactttgatggtgaagaattgacggtaagtacggcagccaagttgcacgagcgcttcccagaagcccgcattgtgaatgcctatggtccaactgaagcgacggttgctttgtctgcagttgcgatcacaccagcgatgattgaaaaggctgagcgtttgccaatcggcttccctaagccagattcaccaacttttgtcatggacgaagatggtaacaagttgccagctggcgaacaaggtgaaatcattgtgtctggtccagcggtttcaaagggttacttgaacaatcccgagaagacggcagcagccttctttgaattagatggtcaaccagcttaccacacgggtgacttgggttactttgatgaggatggcatgttgcactatggtggtcgtttggacttccaaatcaagttcaatggttaccgtatcgagttggaagaagtatcacacatcttgaacttgtcacaatatgttgaatcagcagtttctgtgccacgttataacgatcaacacaaggtgcaaaacttgttggcctacgttgtggttaagccgggtgtccgtgagcaattcgaaaaggatttgcaattgactaaggcaattaaggaagatttgcaaaatgatatgatgccatacatgatgccttcacgcttcatgtatcgtgaagacttgccaattacgccaaatggcaagattaatattaaggcgttgattgcagaggttaataaccgatgatgaactggttgcaagagctaccaaattggcagccatacggcgatcctcagtatttcatctatttgcttgttgcgttaattccagtggtggtggcgttactttttggtaagcgcattaagtggtacgaaggtttagtatcattagcgtttattgttttgatgttcgctggttcccactggcaacaatttatcgccttaatcgggtatattatctggcaggctgtgatggtcttcggctatgctaaatatcggcaaaaggcggataataagtgggtattctatggtgccgtattcttagatgtattgccactagcaatcgtgaagatcacaccagctgtgacgatggggcaaaactcattacttggctttttaggaatttcctacttgatgttccgttcggtcggcatgttgatggagatgcgtgatggtgtgttgaaggaattcacctttggccaattcttacgctttatgctcttcatgccaaccttgtcttccggaccaattgatcggttccgtcgctttacggaagattatgaaacggtacccgatcgagataagtacttggggatgattgaaaaagcggtccactatttgttcttaggcttcttttacaagttcatcttggcttatatttttgggacattacttttgccgggcttagagcatgaggcactggttgctggagggctaattaattggccaacgattggtgtcatgtatgcgtatggtttcgacttgttcttcgactttgccgggtactcattgttcgcagtggccatttcatacttaatgggtattgagacaccaatgaactttgataagccatttatggcgaaaaacttgaaggacttttggaatcgttggcacatgtcactaagtttttggttccgtgattttatctttatgcgcctagtgatggtgttcatgcgccacaaggtgtttaagaaccgtaatgtcacgtctggtgtggtttatgtgcttaacatgacgatcatgggattctggcacggtgtaacttggtattacatcagctacggtattttccacgggctagccttggtgattaatgattggtggctgcgttacaagcgtcgccataagaagcagattccgcacaataagttcacggaagggtttgcaattttcctaacgtttaacattgtgatggttagcttcttgctgttctctggattcttggaccaactttggttccataatcactagtaatgaatgaggtatataaaaatggatgtaaagactgaagtattgggaatgattaacgatttgttcttggaagacgtatcagacatgatggatgaagatttgtttgatgccggtgtcttggactcaatgggaacggttgaacttgtgcttgaaatcgaagccaagtttaacattaaggtaccagtttctgaaatgggtcgtgacgactggaacacagcaaacaagattattgaaggtatcaaggagttgcaaaatgcttaagcgtttgggcctgatttttggtccagtcatcgttgcggttgttgcggttatagctggtattatgttgatgccggaggataacaataagcacgactatcaagccgagcagcgtgctgcaaatgccttaacaccgattgtgtttaagaaccaaacccttaagcaacgggccttaagcgataagcaacaccgctttgtaccgttcttcggttctagtgagtggagccgtatggatacgttccacccatccgttttggcggaaggttatcaccgctcataccgtcctttcttattgggacaacgtggggcacagtcattgacacagtactttggcatgcaacaaatcaccaagcaattgaccaataagcaggccgtgtacgtgatttcaccacaatggtttgtgaagcagggtgaagatccaaatgcgtttaagtattactttaaccaagcacaagcattaacgtggttacagcatgctaaggggaccacggctgatcgttatgcggcaaagcgtttgctggcaatgaatgtctcttcatcactaactggttatctacgacgtattgctgatggcaagaagctgaccgcaaatgatcaaggatggattagtatgaagctacgtttcttgaaccatgaggattcactatttgctgatatgcaattgggaaataattatacgaagcgcgtgttacctaagacagctaacttgccaaaaacgtacaatgaaacaaaattgaacgctttagctgacaagtatgctgcagagcacacgaagtcgaaccagtttggcatcgatgataagttttatcaacaacgtgttgccaagcaattgggtaagctacgaggctcacagcgtcagtttaattatttgcaatcacccgaatatggtgatttgcaattggcattgcaacagtttgcagcgacacataccaatgtgctctttgttatccaaccagttaatgaaaagtgggcggcatacacgggacttgatatgaagatgtatgaccagacggttgcgaagattaagtcacagttaacgacacaaggctttacgaatattgctgatttttctcaatcaggggataagcaatatttcatgcaagataccatccacatggggtggcgcggttggttagcgtttgataagcgggtaaaccacttcttaacaacaccacaatcaacgccaacttatcacatgcaggataagtattatggtcatgactggatgacggcgacatcagtgaattaaaccaaaagtggtggcgatgcgtcaccactttttttagtaggagtaaggaaatgaatcagcgaaaattaatgattagtgcggttgtcttagcaactagtgtcatgacaatggttggcggcgtagcgcgaccggttgtggcggcgacgcaccacgttagttgggccaaaaaaccatttagtcacgatccagcaatggccgatttagcaaagcgcacggttgttaaaaataagctttcaggtagtctattagttgttcgtgataataagccagttttgtatcaggcgtatggacacactctgacgacgcccaatcaagcgttgaatgtccagtcggaatatgaaatggcttcaattcagaaaaatttaacagccatcatgttgatgcgggcgcttgcagaccatcatctgacattagacacaacggttagccactttttaccatcgctaccaaatgctaaaaaaattaccatgcgtcagttattgacgatgacatctaattaccatttgacgaaggtttctaaggaagatttggatgaggaggcgtatttgaattttgacatgcaacatatccagattaagcaaacgccaaagtggcgttacgaagctgggaattatgatgtgattgcgatgattctccgtcagttacaggggaagtcgtatgatgatcaatttaatgcgctgtataaccaacaccaaggatataatttccaaggttatgatgcatttacgaagtcaccgtactatactgaaagtcaaaaagaaactggccaacattatgctggaccggccatgatttataaccgtgagattggtaccggggcaaaggcgacgtctgtcgttaatatgtatgaattcttagaagacgaactacatggcaaactgctgtctaaaacagcttggcaaaacatgaccaaaacgaatggtaatgagcaatatgccagtggtctttaccatcaagcagatggatcactctatttgcatggtttaattcagggttatgaaccaacaattaaaacatcccgtgatggacacacaatggtgatttggttcagtaatcggatgacccaaaaaacacacgcgaacgtggcctttgcacaattgatgttccgggcggcgactgaatagagaggaatgctatgaaaagatatttggcggcgacgcaacaaagtatggcaacgttattgccggttgtattggccttaacgtggttagcgttaggacaacgacttgtgttactgccggatggcttttttccgacggtgttacattacacaaaattcgtgggcaagtttgtgatgttaaatgggttgattacaaacgcactgaccatgggattccaattagtcggagtgttagtagtagccagaacgttgatgaccttgctaaagtcacatctcaaaacggaacaattaggggttttaattgctttgtcagccttaattgtgtggcatttgctaggtaacccacaaatgattaactggcttattttgccagtatttgtcatgtcattggtttggccagtacaacgtgtcaggcctgaatggcgctttagtatgggcgttgcggtgaatgctatctatgcgttgtatattttggtggtgcagcgttggtgggaatttagtttggcggcttacttacaacaagttgtcaatggctggtttggtgatggcccacaacatttgtggtcgagcattgcctggtatgtgatggcggtgcttggtaatggtcttggcttaaatagtctgtcatcagtggtgaatccagatatcagtaccacaacggccaacgccaatttggtcgcaatgttgcaacaccaaaccttacccaatctatacagtctttatccgttggcaccatttgcgttagttgggagtgctggcatgttgttggccttgtttttggcgatgatgatccggcgccgcatgaaacatgtgtcgattacttggttgttggtgttgataccattattactagatcagtggtggccattagcctttatgataccgattatgtggcggccacggctgatggggcggatggtcgctgtcacaatcgtgaacttattattaggggcgctgctattattccgccacttagcacctgcggtttattgggtgccaagtggtacgcctaacctgttgttaggtgggctagcctctcaccaattaggggcttatgcaattgtcatggttgtgatattactgctagatatttggctatattggcaaccagcaaaacggattttagaagaggtgacagatgcgcaatggacttaaatgggtagttaccgcgggtatgttcatattactcgtggtgatgattatactgggtttacgatggagtgaggctaaaacctcaacaaatcgtgcaatttttaattctaaaatgacgccaacgattttaattccagggtcatcagcatcacaaaaccgctttgatggtttggtaaaggaattaaataaaggggttaataagcacagcttactgaaagtgaccgtgaaagagacaggggcgatgacggttagcggcaaattgcgggcccgtgatcaggccccttatatggtggttgcttttgaaaacaatcatgatggttatgccaatatcaaaaagcaagccgcgtggttcaataaagcgattctcatgctgcaaaagcgttaccatttccgccggtttcaagccattggtcactcgaatgggggcttgatttggacacgatatttagaacagtattatcaagcggaagaactacaagttaatgtcttaatgacgattgggtcaccgtataattttgccgagaagagcattaacaacaagacacaaatgttggcggactttattaagcatcggaaagctctcccaactgatttgacggtgtattcgattttgggtacggagacatatgatgatgatggaattgttcctgaagaatcagtcgaagccggtaagtatattttccaaaagcaagttgcccattatacacaaatcacggtgacgggggatgacgcacagcattctgatttgccacagaatgatcaaatcgtgcagctaatccagcaaaacgtcttgccaaagcctatgggaagtgagttgaaccgacctaagtcgtagatgtgttgcgattttgcaacacgtaaatggctaaaaatgcgtcgttcacaatttcttcacaattattcacattttaattcaccatttccacttactataaatagtgttgaaaagttagtaagtaacttttgaaaggtagttgacggtggcaaacgccaactactacgatccttagctgggtaagagcggctgagagggataaagagaattggttggaacaaagcaccgggtggagagacccggtgcttttttcgtgcgattttttgggggagggagggtgtcgtgctagcgcacgaggcatggtggttggggagtgattccgacaaagattcgcccgggcaaactccgccggcacgagcaccggctagcacccaaataattgtgctaagggtcagggtccgtagcgccttatctaaccggcggtcggccgaacttgtgagttcacccgggcaaatcgctccatcactccccaaccaccatgccagcaaccgagatgttatcaaattttttagatagtcatccttgagtaatacggtattaagttcaatttattagcctattacaaagtaagaacttttccgaaaagttagcgacttacttattgaaaataagtgtcatccagggatgcttatcaaataaaaatatattatcttggctgctggtgtgtgggttggctggggtgctgcggagatcttgctgtattagtaggcgtttaagagaggtagcggcaccaaagaaatcttggcggttgggtattttggcctcgctccgagggcaaaatggacaagcgcttagatagattgggaccgtgtctcagccttctaattcagcaagacggagcagcgcaccggtcaaccctcacacctcgtcgcaacgcgacgaaccatctgacgttatcaaaatagtttttctgaatgaattgagcgtataatggttgaattgaaataaggaaagaaagtaaggtgagcgattatgcatgcagatcaaccagtagaacaagaacgactagacaaagtggttgttgaaattgatcagcagttggaagatgcgaaggacgcatacgcacaagctcattctgaaacacgcgccgttgaaggtaattacatcgccaatacgtcaattaacacgtttgaagtcgatgatgccatggaaacgaatgccgaaattcagcagcaacgaaacattgtggcccgtgtaacggaaactgaaaatatcatgcgtaagacggtggataccttaacaatgctgcgaccaagtccctattttggacgtgttgatattgatgaagaaggtgaccaagagtcgttgtacattggcttggcctcggttcaggataaaagtggtgatttcttagtgtatgattggcgggctccgattagtggtatttactacaacggaacgctgggtaaagtatcatatccgaccccaatgggagagcaagatgctgaattattgaagaagcgtcaattcaccattgcagatgccaaaattgttaatatgtttgatacgaatgaaaccgtgggtgatgagatgttgcagtatgcgctggggcaacaaaatgacctgacgatgcgcaatatcgtggctacaattcaacaagagcaaaatcaaattattcgagacacaacaagtgacttgctggtggtgcaaggtgtggcaggttccggtaaaacgtcggcgattttgcaacgaattgcctttttgctattccacgcccgtgaagaacttaatacggatcaaattgtcttgttctcacctaatcggttgttctcaagttatattgccgatgtcctgccatcacttggtgagcgcaatatgcggcaggtgacgctggctgagtttttcagcgcacgtttacaaggattgcaagtacaaacgttgttcgaacggtacgagacaggacaaaacacagttagtgatgcaagtctgcaggtgcgagaagtgcttgaggacgcaacgattttggatgcactgacggcttttgttgagcagctaacgcctacaacgctacgttttgacaatatctattttgaagatgatgtctttttcagtaaggaagcgatgacgttattgtttgctgaattctcaagcaactattcagtacgcgagcggattcaaatgactcaaaagtgtttgatggaacgtttgaataaccggattgacggtttggttgatgaagactgggtgctagaagcactgaataatttggatgaccaacaataccgtgacttattaggtgatgaactcgccgagcaagttgcggaagaagaagaaatgggtgatgcgattgatgtggctgcgaagcgctacctcgagcgagaattccaagtggttgatgatgcactatacaatatgcacttctttgatatctataaccaatacggtgatttcctagcttacatggcaaatcaacggccagcagaagcagagtggtggctatcaaagcgcgatcgctttttacgcgagctagagtatcaccgaatcgatttagaagatgcagcacccatgctctttttgcgtgatttgattacgggtggtggtacgaataagtcgatgttttacgtcttcgttgatgaaatgcaagactataccatggcacaattgttgtatttgaagcatgctttcccagctgctaaatttacggtgttgggggatgctgaacaagcgctcttccgtgaagttgagacgcccgcatcgttgttggccaagtatacagccgcatttaaagcgactaagcctaatttgatcacgttgaataaggcttaccgctcaacgcaagaaatcatggattttgcgaaagcactcttgccagatggtgataacatcatggcgtttacgcgtcctggtggcaaaccagccctctacatcaccgacacaaccggcgtcgctgatgaattatggcgtcaagttgatgtgttacgccaagatcataacaccgttgctattttgacaaagacacaaccggaagcggaagcggtgtaccggatgctacgcaagtatcctgaaaaattccaattattgcaggccagtgatcggacacgaacgtctaacttagtcgtgatgccaatatacttagccaaaggactagaatttgatgcagtgattggttatgatgtgtcacaaacgaactatcctgattctgaagcaacgggcttactttatacgctagcatcccgggctatgcacgctttgacgctcattagcgttggcccagtatcgagtttaattcgccaggtgcaagacaccttagaaattcatgcctttggtgaataagagaatggccgggaatgcttgttatcagtaggaaaaactcttacaatgaacagtgacgaaatttgattttagcggcacaataccgctattagaaagaagagaaacacatggcagaaaagcaagttttgctaacaggtgaccgtccaactggtaagttgcacattggacactatgttggctcattgaagaatcgtgttgcgatgcaagattctggtgaatacgaaccatttattatgattgcagataagcaagcgtttactgataacgctcgtgaccctgagaagattcacaactcattgttggaagttgccttggattatttggctgtcggtatcgacccaagtaagtcaacaatttttgtacaatcagcggtacctgaattatcagagttgacggaatactttttgaacttggtttcaattgcgcgtttgcaacgtaatccaacggtgaaaactgaaatccaacaaaagggcttcggtgaaagcattccagctggcttcttcatttacccagtttctcaagccgctgatattgccttgtttaaggggcaagtagtaccagttggggatgaccaagagccaatgttggagcaaactcgtgagctagtacgtactttcaacaactactacggtgagggtattctagttgaaccccaaggtgtgttcccacctaagggtcaaggacgtatccctggtttggatggtaatgccaagatgtcaaagtctttgaacaacgccatctatttgagcgatgatgaagatacattgtggacgaaggttaagtcaatgtacactgatccagagcacattcgtgtcgaagatcctggtcacgttgaaggtaacatggtcttcacatacttagatatctttgacaaggatacagaaaaggttgctgaattgaaggcgcaataccaagccggtgggttgggtgacatgaagatcaagaagtacttgtttgaagtgttgaatgctgagcttgcgccaatgcgtgagcgtcgcgcaaagtttgctgagaatcctgaagctgtcttgaacatgcttcgtgaagggtcagataaggcacgcgccaaggcccaagtaacaatgcgtgaagtccgcgaagcaatgggcatccaatactggggttaagccgttgtactgacgaataccgtggagggtatagaaatgagctatttagcagtcattgacttgggttcaaattcgacccgcatggttgttgaagaactacaagcaggtggtactttcgctgagctaaagcgtcgtaagttagacacgcgtttagctgaggggatggacaataacgcgggtgaactgacagaagtcgcgatgacccgcgtgattgatgctttgattgaattccaagcagattaccaaacctatgaagatattacggtcgttgggattgcaacggcggccgtccgcgaagcgaccaaccaagctgacttcttggaccaagtctatcgagcagtcggtgttgaagttcgtgtcttaactggtgaccaagaagcctattacgattatttaggggcagtatcagccttggatattagtgatgcgtggttgttggatactggtggtgccagcgttgagttggtaggtattgaagatcggatggccgctaattttattagcttgccatttggtgcggttaacttgtcagaaaagttccaattgaatggtgctggggtagttgatccattgttgattactaaggctagtcaatatgtatctgatcaatatgaccatttgccatggttggaggacgagacgacattgccaattattttgttgggtggtgcaaatcgttcactggctcgtttggatcgtttacgtcatggtttgccagccgattcaaatttccacggttatgaaatgacgacggaatcagtgctaaagacatttgatgaaatggctaatatgacccatgaagaacgggcagccgctttaggtaccgaagctaaccgtgcagatattattatcagcggcttattgccactagttgagttaatctcacgcactggggctgacaaagtaattttctcagcttcaggtgttcgtgaagggttactccaagagtatcgcatgacgctttaaacaataatgattaattaagaccaccgtattaattgcggtggtcttttttgcggatgtttgttgggaagggtgtgtcgtgctagcgcacgaggcatggtggttggggcgtgacttcgccaaagatttgactgggtaaactccgccggcacgagcatcggctagcacccaaataattgtgctaagggtctggctcccaatgccttatctaaccggcggtcggccgaacatgtgaattcacccagacaaatcgctacgtcacaccccaaccaccatgccggcagccgagatgtatctatcatgatttggttgtcatccctgaattagagtcgtatgtgatttaccagtacagaattatgtttgctttgaatccttaatcattagagaattaccagagcattctgactaggagaggccggaagtttacgccagctgaagtcttcttcgttttccccgttagtcagttgctgagtttttcaacaaaggtgtagaagaccagtcacgctggttgcagtaaccaagatgttctatgatgtttagccttgtcaatgtggcactaaatataacggtagaacagagatgttatcaccaacgtaccgatgtctatcaaacaaatcgagaatatcttggctgccggcatgggtgtgggggattggcgtagcgatgacaggtggggaactcacaagttcggccgaccgccggttagataaggcgaacggccccagactcttaacacaattagttgggtgctagccggtgctcgcgccggcggagtttcccagctggcatctttgtcgaagccaatcccccacacccatgcctcgtgcgctagcacgacacaaaaaaaccgccggctcgttggcccgcggtaactttcacaatgctttgcgacacatcgtgagggaagcgctaattcgccaccctttattcaattgtcatggaccaccctagaggtctaatctgcagttttagacgtctgtcgccagggtttggtcgcaaccaaatctgtcttctccatctctaccgcatccacagctatttgtttaaaaagcaaaccgtgtcgggagcagccttcgaactctgtacaggcttacatccaaattggattatcgtacgtcctcgaagtaaccgatgctaatgaccgcaagagatgtcaaatcatgactaaagtgtttatctcttaaattgatacgtcttgttatcttgcgtcattactatttttgggctttcttggccgtgcaaaagcttcataatttccgttagaatatcgcataattgcctccttttactacgctttatgttgatatactctatttaaatacgactcttgttggtatttaggggtaggcagctcatagaatcccatgaactgtctttgaacagcaatttgctcacctgaaataccaccacctgcaacggttacgtttttataaatatatttcctcctatcaagtatttaatagggtaatcatatcaccaagagaaaacgctttcaaaaaatagcacctaaagtgaaacagtcactttaggtgctgcagtcatcatgaataagcggtatggttttgaaagatgggagtctttcattagtaggcaaatttgttgcatcgtatcttaattcatatacaacagtctgattatagaattacaaaaaatgtagcgatattaacgggttattattattaataaataaaaaacaacctctatcatctaactagtagataatggaggttgttttaatcaggttttacaggggcgataatgtcattatagcccctaaaatgcaacacatagttttctatgctagcttctcaatgtcctatgtgtttttgtatcttatcggcctggcacaagttatatatttttttacaatctaccaaaaagcgagtttaagctatgaaaaattattccagcaatattattcggcaacaatttgaattaatttgaccagcattagaaaattttcgtaagcgaacccagcctcgaaaatatgacctttaagaggtcttttgtgcgattctgtgccttgaaagcggttgccaagaacgttgacatgacacgagtgaacgtctctgatcgaaacggggcgattgcactcgtcacccttaatttagagcagtttaaattggttcgaaccatgatggttgatagtggttataccggccaaaattttgccaatgagattagcagtttaacctcagccaaggtaatcgtcgttaaaagaaatgagttaaaccaattttcggttatcccccaacggtggctcattgaacgttcatttagttgattgggaaattatcatcgtttatggcataactgtgagcgtaagctcaacactagtctcatgatggtttcgttagcttttatcaggttacttctcaaaagatactaaacagtttctcacaccagttttgatctttgccatttactatcatggcaatgaggctaagattgaaggattactgacggcatcacaagtgttcctgagtattgctttaccgtttgccatcatcccaatggtcatgttcaccagtaacaagaagttgatgggtgagttcgccaatcatacttgggtcaagtacgctgcttggttttccaccattgtgctggtaaccttgaacatctacttgattctccagacggttggcttgctgaaataaccgtttaaagacctttataaaaaataagtaggtttccgttatattctttataaaagtgtttagcagttgggagtcgttgacaatttaaaaatttgtctgcggcttcttttcttttagtctaaaatagaggttaataactaacaggggtattactgaatgatcaaaccagaaaagacaatcaatggaaccaaatggattgaaacgattcaaatcaatgccgaagaacgggcaaccctcgaagatcagtatggcatcgatgaagatattattgagtacgtcactgataatgatgaaagtactaattatgtttatgatatcaatgaggacgaccaattattcatctttctggcgccgtatgccctcgacaaagatgcgctgagatacattacccagccatttggcatgttgctccataagggcgttttattcacgtttaatcaaagcaacatacctgaagtcaacacggcactttactcggcactggataatcccgaggttaagagcgtcgatacatttattctggaaacactgtttacagttgttgtcagctttatcccaatttctcgcgccattaccaagaaacgcaactatttggataaaatgttgaaccggaagacgaagaacagtgacttggtttcactttcatatcttcaacagacgttgacctttttgtccagcgcggtccaaatcaatctcagtgaactcgatcgtttgccaaagacccattttggtgtcggtgctgaccaagataaaattgatttattcgaagacgtgcaaattgaaggagaacaggttcaacggatgtttgagattgaaacccaagtcgttgaccgaatcgatcataccttcaacaaccttgctaataacaacctgaacgatacaatgaaatttttgacaatctggtcactgaccatggctgtgccaacgatcattaccggattctatgggatgaatgtgaaactcccgttagccgggatgcaatatgcttggatgctgactttggggatttctgtcgccttgattgtggcgatgctgattatgctgaaggtctggcggaagatgtgatgggtgagtgacttgctgctgggtgggggacttttttggaatgtgtatagttgagcagttatgctattttgagcacccttcggcttttgaaatacgctccgacgaccctgactccgaccacataagacaaaaaatccagtaacgaacaaaaaccgatcgctactggattttctgccttatgctctggagtaaacccgggtcttgtcacgctcttattttttaccatttatttacccaatcaataccaagcaaaaacattacccttctatactaaaagtgttagaagctgtctaaaatctcttaagtaatagtgctaatataattagcgcccctagaaaacagcatgaaaacaacccccgttatctacacgctagataacgggggttgtttttttgtttaatagtattataggtactatatcagtatgaatatattggagaaataacatgtataaaaacatcaaacaatcggcagcggatttagcgcttttctaatttcccaatggctctatcatactctgtcacaagatccaaacatcaatatttggctggctagactgcttcctattcttatcatttttttgttataacttaattaatttattttattaaataactcctattcagcatgagtttccttgattgtggaaactgaaagagccccaagagccattacaataccagcaaggataaacatgtgaacttgtgagtgtccaaataatgggaataaagcaaaactcaataatgaagcaacaatctgtggtaaacaaagtgaaccgttgaataatccaagatatgtacccatgtgcttaccagtcaatgcgtttgtaacaattgttaatgggtaagtgttcatcgcagcccaagcaattccgacaagggtgtatgaaacaatcaacgtccattgatcatgaacaaagaacactgaaatgaacccaagagcaccaagaagtaaactaccaccgtaactaagcttgtggtacttgtttggcaccttagctaaaacgtatgaccaaataacagcagcgattgattgaacagcagcaagcacaccgtaccagttaccagcatcctgataaccagcagaggtagcatcaacagtattccaaacgtttttggcaatagccccagctgagtatgtccagaggtattggaatgcaaaccagcagaagaattgaacaagggtaactgtccagaatgcctttggtgcattctttaagagtgtgaaccagtttccaccctctttgttatcatcttcagaaataccatggtactttgcgtaagttgctgggtcatattcatgaacccggaaaactgtaaataaactagtcacaactaacaaggctgccccaatgtagaaggcgataataactgaatctggaacaactcctcgttttgcagtgttacgaaccccaaaccaagcagttaaaatgaatgggaaaacggcagctaacacagcacctgtgttagataagaaactttgaatcccataggcataactcttttggtcatcgttaaccatatcaccaaccatcatcttaaatggctgcattgccacacttgatgaaaggtcaagtaaagcaacagtaattgcaccgaaccaaagggcagcaagcgaaccatacccaaaaccgaaacttcctgaattaggaagcaaaatcataacgataacagctacaatcattcccaatagtaagtatggcaaccgccgaccacctaattttggtgcccatgtacggtctgaataataaccaatgattggttgaacaatcaaaccagctaatggtggtaagatgaagaaccagccaaggttgttagggtcggccccaatagtttggaaaatccgactcatttgagcactttgcagagtataagctgtctgaacaccaaggaatccaaagttgatcatccagaaagtactctttgatagagtaggtaatccagcccccgtggacttttcttgactcattgctaacaactccttaacttataaataaaacagttctaaaagacacttattattaataagtgtaagcgcttcattaaattattgcaatattaataatatcaaattttaatttttttgtgcaacctcttgcgcaaaaaaagtttagaaaacggttgcaattttttataatttaaagttcttactgttcggtttccgcaaatcaggcttttagtatctttatatatgaaagttgaacatacacaaggcatattagtttgtatattttaaaaatgatgatactctctaagcaaggaacttatacagaaagtttcaatctttatattttagggggatatattatgatttggtcactaattgttggtgctgtaattggagcggtagctggagctattacaaatcgtggagagtcaatgggatggatcagtaatattttagcgggtctgattggttcttcaattgggcaaggcgttttgggacattggggccctagcttagctggaatggcaattttcccatcaattattggagcagttattttagttttgattgtgtctgcaatctttggtattaaggcaaaaaagtagcgttatatcgtactaagggggcatgctatgaagagattttacaaggtgttacttgttatcattcttctaatttacttagttagtatttctacgataatttggcccgatataattaccaaaatactttcgtttttagatcatattaatttacacagttcgcttagcgaacaaacgttacttagatataatgagctatttattctaggattaactagtgtaattttaattgttgtaatagctttgcctcggcaaagaaaatctattttgttaattaactcagggaaaggcacactgtctttgggaaatgagggaatcaacagttttattaagacacagttatccggcgaaggattaagtaatattcaagtcgatatcaaaaacactaaacatattaagcgtttcaacgttaccgccgattctgaatataaaaaatcgattatatctgatttaccacgagtagaaaaaaacttaactgatagcttgagaagcttactatctggggttgataaatcacctattcgagtaaatataaaggtaaatcaatctaataagcgtaacaataaagcatcgcgagttatttaattttaggagtttatcgagtatggatcataaacatacagtggtttttttaagtagcttaattggttttgtaattactattttattaattcaatttggctttataaaaacgatactagtagtttttataacagtaatattcggtttattaggccttttgtttgataataatcgtatccaattaaggaaattgttacagaaaattgttaataaataatgcgggggataaatttatgactacagaaaataagacagtaacacaagagaccgtagctcctaaaggacaattgtcatttgatgacaaagtaatccaaaagattgttggttatgcaattgaaaatgtatcaggattgctaggcgtagatggcggctttgtagctaatattaagaataaaatcgttaatagtgataatccaacagatggaattagtgtcgaggttggtaaagaacaagtagctgttgatttgaatattgtgatggagtttggccataacgcacatgatgtctataaagaaatcagtaaggttgtagcaaaacagatagaagaagcaacaagtcttaccctggttgagctgaacgttgaagtaatagatattcaaactaaatcagaattcaatgaatcacaagtaactatacaagatcgtgtaactgaggtaggaaaatcagtgcaagataaagcaacagtaggaatcgataaggtgaaatctgttactgattcagatgatgcgcgagtacaataactagacctgttattttaatagggaagaaaggcattgattaatggttaatactatattaaaagtcgctgctataacatcacttgtattgggtggtattgttgttgcagccacagtttttacggcaaaagaaattgataatgctggagacaaattaggtcaaaaactacacaattaattatatataaaaaggcttcaccttaattaaaggtgaagcctttttcaggtactacctacttagataattaatgtatccatagtgtatacagtcataaactaataagatttggataatttaccatctactagctcataaacatgatcagcaaatttctttaatcgtagatcatgtgtaactgtaacaattgatttatgttgttcatgcgcaatggattgtagtaacttacccactacttccacacgatcggtatccaatgctgcagtcggttcatcagctaaaattattttaggatcagtatataacgcgcgagcgatagctactctttgcgactgcccacctgagaattgattgggtacttatttaataatgattttgtaccgagttgatttaatattttatcgaattcactactatttaaattgttatttggcgttactttgtttaccagtgaaaattgatcctgaactttgaaaaagggaactaaactgctcttatgctagatttacggacagattttcttctgccctgtaaactaatagcataggagcaataattgttagcagtgtgtttataaattataattttcccacccatatgatagataactgtttttaaacccccgttgcgcaattaaacgcaatttatatttctactaattaataaaaggctattggccaaccaattttggttagccaatagccttttattttattcataagcgttgttgtaactgataagtaatatcctcgtatccaggttttcccaacaatccgaacatattgcgcttatatgcctccacacctggttggtcaaatgggttaattccattcaagtaaccagagatggcaacagctacctcaaagaagtaaatagcttgtcccaaagcaaattcgttttgcttgtccaactcaacgatcatgttaggtacaccaccgtcaacgtgggccaacaacgttccttctgaagctgtacggttaacgtaactcatcttcttgccttgcaagtaacccaaaccgtcatcagcgtccatctctggaatcacaacgtctgttactggatcagttacgcggaacaacgtctcaaacaagttgcgacgaccgtcttggatgtattgtccaaaactgtgcaaatccgttgagaagtttccattcgctgggaagatgcccttgccgtccttaccttctgactcaccttgtaattgcttccaccattcaccaaattgtaccaacgttggatcgtagttaatcaacaattctgtcgtataacccttacggtacaagatgttacggtaagctgcatactggtaagctgggttctttgccaaatcggcatctgcgtactcggactcaccagctgctgctccagccatcaattgctcaatgtcgccaccagcagttgcaattggcaacaaaccaacagccgtcaaaactgagaatcgtccaccaacaccatccggcacaacgaattcttcgtagccttctgtgtcagccaatgtcttcaaagcaccacgctttgcgtcagtcgttgcatagatgcgctcacgagcgccttcaacaccatacttttcttccaacatttgcttgaacacacggaatgcaatcgcaggctcagtcgtcgttcctgactttgaaatcacgttaaccgagaagtcgcgggcgccaattaccttaatcaagctattcaagtaagctggttcaattgaatttccggcaaataaaacttgtgggaaatcacgttgatcatctggcaagtaattgttgaaatactcattcaagaaatcaattgctgcacgagcacccaagtatgagcccccgattccaataacaaccaaaacctttgagtctgattggattttctttgctgctgcttgaatacgctcaaattcatccttgtcgtattcagttggcaagtgaagccagtcagtgtaggctgctccagccccagtccccttgcgtagtaattcatctgcaaccataaccatcggttgcataagagacacttctgtacttgtaataaatttttctacgtattgagttttaaactttaacattgatttactcaagattagcatgcctctgttttaattctgattcagtgatattgtagtaattcatataatttataacgaacaagtccccatatatccaaactgattgctcgaacaaactccccattggttgttgagttaggctgctattactgaatttactctttcctgctagtaaagtgaaatagtccgctttttcatagattgtattattaatattagtactccacaaccaaatttttgagcctacatttttagaaatatcagcataattaattaactggctagtttcaccagatgatgatgctactataagcaagtcttcactatcaatagcaggagtattagtatctcctataaaaaaaacagattttcctagttgagaaaggcgcatttcaaaagcttttaatgctaatcccgaacgtcccgatcctgttaagaaaatcctattggtagtgtgtattaactctaacaattcggtagatatttggttatctgaattattgctaatctcatataatagatttgcccacttcattatagtttcctacttttatcctagtattttcttaaattctgcagccgcttctgcagggtcatctgctgtagaaatcgcaccaccaataatcaatagatctggatttgcctttttaatttcttcagatgcggataacttaattcctcctgcaatagcagtctttgtctttgatacattgtttgtaatgagattaaactcttcaaagggattttgaccgagtgcttgcaaatcatatccagtatgagttccaacatagtcggctccgaactcatctacttcacgagccctattttcaatatcttgaacaccaatcatatcaaccaaaatttcttttccagcttcatgagcagtcttaattgcatccttaatagattgatcctcagcgacacccaaaattgttgtaatgtcagcaccatacttgaatgcttgcgttacttcgtaagaagcaacatccataatcttcaaatctgcaagtagcgtaatatcaggaaattcagtacgaattttttgaaggccttcaagaccaaaatttataaccaacggagttccatactcaaaaatatcaatactatctttggtctttcgaattaggttaatggctccttggatatcttctaaatcaattgctaattgtaatttcataatgggctaaatcctttctttctttcaaagttatctttattatctaacttattgttaaaattaaatagagggcactttaaagtaacctactctatctatataaaattgaacaggaagtgtggaccatgtcagattattttcgtaatacagttataaaaaaacttaataatggcgatttcgattgtacaaaagaattcacagtttcaatgttcagtggtaagcataaactactaatactgtggattctaataaataatggcccacaaggattctcttattttaaaaataatttaaggggcattagtaaaaaagtattatccaatcagctaactgaattaattgatgaccaaatcatattgaaaaaagactacttaaatgggaaagtacgccacacagaatatcagttaactgatgttggagaaagtttaataccaattatcgtggcgttaaacaactggggagagaatagattgaaggaagtctctttatctaaaaaatttaacaatgatttataataggtaatttctgtgactgagaacaatttcttttttatatctatacgttattctttttatgatggtttgcatcagaaaaatcattagcaaacaaacaatgcatcaaattgacattttttgagaaacaataacttaacggaaattatttacactaaccgcaacgaatgatccaactcggtttattgaataggtacaccgcagaatatttaaatgtgcgatctgattcagaatcactaaattatgggtaattaaaaaacgaggtaatggcccttaaaacccaaaaataatttgcctatttaagggtcgcctagtttcctatctatcgatagatattttaatatcaaaagttgatcattcttaattgttaaccaataaattgacaaaaaagcagctaaatttgtaaaaatttagctgcttatatcttagttaagtttagcgtaacatttaaggattgcttgccgattaatcaaaatcaatctgcttttttataatctgccggttctggcttacccttaacttctttctgagggctcaatgaaatatcttcttcttcattcttatcttttttcgtactatctttagtcatagtggcctccctgattacctaatactgtatacttgatacttaataagtgtaacaaaataaactcacaatataaagtttctattaaaatttttataattaaatattaattgagttgtttttataatagcgctaaattagtgctaacttaatacaacatagatcatcaaaaaaacactaggatttacgtcttttttaactttttcacaagttagaatgataaaaaataacccgtaagtagccagttaacccaacctatagtataatttttaacataaaattttaagtacatgtacaaaaaaagatagtcacgcccctttattggagcgtgactatctttttttatatagctatgctgtcccataaatcaccgtaattatagggggcatattatacgcaatgcctttgtttatcaatgtcggtagtgggtaaagtgtggttactactgattttattgcagctttaaatcaaagaaagctaagcgcggctggtctagatgtaactgatacagaacaattgcctgcagatagccccctatggcaaatgaaaaacattttgattactccgcatattcaggtatttatcaagaatatgctgaagatgttgtacaaatttcccaagaaaacttggagaaataccggcaagatggaacaatgcgagaagcaaactcgatttgattcgaggatactaacagcatccgtgtcttcgtcccacaagtaggttatctggtgggttcaatgtcaccactaaaaatcttaaacgttgtcgttaactgccaggtaagttttccatagataagaccaagtacttaactaatctattggtcattttttaattaaaatactttaccaatacctatcatgggaaaataaattattaatttcgcgaataacagtgagcataagtgtttatttatatgtactccgtacctgttattgtatacttaccttacctgtataaatatttctgtatatttactttagaaaaatagtaagttaaagaaacttttttctcattaatttattttaaagagtgtacctggggcaacatcgaacataaataaattttataacacgcgatatttaagtgacttttgtaaccagaagggggggtacaagatgaaaactaagctagctaagtttcatttcttaaattattctgtatacactatttcactaggcgggtttctttttggctatgatacaggaattattaacggtgcgcttgcgttcatgagcaaaccaagccaactagacttgtcaccagcattacaaggtatcgtttctagttcgttagtcgtaggtgcatgtttaggagcattaggctgtggtaaattagccgataaaattggccgtaaaaaaactttgaggttaatcgcagaaatttttaccgtgactacaatcctttgtacgctagcacttaacgcatggtcgatatctatctttcgtttcattttagggattgctgttggcgctgcctctaccctatcgcctatgtacttagctgaaatttctccagaggaatctcgtagcgccagtattgataaaaacgctattttcattgtcctaggccaactatgtgcgtttactgtcaatgctgccttaggcaatatctgggggaggtgggacccaatttggagaattatgttgctatctgctgcagtcccagccatcattttgtggataaattcctataagataagcaatagtccacaatggttattgtttaacgaccatccaaataaagcgcggcaattattttacaaactgaagttttctaacgtgcctcaattgcttgcaacacatgaggaacatgtggctaatagtaaagagtccaactttaagtggtcgacagtgataaacgacaaagggttagtttatttattatttactggtatagtaattgcgttcgttcagcagatctcaggagtaaatactgttatgtactatggtaccattttgcttgaaaaggttggactgggagaaagcggttccttatatgcaaatattttgattggggcagtatctgtcattgccactatcttaggtactcgtttaatagaaaaatccaatcattatcacatgttgtacattgggctatttggaaacgcagttttcttgtgcttattgggttttataatgaagatttccacatttcctcaaggtttagtaaatatattggtactagtctgcttagccctttttttagccaaccatcagggcttagtcagcccagttacttggctattactggcagaaatgtttccggaaaaagttaaagcacaatttatgtctattgcgaccgctactaactggataactaattttataattagtttagtttacccacagctaatcgcttcattaggaatggcggttgtattttttatatttgcgttagcgaatggtatgagcaccattttgtctatactattcatcaacaatcatagaatgaaaattgcctatcaaggagtagatcattaagtaatacaaaaattaggaggatgggaatatggcaaacttttatgtgaacccaacagaaatcactcacgacataccggacaacgaccggccaaaattttacatgtttggcgttccaagttatacgaatatgggcgatcaggctgtttcactggcggaacgaaaatatatcgaaaacgaattttctgaataccagtacattgaagtcttggaagaagatgacgatgaagcaatcccagttgtcaaaaagcatttgcaaccgcaggatatcatcgcttttactggcggtggtaatatggggaatttataccctacccatgaagaagcccggcggaaagttttttcaactttcactgacaacttaactatttctttcccgcaatcaatccactttgaagatactgaagctgggcaggttgaaaaaaggaaaagccagcaagcatataataagaatccaaacctagtactggttgctcgcgatgcgcaaagcttccaccgcatgcaaacaactttccagaaccctgtcatttttacgcctgacatggtcttatatatggacacagttgattggcaatttgaccgccatggtgcgctatttgttttacgtcacgatacggagaaagttgttaaacagtcaaccatcgataacgtcaaaagtgtcctagacgctacctaccccgtcaagcgtgttgataccgttttagataaccctaaagaaatcacaccggtaacacgcgaaaccttgtatgaacgcgaattagagttattttcccagcaaaatattgtcattactgatcggtggcatgcgatggtcttttcagtattaactggaactccttgcttattatttggtaatagctatggtaaaggtaagcatgcttatattgattggctggaacatgtcaattggattgattacactgaagaaaatgataccgaccgaattaaagaagttatcgaaaaattattagtccagaagcgtcataactatgatgttagaaaggatttccaacaattacatgatgtgattactcgttacactagaaagtggcagtctatataacgaactatcaccttttaattaactagaatgcagggaagttacctgcattctagtttttttattgagtaaatttataatttaagcttaaaaagcagccggatttcttaggaattcggctgcttggaagtgattactcaattaaatagtagctactgatccagcatctacacgatattcagctccattgatgaagctagctctctctgaccaaaggaaagcaatcatatttgctacttcggctgctttcccacggctttggctagtcatatgtggccttttatcattaaggaagctgcgaataacttcgtcaactgaaacgcctaattggtccgctcgcttttccatcatccaatcagtcatcggtgtatcaatgaaagctggtgatacagtattggccgaagtgtttttcctacccagtgttcttgacaagcccttagataaggctaaaacaccatcctttgtacaacaataagggatttcatcagaataggggtgctgaccatcttcagtctcctctcattggttaaattaatctcatttaataagggcacgttatctaaacaagccataagacacagcttttttattaactactccaaaaccataggctaacatgttgtctaggtgagctcaattaagcacacctagactttcgtctaaccaatagataattaaaggtttttcgctataaaactaccaaatatcctttaaaggtaccttgttctccgtagccaagcccacactacagtactcagaataatagaaatcaacacaatccaaaacatgccaaaagcatttttttcaaatagtaccggcgtatttataccccataaaccatagataactgacggtactgtcagaacaatcgatatctctgttaatgtcttcatgatggaatttagttggaatgatgaaacattattaatcattgatccaagactgtctaaaaaagcactatatttctgtataatactatccattgtttctactcggtcataaaggtcagaaataacatggccaaccgtttcgttgcctctacctattttttggatgtgcgtactcagaaagtcgaccattcttttatctgtcttatatgttgaagatagaactatcatgtgtttttgtagtgataatagatcgttaaatactggaataacaggccctgcatctgtaatatgccgttctaaaccgtcaatttcccctttgaattttcttaactcttcaatcatcaaggcaaagctattgtctattgtctctaaagctgcttcaatggcaaagttgttgttgactgtcaaagaaaggtccgtcagcgtgtcaattatcgatgtaactttctgctttgtgacaacgatgagtttctcttcaaaaattaggaaagcaattgatgtaattaaatcatctaaatgaggtcccttacttaaatctggtaacaagtaactaatgaataaaaatttttccccagtttccttatcagttatgaagtcagatacaatttcatcttcacgtctgataacctcatttaactcaataccatattgttcctgtagtctgtcaattgcctgctcatcttcaccgtatatatacgttacataacttgctaaatcattgtttttagggaccaattttaattgtccaacagtaggattataattgtctatcataaattatctccataaaccggtttagttataccataataaataactaaaataaaagacatctattactagacgtctaataccataattaatattgctctgctatttattcatacgggtcgtaacccaagatacaattaataccagtattactgctccaataattgaaggaattaaggccatgcccgcgagactaggaccccaagcccctaataggctttcacctagccatgaaccaattaaaccagctaaaatattactaatccaccccatagctgcgccacgactagtaattgcacctgcaatcacaccaattaatgcaccgacaattaatgaccaaatcataacaccatcctcctttatttatatcaatatagataacgggtttttcacttatttttcgatcgtttagaagctttttttgaaggttgtctcaaaaggcgatatacactaaataacgcctgacaaactataacaacaattgacattttagaccataaatctatacggccagtttttctcgtcatatcgtacttctccttataaatatgtttaaatgttgcctctagttatcctaaccaccatttacatttagggactcccccgttatgtaactagcatccttcgaggcaaggaaaacataggcacctgccagctccgcaggctgacctgctctcccgactgatgtttcgctaccaaattttggtatattttcttgtagttgaccacctgaaacttgtaacggtgtccaaattggcccaggagctacactattaactcttatccccttaggggaaagctgctttgacaaactaacagtcatgtttttaattgctgctttcgtgcctgcataatctactaagaatgatgacggttgagatgcttggatggaattggttgtaatgatactactacctggattcatatagggaagcgctgcttttaccaaccaaatgagactaaacacatttgttgtgtatgtatctatcaattgttcagtggttagcttactaatatctgtctgtgcctgctgcttaccagcaaccaacactaatacatctaggcttcccaaaaaatccgctgccttttcaactagctctttgttaaatttttcgtctttcaaatctccagggattaacttgattttcctaccagttgattcaataactctttttacttcctgagcatcactctcttcttctggcaagtaattaagtactatatctgctccttctctagcatatgctatcgccacagacctcccaatgcctgaatcaccacctgtaataatggcattaatgttttccaaacgtccatgtcccgtataactagcagatccgtcttcagggatgggcgtcatttgagattgcaaacctggttccacctgagattgctttggaaaatattctttcttcaattcatctgtcatattttctcccgtctagccaattgactatatagataaaaatgtttacaacatcgacataaagatcttacccttaaaaaatttttctacttagtatataagtagaaaaatacttatatactaagttacgtgaatcgtaacattcaaatttgaatttttcaattaattagcttgcttaacataacctcagcaacacaaattttattagaagagctaacagtaggctacacttttggatgtctatttatgaacaaatttcgcacaaattaaaatttaaattttgtttgaaaattcattttacaaacatgcttggtaagtgtatttatgtatacataatgatattcacttttaattactaacaatatggttctgacaaaaaagcgtaaaactgagaatttttatgggtattatgtcttcatacgtgcttaaatttgttatgcctagcatgctgcctgtcctattcggatgggatatcgcagtactgccaatatttagctatgttaattgccatagttatcaacttcgctgctggattaattacgggctgacccctcaaactactactttcaacaattccctaaatatttacgcttaaatattaaaattattagcaatggaaacactcttgacctacctaattaactactcatgccactgatacgtaagtagtgtagaacgtgctctatttaaaatagattatctccccaaaaagcacctgcattactcaacaataaagaagtagacttttaaaaaaagtgcggttaatctttaccctttggcaatctttgcgcctactatccaaatactgaggaaaaactgctaaaaacagcgtgtagacatcaaacttttatgcttaatgtctacacgctgtttttactttgctatttattttttattgcttattaacctcttagctgtatttcatgtaggagggatctgatgtcaaggctccggatctctttttcgagcccgctagggatcgtccccccttaaatttttaaaaatgacctgatttcgttaaatttcacaagtctgaggggatagcaaataaacactgctcagagtgatttttggctattccttatcatcaattgaatgctttcattcaaatattctacaattcactaatcaacgcatttagaaacttagacgctgatttaaaccccttttcctttgcaaccgcgtctaatcgtttacgaacacttggctgtaaagtaaacgtatagtgcttagtagtctcatgttcgtcttcattgttaaacactggcacttgcaaaacagttttattggccaagctatcgtttgccttattttcaaaggcactgtccttacgtactgcctttgttagttgttcattctttgggttaaatgccataataaatactccttatcatctattatcataaatagcacgtataaatagtacgtatacgtactatttatacgttaaattttttcagtaatatttttaaatacgctatccatttcactgaaaaaatctcggttttttacgaaaatgctgtggtcttgtttcatagttgatagcgactctttatcaagagttgtccgattaaacaattcttttgacggaacaatgccaatgacagattcatcatctttaatcgaatctagcaactcatgagaagatttagtattgtgtttaatcatgtttgcaacaaaataaagttgcgctgtcacgtatgagttacgtgattgaaaatcaattgcttcatcacgtaactcttttaaccgctcttccaaattaaacttggcattatatccgtgttcacttggaatgattggactgataatggcgtggctgataatagcggcatttctcgtggcaatcgaaaaatcggggtgtgtatcaaggataatgtaatcgaatttccccaaattcaaacgataaaaattatcgcttaaccacatgtacagcatcatgttcttatttgttttattttcaatttctcgttccacatcatcaagatgtaagtcacctgcaataagactaacattctcactaaccttatgaatatctacttgtccttgaccagaaaaaatattagcaaccgtattttcagtagcatagatattatacgtttgtgttaaattgctttggtgatctaagtcaataaatagaacctgattgttatggtcagccaaccactcgccgtaattaaaagccaatgttgttttcccaacaccacctttaattgctgaaaacgtaagtatcttcatttctcataccccttttatatttcctatacttataatatcacggtatactcactatgtatacgtataatttatacacagttagtatatgtataaatcacaaaagactagtagttcatctaactaatagcgcttgtaatactcaactacaaggatcaatgcaacgctatccaacgcctgctggacaaggtcgtataagtgaaagtcattttaatttgaatcccgcttgtaatgtacaccggctaattagtagccttcggcagatacaagtgcaagcacttgaaacttatatgctgacgcctaattaaaaccttttttaaaccaaaacatattgacatgtaccaactaatcatcgctccgaaagatttgagtatttgagaatacagttcacccatagcttagccataaatgaactatatgcaacgtcaatcgctcctcagagttctcgtaccgtcgtcaacaagactagttcaacactcacacttttaaggcgtcaggagccgtatacctgccttttagcggtttcccgctggtgtgagccaataaagctccgtagaccgtccagaattacgttatacgttgattctaggcggtgttttgccacccacaaacccagttttacatatgatccgttattgaatcacttagtttttgcgtcaaatgcgcttggaagccagaggtcgtgtccttatatgcgctccccacacccccatgccgtaatagtccgtcacggcacagggaatgccgtttaatcatcggggtgcattttccccgccacaaattgtggatacgtctataacgtgtacgttctaccggtgctaatttgccacataaaaaggggacgtgtaagcgtttcttcgtacacacttacacgtcccctttggtatcgtctgttgaatgccccttttggactgttcctgacgttatcttgttgaacttttctataaacctagtataatagatttatagaaaaataaatgtgttaaagatacttgcctatccttagcacaggcacttattggaacgccaattccaacgagtgcctttttttattcacttgttatatgatatatctattataacgcaacatgttgttttataatagatatactgccaaatttatttaatcaatatactaactataccaaaaaagccccactttgtgcggggcttttttggtatctataaactttgttcactagttgtgagtgttgaatcgttttcttgatgtcttctgtactctttccgtctgattcaagacagtctttgacggcttgtttggcgctgtttctggtgtgtttcgagtaactcgtttgcattatctgtaacaatgatacctttttatacgtcacgaactacatatacatctatcgcgttcagtttttcagaccttgattagaatacctatttcttcttagatcttgggtggctattacgtccttttttcgcacgttcctgatttaaccacgcaagccctgaatccgtaatgtacttactccaattagtttctatgatggcattttcaggtatatcgcctttatagcgtcgcaaaaacaaactgatgtaactacgacttttgccaatcatctcacttgcttctgagaaggtatacatgttctcgttatctggtagttttctcataatgccactccttagttataacacacactatcgcattatatatgcacacctacattcccctgccataagagtgttgctgactgcgattctgccggcgacccttggcttgcatatcatgctcaagttctgattcgttcttttgattacggcttaggttgtagataatattcatcatagcgcctgtaaatagcttgttcgtgtatttcttaggcgttgtctcttcgtattgcatacgtccataatcgccaccaaccctgtcacgggtatatcgttcacgctttaaccattcattaccacttacttgctttgcctgttcaatcagatcctgtggtattgccttgtcatcagacgcttcccctataaacaattgcactgttccaccgttcataagcacccgcttcaatgacttatttttaacgttatcaatactttcttgtcccgccaatactttcagtccttgtacgtggtcgttcgtactaaacatgcgtggtgggttctctgtaagcaccttaatatgggcttctctaagttctttttggttcgggttgtaatagttaatcaaattgtacagacgttctttctcaaccaaattcaacgctttgtaatccacttctttaaatgtactttcaatagctgttttgtactctgcttcgacaactcgttgcatttcttgaatacctgcaaacttacgtactgaacgcaccaaactctcacggtcttcgccggtaaatttttgaatcaactttccctttgaatcatcaaggtcttgccatgttttaccttgcttttgcaaaatggtttccatgtcattcatagtgcttctacgttgcatttgaagtaatcttgcactgctgtatggtcgcttagtaaacgtcaatacttcacgatttatcgtgaacgctctgatgtcattcatacggtcttgtaattcatcatttgagaacacacgattttctgaatttgtttcaacgatcagttgtcgcaattcagactttgagaacttatccttatccagttctgggtataccttatcaaccactctatcaaccactttatttaccaactcattggcttcatcaagggcgttttcttggcgtgcaataatttgcattgccttagtcatatcttcgccaacggcattcttaatgaatgtactatttttccagttaaataacatacgttgcttatctcgcaattggtcgatttcgatataagtttgtagttccttacctagcttggcaatttgtcccttttcttcaaaactcatgtgttccttcaaggcaatcaagcggcgctctgcaacaattttttcgccaacattttcttgttgtgataaattacttcgttgctccttaacaagctcgttatactctgctcgttctttggcttgattattcacaccaacgtgctttgtagctggcaattcaataccctgctcttttaatgtcttttcgctaatgcgatcaggcatttttttgagttcaaaatattgatttacagcttgtgcccactgtccacgccactcatcaactttccccggcttatcccaatcaacaagccaaactttactttgtcggatgttgccttgttcggttcttgttttgttgccgttttcgtcaagaatatattcagtttttgccttttgtccccacgtaccgtctacgttaaatggtcggtttgtcagcataacgtgtgcgtgcggattatctgggtggtctctgtgaattgcaatgtctgaaaccatacctgaatctacaaaggtttcttgaatataattagtcaacaactcacgttgttcttcatcacttaattcaactggtaatgcaacattaaactcctttgcgtaacgtgagttagccttgttttcttgggcttctacttcattccacaaacgttctctgttactagcccactccggcgcgttttcaggcaacaaaataaaagattctggctttaaaacacgggggtattcataatttttttcatcagcgtctctgtaaagaacttcgccacttctgtaactagcactagcaacggcacttcgtccgtctccggcactaatgtttttgaagttcatgtgaaaaatagccatttttaatatccccctttcctgttgtttttttgtttatttttttagttgccgaaaaggcttctaatacacaattttttgagcaattacatcaactatttagggttgatgtgtaagtgcgcttactactcgtttcactcgcttgtaagattcccatttactgtaactttattctacatgtttttggggtgtttttcaattttttattgactgttttttgtggatttgctaccatgaatttaacaaatggtcgatttaaaaaatccgggggtaaaatcatggctttaagcaacttagaaaagcaacaagcacgtcttgaaaagctgaacaatcaaattcgacttgaaaaagaaaaaattgagcgaaatttaggtcatgaaataatcaagaactctaaccttgattattctgattttacaaaagaaaaaatcgcagagtttagttcattgttagggtctcaaatttcatctaatgatttagatcattctaacaacgaaaattaatcaaataataacggttcaactaacgtcaataagccacaattttaagtagataaataaccatgaatgataatctggataagctagttcaacaaaaaaatgaactagaaaaaaagattcaaaaaaatgagttactaattaagcaaagtaagtattatgagtcaaacaaagaacgcaaaacacgtactcgaaaattgattcaaaaaggtgcattacttgataagtattttgacattgaaaatctatcagtagatgaaactgaatctctattaaaagtatttgcggaatacgtaaaatctaataaacctgaaaaatacaaaaaaggatagccctattcaggattatcctttttctatcaacaaccctatcaaatttttgtatcttactagttagcggcactgcacaaaatatatcggattcaaatttatcttgaatcgcgaaataatgtggcctggaatgtcctattcatttgtttgtatttaaaaatggatcattaaccgattcaaaaaaatcatcagcaaccaacactaagatttcgaattcaaaatcagaactatcactcatatccattccccctaacaaaaaggcctaccatgacaccggtaggcctttaccactataacctggttatttataaatctgatgatcgaaccgatatattggtcaattgaacaatatatgttatgattgacgtatggaaaatccaaagtttacagcattcacacgtcctaacggacataacgaattcgtggaatttgttaacacgctacctgtaaaagataggcaaaaactgttgtcgacacttaaaaaaatcgaagaacatggtttgccagttgcctcacgtatggagtgggtaaagcctttgaataaaaacatttatgaaattcgttcaaaggttggatcaaacattcaacgggcgttgtactttcatgtagtcggaaatgaattcattatcacgcatgggttcacgaagaagacacaaaagacgccatccgctgaaatcaagcacggcgaagcgttgcgtaaagaatattttgatatggaggactaaggtatggctgcaaagacaatttcaatcgatgatttgattgctgatcaaatgaaagacccagaatttaaggctggtttcgaagcagaatcagaaaagttagagtctgcagtgcaattgatgttagcacgtgaggcagctggcttgtctcaacgagatttggcagctaagtcaggtgttcctcaatcaacaattgcgcgtgtagaacgtggttcaaataccagtgttgatacgttaaataagttggcgtatgcgttgggtaagaaactagaagtacgattcgcataataattggtatagattgtgaaaaaagcccaattgcccacttgtgaagtgagtgaattgggcttttttaaagtttgtgaaattgcaaaaatcacaaagggcgatcaggccgcgttttaactgggacttgggataatcgatgttatgttaactccctttggtataggtattatcagaaggcacttttaaagtaaatcatcgtaccctttttcaatcaaaataatcttcataacttgtaattataaataaaagtgctcctatgaggggatattttaacaaactagaaaaactagtccggaatctcctcataagagcagatggcgctgatgtcaatattatggacaagttctgcgaggcgtgtcatcgacacgcgatgacagtagcgttcccccttccttctgggggaactgctatttttcggcgcctattatccggctagaaaaacctccggcgggtcacgccgtgacggggcaatttatcattgcaggatcgctttcagcgagagcatgtcatgcagaacgctacccgcgtcgggcaagctgatgtcagcttaaccacataaaaaagaagttgagatagtattggtgtctatctcaacttcttttgaatgctaatatatggatcagtctattggcgtcaatcaaaagtcatgaccaatattcagtctgagaaaaaaagcgtcgtttattaaaacacgtgcagtgcaattcttcatagtacttagattcactatcattacttccaacgccgtactttaaaagacaataaccatttgataaactctgcaccaatccgtcattgttaattatccgggttaataagagttgtttggcaagaaaaaagtgatattttcccgtaaatgtatatatttatgtcaataagttggatcaaaaattccgctttggacagaatagtactatcttcatagtgaacaatattcaagtatcttgatcaaacttggagactacaggtcaaaacggccatggtaaatagttcattctaggacatcatgaatagtgataataccgacaacttcttcattatcgtcaaggacaactaagttggaaatattatgtgccgccatttttttccaagcagcgccattgcgggattcttggtcaatgctgatgaatccttctgtcatgtaatctttggcagtagaatttttgacttggctaatgtccaaaaattttttacgaatatcgccgtcggtaacaataccaatgactttttcatcatcgtttttgacaagcgtcatgccaacggcaaaatcactgatacggtagataacatcattgattggtgtcgatgtatgcacgtaaggaatcttcgtgtgcatggcatttttaacattttggagtaataacttgccaatggagccacctgggtgatatagggcaaagttttcgcgtttgaatgctttctctttttcaattgcaattaacaaagcatcacccataaccaatgtggccgtcgttgagctagtcggtgctaatttagtagggtctgcttcttcagcaacatcaacttttaagagtaaatctgtactattagctaatgtagaatcttctgatcctgtgatagccacagttttaagattattgtggtgaatcacttgcaaagcaatcaacgtttgaatgacttcttgggtttcgccactattagaaatgaaaattgctaaatcatcactagcaacacgaccaagatcaccatgataggccgtaccagcatcaatataaaagcttggaacgccaactgatgaaaaagaggctgcaattttgtcagcaataatacccgatttgccaatcgcaataaaaatgagacgtcccttggtctgtaatatagttgccactacactatcaaaagtagtgtccaaagtatctcggacagattttaacgcgtcaatttcagtgttgaacgtgtgttttgcatcgtcaaagtaagtcgtcatgggcatacaccgccttcatttcaagatgttcatgaaataatcgattcgcattctccagaataggacgaatttttgacaagtataattgactgtcttggtcagaaattgcctctggtggattaggatggacttcagcaaaaatgccatcaataccaatggctagtgccgcgcgcatcagtggaaaggcgtaatcacgattaccacctgaatgattgccataaccacttggcacttgaacagaatgggtcgcgtcaaaaatgacgggatagcctgttgcacgcatttgaatgagacttgtcatatcaacaacaagctggtgatagccaaacatagtgccacgttcagttacaagaatattctggtcgtttgttgcgactttatccacagctgtttgaatatcttccggtgccataaactgtgcttttttgatgttgacaacacgcccagtttttccagctgccaatagtaagtcagtttgtcggcttagataagcaggaatttgcaatacgtctgcgacctcagctacaggttcacattgataaggttcatgaacatcagtgacgattggcacatgataattctctttaatcttggctaaaactttcagaccagctgccattccggcgcctcgttgtgaatcaatagaactacgatttgctttatcaaaagatgatttgaaaacgtaatttatcccaagttcatcggtaatttgttttagcgtctcggcgacctcagcacatgtttcataggattcaatggcacatgggccggcgaggagcgtgagacgatcgtttttaaagccgtaattttgaaatacatcactaatttgtggcatgattttctatctcctaagctcaaagattttgtaagcgctttctagcgattatcaattaccgaaattatatacgctttatcttttactaacaagaaaaatgctcatgctaaattttaaacaaaacttgtcattcatttcatttggaggatttgtattctggtgggttagtagtggcaaatcattttggttagcaataataagtgggaatattttattttataatcaccaagttttgctcagataacgattgatgaaatcctggcagcacttgagcttattaatcaacgaccattaaaaatccatcatcaacagactgccattgaaagtttccgggcttgttcggattaaacttgtaatttgccatttactaaaggttagcggctattttattattcacaatgcttaaaagataacttatcatttgttaataagccgcttgtgaggtacgatgtaagcgaatacaaaaaacgaaaatggaggcgtttgttgtgacagaaaaaattgcgtttgttacgggcggcggtcaaggaattggtgaggccgtggcaattcgattacacgaagatggctttaaggtagcagttgcagatttgaacatcgataatgcaaatagagtagccgctaaattatcaccagatggtagtcaagccattggtgttaaagttgatgtttcagatcgtgattctgtcttttcagctgttaatgaaacggttgataaattgggcggatttgacgtgatcgtaaataatgcaggtctcggaccaaccacaccattggataccattacaccagatcaattcaaactcgtatatggcgttaatgttggtggtgttctctggggggcccaggctgcccatcaagcctttaaaaaattaggacacggcggtaagatcatcaatgcgacttcacaagccggggttgtcggaaatcctaatttagctctttattcaggaaccaaatttgcagttcgaggaatcactcaagtactagctcgtgacttggctgaggaaggcattacggtcaatgcttatgcaccaggcattgttaagacaccaatgatgcttgatattgcccatcaagttggtaaaaacgctggtaaggatgatgaatggggcatgcaacaatttgcaaaagacattgctttgacacgtttgtcagagccagaagatgttgcggctgtcgtctcatttcttgcggggaacgactctgattatattactggtcagacaatcatagttgatgggggaattcagttccattaattaatagatctgtcattagattaacaaatttaaacaggatgagtgccatggcactcttcctgttttcgtattatggtaaattatataattaatccgaacaaaaattaaaaaaatcccaaagcaatctcttacaatggtagtagctaattccaaccaactataaggagtgatcttatgctagatttacggacagattttcttctgccctgtaaactaataacataggagcatcgattggtttaacaatcgacgaatatcacagaaaaaaagcatgactccctgcgaatacagggaacatgccttaacagtttaaaaatattcaattttgtctaacttttgtgttgcactttaaatgaggtgatctttttgaatcttttaagaaattatagctgctaatgcagcaccagtccgagagtttttatcctttaggctatcttttggatgaccttcaaaacaaacttgaccgccgaatttaccagcatcgggtcccatatcgactaaccaatcggctcgtgaaattaatttcagattatgttcaatcagaattaatgtattgcccttatcgaccaatccttcaaataaatcgatcaattgttgagtatcctgtaagtgcaatccggttgttggttcatctaagaaatagattcggccggtatgattcaattccattgctaacttaacacgttgcacttcaccaccagataaagtggtcatcgactggctaagatttaaataaccaagtccaacttggtggagtagactaacctttttgtagatatctggcacatctttgaaaaactctaaagtgtcgttgatagaaagatttagaacctcagaaatatctttgtcatgataagtgtattgtagtgcttcttggctataacgtttcccatgacacaactcacattcttgaatgattggatccatgaatgccatctcggtgatcatcacacctttacctttgcaacggggacaagcacctttaccgttataactaaatagttgtgttgaaacgccattgttggctttactgaaaagctttcgtagaggatttaaaatgttcaagtaagttgcaggtgtagaacgaatattcaaacctacagaatcctgactcaaatcaatatagtcttgatcagaaacttgttgtttgaaagcttggactaaagtactttttccagaacctgctggtccagatatcacggtcattacaccttgagggattctggtagatacgtcttttaaattatgagaagttacatgattaacatttagccaagattgaggttcacgaggctttgggaaagtgattttttctcgtaacattttacccgtaatcgtatctgaccgtaatagttcgtcgtaggtaccagtgaaagttacttgaccaccatttttgccggcttgtggtcccatttccacgacataatctgctgtcgaaataatggcagggttgtgatcaactaggataatggtattgccatgttccttgagcttttttaaggattgggcaattaatttaatatcgtgaggatggagtcctacacttggttcatcgagtacgtaaactaaatcggatagggaactcgtcaaatatttggcaattttaattcgttgagcttctccaccagatagagtatcagttccacggccaagggaaagataacctaaaccgatgtcgaccaaagcttgaactttactatgtagttcacgcaccattgttttagccttggggtccgagatattatccaaaaattttaggacacttactaaatccatatcgctgacttctgcaatatttttgccagcaattttaccagttagagcctttttgttcagacgtgttccatgacatactgggcaagtttttcgagtgacaatctttgataaggcagcttcatgatgacgacctgaggcactatgaataacagagcgaagcatacgtggaactagtccttcatataatgccgtacgtccccaatttgccggtggattttttaatttttgttgcggagcgtgcatgaacaaatcatattcttcatcggtgtagtctttaatttttttgtctaaatcaaataatccactgttgccatattccttccaacgccaagttcccggttgaaaaccggcaaaagtcattgcaccttcattgagtgatttattaggatcaattaattgacgttcatctatgtcgtcaacaaagcctaatccctgacattttggacacattccctgaggtaggttaaaggaaaaccattcagaatacccaacccaaggctgtccaattcgagaaaacatcaaacgtaagacggaatagatgccggtgtaggttgccagagtagatcgagaattacgaccaataggcttctgttcaaccacaattgccactggtaagttgtcgattcggttcacttcaggttgaccgtatttaggcaaatattgttgggtgaaactaggaaaagtttcattcaattcacgtcgggaaacagcggctaatgtatcaaaaactaaagaggatttaccagacccagaaagaccagcaaatacagtcgttttatgcttaggaatatctaaactgacatcctttaagttattttcttgagctccatagatagagatagtcccatctgcaaataaatcggtcataaaaacctccaacagtgaatttataattctgctcttacaccatttttaagacgtttgagtctttgattggcagtacggtatgttgcataataatatttttacttttcgggtttccattgtcatttagtcatatcttagcattcataataaaaattcatagttttgaaaaagacttgatacttatataagcatcaagtctttttaattacatcccgaatatgtcgcattataataatctgcaatagtttttgataattcagaaagttttcacagctatcaatgttttatagtaatttattctcggtaagtagctcttcgataaacgttccctttatcttcttttttagaacagctttagctaatttaggaattcctaaattagcctcatcaatggtttttttatctcccatatagtagatggctttaagtagttctcgaatatcataaatggatccataaacttcaggaacagcgcgttcaacttcaagtaaagtatatacagattccatggctgtcctaattgaatattcggtggtaaacacggtgtcattactaggtgactctgcgaaattaccaataaaggctaaattaacagaccctttaggaacaatatctggcctatcacccgcaacgcggggcataaaatatgatgtaataaatggcataaatactggaacggtgtttatattgttttggttagacaattgtttgattttggactcagggacaccaaggtgataaaggagttcttgagtgatttcttccccagaactttctacaatagtcttattaacaaaatttccttttgtatctgaatatagtccatatatccatacaattgtttcattttctttttgttctttgaaatgtggctgcctgtggaccgcgaaactcatcaaccagttcgaatcggttatggtaatgatcccaccactattaattttgtgatcatgcaaatcacgattggtgagacgttcaatgtaaggttcaatttctggtgattttatagtggctgtcgctgacacaaaccaacttttgtcaggtaggttatcgtagaatacttctggatgaccgaaatcattagattgttctgccagattcttccaaagtgaccaactaccacccaactcttttgatataggagcgggtttatcatggcttccgtatgttgaactttctgtaatagatccatttgtaacgaatacaagatcatcacgcgataggctaacatcatcaccatcctggatcacgatttttttggcaactttttcgtcattgtcaaaatcgactacaatattattaacttgtgtatcataaatgaattcaacattatatgactctaaataccttataatgggtagaaccatagactcatactgattgtacctattgaactttagggcgctaaaatcaggtaagccatcaatatgatgaataaatcgcatcgtgtatcgacgcatctcaactgcagagtgccacttttcaaaagcaaacatagttgcccagtacatccaaaaattactttcaaagaactcatttgagaaaaattcctcaatagtcgtcttacccagttttgactcgggagttaaaattaaatctattaattctttagatttttcatccaaagtatacaggccatctgttgggacgcgttgtccacgattataaattaggcgagtattagatgaatttggatcatcttgatctagccaataaaattcatctaagtaagaggcgtcttcaatttctaaagaaggaatcgatcgatacatgtcccacatagtttcaaaatgattttccatttctcgaccaccacgtgtcacaaatccgatattggcacgcttttctccatctaacgatccacccggagtaggcaattcctcatatatatgaattttttctccggacatttgtccatcgcgcactaagaaaacagcggtagccaatccggctagccctcctccaataatatacgctgatttttgatccacatcgcctggggtcgttccgccatcgcctggggtcgttccgccatcatccggattttcagtcgcggcctttgcatttgcaacaatttgttcaacttcttcaaccgttgcggcatttgtcacttgatcgaggtaagtttgcttacccgcatcgtccaagttcgtcaaaccactaatttctgtcgtcgcccagtcttttgcgttcgtcaaattttttgcggttgcgtcagttacgattgcgtcgatggcatccgcggttgtggcgtcagatacctgttgcttatagtcggctttctcctcgtccgtcagatacttcatcgcatcgatggccgccgttgcgtcagccttcgcagcatctaaatcagtgctcttggcatttcgcgcatcctcaacgatttgttcaactgcttcaacggtcgttgcatcaagcaatttatcaagataagtctgcttgcctgcatcatccaagttcgtcaaaccattaatctcgtccgtcgcccagtcttttgcgttcgtcaaattttttgcggttgcgtcagttacgattgcgtcaatggcgtccgcagttgtggcatcgtctacttgttgcttatagtcggctttctcttcgtcggtcagatacttcatcgcatcaatggctgccgtagcatcagccttttcggcggtcaaatctgtgcttgtggcgttacgggcttcttcaacgatttgttcaactgcttcaacggtcgttgcatctggcaattgatctgtataggtcttcttgcccgcatcatccaagtttgtcaaaccattaatctcgtctgtcgcccagtcctttgcgttcgtcaaattttttgcggttgcgtcagttacgattgcgtcgatggcgtctgcagttgtggcatcgtctacttgttgcttatagtcagccttctcttcgtcagtcagatacttcatcccatcaatagccgccgttgcgtcagacttttcggcagtcaggtcagtacttgtggcgttgcgtgcatcctcaacgatttgttcgacggcttcaacagtcgtggcatccgtcaattgatcaagatacgtctgcttatctgcatcatctaaattggtcagccccttgatctcatctgtcgcccagtcttttgcgttctccaagttctgtgctgtggcgtcagttacgattgcatcaatcgcatccgcgtttgtcgcatcagttacttgttgcttatagtcggctttctcttcgtctgtcagatacttcattccatcaatagccgccgttgcgtcagacttttcggcagtcaggtcagtacttgtggcgttgcgcgcatcctcaacaatttgttcgacggcttcaaccgttgtggcatctggtaattgatcaagatacgtctgcttatctgcatcattcaaattcgtcaaaccactaatttctgtcgtcgcccagtccttcgcgttcgtcaagttctgcgctgtggcatcctcaacaactgcatcaatcgcgtccgctgttgtcgcatcagttacttgttgcttatagtcggctttctcctcatccgtcaaatacttcatcgcatcaatagccgccgttgcatcagccttcgcagcggtcaaatcagtacttgtggcatttcgcgcatcttcaacaatttgttcaacagcttcaaccgttgcggcgtctggtaattgatctgtataggtcttcttgcccgcatcatctagattcgtcaaaccattaatttcagtcgttgcccaatcctttgcgttcgccaagttttgtgctgtggcatcagatacaactgcatcaatcgcatccgctgttgtcgcatcagttacttgttgcttatagtcggctttctcctcatccgtcaaatacttcatcccatcaatagccgccgttgcgtcagccttttcggcagtcaggtcagtacttgtggcgttgcgcgcatcctcaacaatttgttcgacggcttcaaccgttgtggcatctggcaattgatctgtataggtcttcttgcccgcatcatctagattcgtcaaaccattaatctcagtcgttgcccaatcctttgcgttcgccaagttttgtgccgtggcttcagatacaactgcatcaatcgcatctgcggttgtcgcgtcggctatctgttgcttatagtcagccttctcttcgtcggtcagatacttcatcccatcaatcgctgccgtggcatcagccttcgcagcggtcaaatcagtgcttgtggcattgcgcgcattttcaacaatttgttcaacttcttcaaccgtggcggcatctggcaattgatcgaggtaagtttgcttgcctgcatcatctaagttggtcaaaccaccaatttctgtcgtcgcccagtcttttgcgttcgccaagttctgtgctgtggcgtcagttacgattgcgtcgatggcgtccgctgttgtcgcatcagttacctgttgcttataggttgccttctcctcatccgttaaatacttcattgcatcaattgctgctgttgcgtcggccttcgcatcggttaggtcagtacctgtagcgtttcgggcatcctcaacaatttgttcaactgcttccacagtcgcagcatctggtaattgatctgtataagtctgcttgcccgcatcatccaagttggtcaaaccattaatctcgtctgtcgcccagtcctttgcatttgccaagttctttgcggtggcgtcagttacgattgcgtcgatggcgtccgcagttgtcgcatcggctacctgttgcttatagtcgactttctcttcgtcagtcagatacttcattgcatcaatagccgccgttgcatcggccttttcggtagtcaagtcagtacttgtagcatttcgcgcatcttcaacgatttgttcaactgcctcaaccgttgtagcacctggcaattgatcgaggtaagtttgcttgcccgcatcatctaagttggtcaaaccaccaatttccgttgtcgcccaatcctttgcgttcgccaagttttgcgctgtggcatccgcaacaactgtatcaatcgcatccgtggttgtggcatcggctacctgttgcttatagtcagccttctcttcgtcggtcagatacttcatcgcatcaatcgctgctgttgcatcagcctttgcggtagccaagtctgcaccggtcgtatcaacttgcaatggtgttgttcctgctgaatttgcaaacaagtcaacgttaatcaattctgaccgtgcaatggcaccctttaccgaaacagagtcttgcgtgccatctggcgtaacttgtgttggaatcgttaccgaggtactacccagaacagataaatcaactaactgattaacagtatcacctgttccggtggtcaactcgctaattaatggtgttaacaaattatcaaccaatggactcaaaactgggtccaaattaacaatgcccaacaaatttatacttgataaggtgtccaacaagtctgacagcgtaccactcaacgtttggcttaatgccgtgcctagtccaccatcaatattcactgctaaatattgactaccatccggcaaggttgtgaccgtcgcttcacttggatcgattgtatattgcgctgtaatcgcaccatttttcaaattgtctagcgttgcattcaaattatccacaactgaggacccaactaaaagcttggtcacgggattatcaataacgttaagcactccctgcagtccattaacaatcggatccagaatagttcctaatccgccagtaaccgcaacatctacgctaataggaccattagccgtaatatccgttcctgctggtacctgtagcgcaacctcacgtgaacctgtgttgaccgctgaaacgtcggcaacaccacttcctgccacagtaaagttaacatttgttgcttgatttgctggtaatggttcagtcacatcggcagttgtatcaacatcactaaatatctgactatctacagcagccgcttctgccgttcgttgggtaatatgtaccccattttgatcaactgacacaaaatccgatagcgtaacaccaccaaaagctaaaccaacaacgccagcaattacccacatcttttttgccttgtacatccgctttctttgaacagatgacaccagcgtctttcccacttttttcatagtgaacccccacagttctatactctctaattaacctacaacgaggttgcccgacacaatcaatgatttgaaaccgctgagatagccgagtactactccaataaaccgatttttacaaaatactctcaactctgcaaaactaatacaatttatttttaccacaaataaaaagcgaatacaaaacaaatctattgtaatatttttagttatttttattttatataaaaagtaaaatattaacgcttaaaacatatttataatcaattattaatgtaattatgttttttatctcatgtttacactttctgttagtaagtgcttgaaaaacatggttttatacgttttgtaagcgtttgcgtatatataactaatttgttcattcattaacaatcagccattgtccggtattgtgtacacaattcccaaaaatgccgcatgaattcaaattcatgcggcattagattaaatggccttcaaattcaatacccaagcattacgagcctcagtttctggtgtttcagaaatcgtgtagttcggcgtgttagtcacaatcatcatgaccgtcgtatcgtaacctgcggccgcaatcgcagcacgatcaaaggttaccaacttgtcacctgctttaaccttctgtccctgttcaacaaattgttcaaagtgttggccgtccaattgcacggtatcaatcccgatatgcaataagatttctgcgcctgcatcagtcaccaagccaatggcgtgcttacttggatagaccgccgccaccgtggcatcggctggtgcaaccaagtcattattggttggtacaattgcgagtcccttacccatcgcttcactagcaaagacgggatctttaactgctgacaaaggcaggattgttccctgaatcggtgcattgagttgctcgccaacactaactgtttcatttaaatccgtggctgtttgttcttcagctggcacaccaaagaaatatgtgagtaccgtcggaataacaaatccaacccctaatccgataactgcagacatgaatccaggtccaataaacgttggcacaccaagcaaactaaccagcgtcatagcggttgcttgtgcgccaccaacggctgcaatggccccaccaatcgcgccaccaatgaccgcaaaaataaatggcttcttgagcttcaacgttaccccgtaaataccaggttctgtgataccaagcaacgctgacaacgtagctgaccctgacaatgacttcaacttcgtgttcttcgtcttcaagaagacacctagtagcgcacctgcttgagcaatgacagcaactgtcaaaatgggttgcaacggatcatggcctgataccgcaatcgtattcgtaatcacgggcacaaacgtccagtgcaccccaaaaataacaaacacttcccaaagcgcccccataatggcacccgcaattaatggcgcaacattgtaaatcgcttcaacagcacctgacaagaccgttccaaccccggtccccaatggtccaatggccaatacggtaattggcattagcagcgcaagtgagaacatcggcgtaaagatattgcggaccgactcgtggaagaacttatcaaagactggttgaatatatgatagcaaccaaattgccaacaaaattggaatcacgcttgagctataagtggcgctgaccactgggataccaaagaagtcgagttgcgtcttgccccccattgctgcaaccaaattagggtataacagcgcaacggccaagccaatcgccacaaactcgttcacctttaaccgtcgggcagccgttatggccagaaacaccggcaagaagtagaagaagccatcggcggctgcataccaaatttgatacgcaccactggtttctttcagtacccctgtcacgctgagcaaggttagtaatcctttcagcacaccagttcccgccatcgcccctaagaatggcgtgaagacacttgaaatgaagccaatgaagcgattaatcagcgaatccttttcaactggttcatcagttgtggttgctgactcacccccatttcccaaaccagccaactttgataatggctcaaaaacatttgccaccgagttaccaatcacaacttgatattgaccagctgattgcacaaccgtcacaaccccatcaagattctcaatcttttcggtttgggctttcgcttcatccttcaacttaaatcgtaagcgggtggcacagtgccacgccgtgttgatgttttcctgaccaccaacgtccgtcaaaatttcttttgctaacccctcgtaatccatcacgtttcccctttttgaaaaacaaaacccgcaagaaaacacgtcacatagcgtgctttcttgcgggttttgcctaattaaatagtaacaatcccaatgtgagatttaattggacctagctattgcgctaaggtcgattgcagtacacgattcaaatgtaccgttagataaatacgttcattttcagcaacttgtttatgggtcttatcttcgatgtagacaatcactttgtcggccaagtcatacgcttttggatatgatcgttggacgtgctgtaacatgaccgcatcaatatttgcattacccgtacgattttcttcgtcatataaacgatctaagaaaaatcgtaaatggacaagcaagcgttgataattaatatcattttcatcaatcgtctgtccaaccgcatagcggataatggtcaacgcatcactgattaacgttgtgatttgactcgcgcgttcatttgccaaatagccattctgcttatcgacaaacttcaatgcaatgaaccccgcctcatcatcaggtagcgccacgccgatttgttcaaggatcgtcgcgacggcccactccccaatttgatattccatcggataataatgacgggtttcccatagtaaattgttatgcaccacaatttgctatttggctttttcgatggcataactgatgtgatcagccaacgacaccaataaatatgtgttgaacgttgtgtgtaattgggcctctgcatggcgcaaaatattcgacgccatctcaataaccagcggtgagatttcactagctaaatcgttaaacgtccggccccaatgttcatcctgcggcaagtaccgcgtatcaattaatgcttcttcaacagcatcacctcgcttcttttgaaatccaatgccacggcctataaccacaatatcttgctgcttgtcttcagccagtaagacattattattgaaaattttcttgatcagcatcaatatcctcccaatagaaaagaccaaacaataagcccgtgcctgcatgccacgtgatttcaatacttatcattcggtcttgcccagttcaattttggttacaatccgtatcactgactacatgttagcatcattatgtaagcgtttacaatacaatttatgaatgagcgcaaaaaataacttatctgaggtcaaaaagcgatacggctgcattaaacataaaaaacaaggcgtccaatcgcttgaacgccttgttaatgtcactaatccaatgcggtcccattcgttgcgataacgtgttggtaccaatcaaaggaatccttcttctgtcggttcaacgtcccattcccggcgtcgtcttgatcgacgtagaccaccccataacgcttcgacatttctgaggttgagaatgaaaccaggtcaataatcccccacatggtgtaacccatcaggtcgacaccatcgataatcgcctcacgcatttgttcaatgtgttgacgcaaataatcaatacggtattgatcatgaatttggccatcagctgcaatttcatcaacggcgccaagaccgttttcaacaataaacaacggcacacgataacggtcccaaagttcattcagcgtaatccgcaacccaactgggtcaatttgccatccccaatcagaggcggccaaataagggttacgaccaccagtcgccatattaccaagtgtttcggcttccccatcagtggcactcgtcaccgttgtcatgtagtaactaaagctcaagaaatcaactgggttggccaaaaggattgcctcatcttcggcagccatgtcaatcttgatgccatgcgttgcaaaatagcggttcatatattctggatattcaccacgtacctgcacatcggtaaagaagaggtttaattcatctgctaattgggcggcttgcacatcagctggatttggcgtggctgcgtacgtttgcatgcgtgccaacattgatccaatttgtgcgtctgggtcgatctcatgcaattgcttcgtcgcaattgcactggcaacaaattggtgatgcaacgcttgataacgcaattgtagttgttcatcaaacggcaaaccggcatcaaccacaccagtttcgtggaaaccaaacgtacctgtattgatttcattaaatgttaaccaataggtcaccttacccttataacgcttaaagaccgtttcagtaaagcggttaaagtcagcaattgtggctcgatctaaccatccattccgcgtaacagttaggtgaattgggctttcgtagtgagacaaggtcaccacgggatcgatgccatattcagccatcttatcaaaaaccttatcataaaatgccaagcccgcttcgtttggcgtagtctcgtccccattcgggaaaatacgtgtccaggctaacgacaaacggaatgccttaattcctagttcgtgcatcaaggccaaatcctcttcaaaacgatgatagaaatcgaccccacgtcgcttcggataattttcatccgttgcatcagcgatagcaacttcaatgtctgcaagggtaatattacccaagttcatttccgttcgcttttcagccttcatcaccacttctgcggtgctaattcccttgccgtcagcctgccaggctccttcgtattgattggcggcagttgcaccaccccaaagaaagttctcggggaatcctgttggcattgttgacttgtacatattcttatacctcctgattgagttgcatgagtaagtgataaacggcgccgaacaagttcgcatcgttggcaaatttaccggcgacgatttcagctggtgtcaacgtcgacttcaccagttcattgccgttaaagaacgcaagatacttttcacggatgcgttcagcgacgattggttgcgcggaaatgccaccaccaatcacaatacgttgaatatcagttatcgcttgaatgttttgaattaatagggcaatttgattcgcgtacgcatcaaaaatttcatttgctgctggctcacccgcattaatgtgttcaaagacggtcaagccatcatcaatttctggtaattgcaactgggtcccgatgcgcttaatcatctcaacggcagacccgtgcaatccaattgaagtctccatccctgtttcaatctggccaaagataaagcttagctcaccggcttgatagtgcgtgccatatactagctcaccattcagaactaatccgccaccgacaccggtgccgaggacaatcgccataccatctgccacatcgtttaactcaccaagccatagttcagctagcgcggctgctttaccatcattttcgaccgctaccggtaaatcaagttggagttcatcccgtagattaaccccgtccataaaggtcaacgcgcccccacctttgatcgtgtctgttggatgggcaactttaccaggcacactgaaggccacccctcgaatttggccagcgtaccgatcaattacttgatgcaactgaactagaaattcaggtaatccagtcgttacggtgcgttcgttatacttttcaatgatatttccggcgcggtcaatcaagcccacctttaaccgtgttcccccaacatcgattgctaaataatttttcgtcatgataatcccctactttgcatgcactggttttggtgcacgttctggcttctgcaaagatgcagtcaccaaagtaataacagctaatgccagcaccaacaaaccgtcaacgcgcatactaaagacggctgaagtgtcaccgaacgccgaagcgattagttggaacacatatgggctcaagaaaactcccatattaacagcaactagcaaaatcgttgatcccaaattttgtgaggcttcgtccgtcttggctgctacggctgagtaaatggctggcactgccataccaaaggccaatccgtacactgcaatcgccacccccgacaaaatcaggttttgactcatacttaagaccagcaccatcacggcccctgctaaagtacccaaaccaatcatatagcggcccaaaatttgcttaattgatccaaaaattaccccagcgacaaaccccgtagcggcgctaatccctgaaatcaaacttgcttcagcagctgtcccataaccggcttgttcgaataatggcgcaattttaacggtcatcccaaagtacgtcacgaacaaaataaacataaagatgccatagccaatcatcgtcgcattcagcttgggcttttgcgtactaaccgttgatgttgaggcacctgtaaccgttggcgttttatctgaaacaaacaagccaaacataatcagtggaatcacgcctaatgcatacacgccaaatgtcatgtgccaaccaaatgacatcagataaccgaccaaccaagtaaagatggttgtcgcggcggccgcggcagcattctcaaaaccaatcaagcgatcacgttctttgccttcgtagtaaatcgaaatcagcgaaatcgctaatgaattaaacaatcctacaccagcaccaaacatgaaacgtgacgccaataagaccgcatagttttccgtgaacatgggaataacccccgcaatcacagcaattgccacacctaataccactgtctttttgttaccaatcaaccgtgttaaaaagttagacaataaaataaatagcagaattccaaaactcgtcactgacatcaataattcaatcgacgcttgcgactggtttggtaaatccttcataatcattggtactgttacctgtaccgctgcggctgcattcgtcaacgttgcaattgataacaacgatgccttaaacagccaaccatgcttatccatgatgtaaccccccgtatcgtaacaatctttctacgaggtctattgtattatgtaagcgctttctaaaaagggcgtttcttgcttagtgctgagttattttttgacatttgctggctttttgaacaaaaaaatcccatcaatcggcagaaccaaattgatgggattttatgttttatgcgattggcgggggtcgaacccgcacggtatctctaccacaggatccttaatcctgcgcgtctgccaattccgccacaaccgcatgtctgtgctaaaactatcagcacagattatattatcagatataccgatgatatgcaagtcgcttagatctcgtcatccttgtgctgacgcggttgcaagacttctggttgcttatctggttctgcaacatcctcatactttagcacgatatcttcatcagccggtgtgacgtccttacgttcttgtggttcaactggttcttccgcttgttgttctgtcttgtccttcgcgaatagaccagtcaccttatccttgatttcatcaaccttcgcattaattttagcttgattctcaggatcagcgagatactccccacccttttgtgcctgtgcaccaatttccgacaccacgttaccggttgtttttgcgaccttacttaatacgtctaaaaatgccatgttttcattcctcctcattgttgctattatacccggttgcatcaaaaaagagcgaacaattctgctcgctcttttgcttaattttcctttggtgcaaccatcgacagaccgatacgttcacgttttacatccacgtcaacgacccaaactgtcacaatatcaccaacggccacaatctcatgaggattcttgaccattcgcttggccatccgtgaaatgtggaccagaccatcttcgtggacacctaagtcgacaaaggcaccgaagtcaaccacgttacgaacggttccttgcaactgcatccccggcttcaaatccttcaatgacaacacatccgaacgcaagaccgctcctggtgcatcgtcacgtaagtcacgtcctggattacctagcgaggcaatcacgtcttgcaaggttggtaacccaaccccaagtcgatccgccgtagcttggttattaaagcgacgcaacgcttgaccagcttcagctcccggcgttgtcacacccgcctctttcaacaaggcttccgcaattttgtatgactcagggtgaatatccgtgttatccaacgcattcttagcatctggtaaacgcaagaacccagcagcctgttcaaatgccttaggaccaagctttggcaccttctttaattgcgctcgtgatgtaaattgaccattttcgtcacgatacgtcacaatattagccgccgtggttttcgtcaaaccagcgatatgggtcaacaattgtggcgaagccgtattcaagttaacgccaacctggttaaccgccgtttccaggaccgcatccaattcagcatcgagctctttggttggcaaatcgtgttgatattgccccacaccaaccgcctgcggatcaattttaatgagttctgccatggggtcttgcaaacgacgggcaattgaaattgctgaacgttgctcaacctgcaggtctggaaactcttctcgcgccacatcgctggctgaataaatagacgccccagactcattaactactacgtattgcaaatcaggtaagtctgacttgataatgtccgcaataaacgtttgtgactcacgcgatgccgtcccgttaccaatcgctaccagtgaaacaccgtactgcttaactagcttgataatcgtctctttggcacccttcggatcatacttggcagcacggtgcggatagataaccgccttttctaggaacttaccgttctcatcgaccacagccaactttgaaccagttcgaatccctgggtcgaatcctagtacaacccgaccacgcaacggtgctgccataagtaggtgatacaaattcgtaccaaagaccttgattgcatccccagccgcccgttcgaaaagttctttgcgcaattcgcgttcgatagcgggaccaataaagcgcttataggcgtcattggccgccgcgaccaaaacatcagctgcctcacccgtttttgaaccaaccaaacggaatttcaaataacgggcaatcgcttcagcgtccgcttcgatgctacctgacaaaacgccttcattctcaccacggttgatggccaagatttggtggtttgccactttgctgattggcatgctgaactcatagtacaacttaaagacttcctgggtatccttatcacccgcaccacgcttcagcttcgagactaggtgaccattatcacgcgtgtacttacgtgtccaatcacgtaaccccgcattttcaccaatcacttccgcaaaaatttcatgcacgccggccataactgccgcgatatcaggcaagtctttctctgggttcacaaattttgccgcctcagcttgcaaaccggttgttggaaacttttgcaccaattgtgccaatggcatcaatcctgcttccttggcaatcgttgccttggtacggcgcttttgcttataaggcagataaatatcttcaactgcttgcattgtttcagccgctgccaacgctttcagcaaattaggcgtcatcgccttttgctcagcaattgccttttgaacggtttgcttacgtgcttgcaaatcttctaagcgcttcgtcactgcctggatatcacggatttgaacttcatccaaattgcccgtgacttccttacggtaacgcgccacgaatggcaccgtattcccatcggccaataattctgacgtcgccgtcactttcgttagtggcaacgctaattcttttgctactgcactcgcaatatcaattgtcagtgcgtcgttttccaccgtcgtcattacatcgccgtcgtcaaaatacgacgtacttgtaccaagaacttctccatcaatgagtcttgatcagcctctgattgcttgaacttgtccatatcgattgattggtcagcaacgttcaatgattcagccattgcttccgtcgcagcagcgtattccgtaaacgtcttcttcatcgattggtgcaagcccatcaaacgaacgggtgcagccatggcgttaatcttagctgatgcatccttgtacactgccactgcctcatcaaattcaactgaaatttcttggaaatcagcctttggcatgtccgcaacttggtcagccttaatggcatcatcaagcttctcgaagaatggtgcaaccttgttaccagcatcttcagttgattggataacttgacccaagttagttgcatattgttgtggtgacacgaacttcatcttagccatgaataaatctcctcttgccatttaggcggttaactttttaaacaatgcttttattataccagttcgccaccacaaaataagcccacctcatacatcggtgggcaaacaattatgattcagttaccgccaactgcaacgcctggtcaagatccgcaatcaaatcagccacgtcctcaatcccaactgataaacggagcgtttcaggccgggtccctgatgccaacagttctgccggactgagttgcgcatgtgaggttgaggccggatgcaaaattgatgatttcccttcaccagacgaagcgaaatgcgtaaagacttggacgctatccaagacttttcgaccggctgacgccccaccaacaaccccaaaggtgaagattgatcctggcccctttggtaagtatgtttgcgccaactcatagtatgggctgtcagataatcccgcataatttacccacgccacagccggatgttgggctaagaattcagcaattttctgggcattgtcaacgtggcgttgcacacgcaatgataatgtctctgatcccagcaaaattaaccaggcattaaatggggatagggtagccccagaatcccgcaacaaattataacgaatccgattgacgtacgcagcgtcgccaaacttttcggtatacactaacccgtgatagctttcgtccggttctgtcaggcctgggaatttgtcattttgcgtccagtcaaaatgaccgctatccaccacgataccacccaacgcagccccatgacccgataggaattttgtggcagagtaaacgacaatatcagcgccaaaatcaaacacccgattaaggtacgccgttgcaaatgtattatctacaatcaacggaatgccagccacatgcgcaacttcagctaaggcgcttaaatctgcgatgtttgaatttggattaccaattaactcaatgtaaagcgcctttgtattaggctgaattgccgccttgactgctgccaaatcatcgatatccacaaatgtcgtggtcacgccgcgccgagggtacgccgtcgccaacaagttgtgggtcccaccatatagcgtattcgcagcaaccaaatgatcacccgcaaccgtgatattttccagtgcataattaatcgcagccatccccgatgcaacggcaacggccccaacgccaccttcaagctcagccaaccgcttttcaagcacttcagtcgtcggatttgtgaaacgggtgtatagctggcctggcttatccaaagcaaattgttctgcagcgtcttctgcactgtcataaacatacgaggtggtttgataaattggcacgctggttgcgtgggcctcagcgtcgggcgtgtaaccaccgtgaagtgcgattgtatcgaagtttcgtgctgtcatttgtctattcctttctatgcaaaaaagcccgttcctacccagttacttactggaatagaaacgagcttgtcgtgttaccattctatctttattgccccagttacccgggtcaaccttacaacgtgcggtcagatcgcgacatgatgcgatgacgatacgcgtgtccgttaacggagaccaacccgtaaatcgctcatgaacttgccacttacgatttccaatcacaggccattttctttgtcgtctccccaactgtttcacaccaaccaacagctctctgtttggcgaacgacaaatactttcctgatcactttgtttctcattgttttctaacagtattgattgtaaactctcacttactttatgtcaacgtctgtatcaaacaaaaaccgctgattgatgccctatcatcaatcagcggttttatttttaatgtgctgtgccccataaccacaccactttattataggttttatgcgtaacgcctaatctcttagtaattatgcttcagtgtccaacaaggcatacttgccatcgcgacgcttgtatacgacagccgccgtatcagtttcagcatcttggaaaatgaagaactcgtggcccaacaattccatttgcaaaactgcttcttcagcatccattggcttcaaagcaacatgctttgtacgtacaatgtccaaggcttcagactcttctgcctcaagttcttccggtgcagcttcaaagtccaattcttcaatgcccttgtagcccttctcacgtgacttgcggttgaccttagtcttgtacttacgaatttgacgctccaacttttcagaaacgaaatcaactgtttgatacatgtcggcttgcgtatcttcagcacgcaacaacaagtatggcaattgaatcgtaacttcagtcttgaacgtaccttccttgtatgaacgaacgttaacgtgggcaacatactttgcgtcatcgttcaagtaacgctccaagcgtgacaaacgcttctcgatgtagtcggtcattgcatcagtgacctcaatgttctcaccacgtaccttaaattctagcataatcctgtctcctgtctgactagatttgcgtgatgctatgtccccataacacgtgatcacgcagttcccaaagtatctgtctagatgtcctttcggtaactatattgtaacaccaatatgacaataaaagaaagcgttttcatactctcttcatgaacatatcatcttgctaacgtgactgtgcatatttgggtcgcaccactttcatacaaacacgacgatgcgtgtcgcaacgtgcgtcctgtcgtataaacatcatcaactatacaaattctttgtccagttaaatcaagattttctgtgacgagacagaacggctgcgttgtctgtaaacgctcccgccgtgttttcatagattgtaccgccttactggttgagatacaagttaaaatttcatttatttcacatttttctaaccatgcgctcacttgattgaacccacgttggttttgtgtctccgttgttattgggattggcacaatcatagtcggtgcaactttaaccaacctttgggcgagcatctcttgaaacacatcccttaaatgatagccaccttgaaacttatactgcttaaagtactgttgcatctgctcgtcataagcaaataaagcttgattatggatggccgggtatcctgctgtcagccaaatttcacactcagcacagggcgatatttggctttgacacccacattcagcacacactggccccgtaatccgggtgaactgttgccgacacgcttcgcaaattgacaacatctgtggttgatgaaagatgaaaaaatcacccaaggtccattctccctgctgtatccgcccgcacaattcacacgtcatactgtttccctttcatgtttaaataccgaatctcgttccgggcttggatgaccgtacgcgttcgttctgtaacccctgtccaaactttaccggttggccgagaagcgctacgtccacaacgtccggcaatttgaattaaggcagcttgactaaaaacaggatcgtcagcgcccagaatcatcacatcaatgcctttaaacgtcaccccacgctccaagatggttgtcgtaatcaatgcttgcaactcacttgcccgcatcgcctgtaccttcgcttgccgatcaggatcgccagcgtgtgtggctgcaattttaagtgatggttgcaaccgtgctatctcgttcagtgtcgccgttaaatcagcaacatggggcacaaaaattaaaaagcgttgttttgatataacgtactcacggagaatgcgctgaatacgccacgataattttttgcgccaattgccaattttaataatcgtaaaattcggcaacggttgcccgtgataacggcgaggcaacaaactaatccgtaatcgttgtttgctaacgtcacgtaagagtcgcgcacttggggttgccgtgagataaaaatgacacccttgtggtttagtcgctcgctgaacagcaccttctaattggacattctcagcgtaagggaacgcatctacttcatccacaacaatcacatcaaaggctgcccggaaacgcagcaactggtgcgtagaggctaataccaactgtgtgtaacgatacgtctctggtgagtcgccataaagtaccacgaaatccgttttaaacgcctcacgtaaacgtggcgctaactccacaatcacatccactcgcggtgatactaaggcaatgcgctttcctgcctgtaacgccgccgtcaacatgggaaacagcatttcggtctttcccgctccagttactgcataggttaagtgtgaacgccctgctttgagtgcctgaagctgttcatctgccactcggcgttgagccggcgttaactcaccttgccactgacagggcattgtatccgtttcaaagacatttggctctggtatcgttgccaaaaattggtcctctgacaaccgacctaaatttgcacaagcccaacagtaggcacttgttggggtgcgccaggttgtattgatttttgtgacacaccgttggcatatcccatctttaatggccggtatcgtcatggatccctcgggtaatgctggtatttggtcgtgtcgcacaggtaccaagcgaccatagaaatccgattcatccatgcttgtattagcacctccactaactatagacgactaacacatgaaaaattccaaaaaaaatgccgactcactggccggcaattatttcatttacttatttacttttcttaacatcaccgtcagcgctcttaacaacgttcatatcagaaactggaatgtaaccaagtttcttaatagtcttcttcattgctgaagattgcacgaacttaatgtaggccttggtattcttgtcagtcttctttaccgtatacatatgctcgtatgcccaaatttgccacttatttgatcggacatttttgtcagttggggaaactttatcaattgatagcgttcgtaagcccttggcatttggcccactcgtatatgagaaggccaggtatgagatagcgcctggtgttttgctgacaatcttttgcactgccccattatcgtcttgttcttgggcagtctttgtatcctcgccgttcatgacttcgtgttcgaatgtgaaccgggtacctgaaccttgcgcacgattaattaggacaatcttttcatcttgaccgccaacgtccttccagttcgtaatcttacctgagaagatatcacgtaactgatccatcgttaacgacttaactttaatatcatcattcacaactggtgcgataccgacaaccgccaccttatggtccttcaacttctttgcatcaacaccatctttttggctagcaaaaatatcggaattaccaattgtgacaccgcctttaccaacttggcttagaccggcacctgatccaccaccttgcacaacgacatttacaccggcatgtttctctccaaacatttcggcagcctgcgcagctagcggttgtagggctgttgacccaaccgccatgacgcgactatcagaggctgcatgtacaacgcctccactcaccaatcccccggctaatactaatgcaacagaactccccacagcaagatacaacttacccttcatgacaatctcctaacgtatgactagatattattcgagttaggtcgcaggtttgaagcttggtagtagtagcagttagagacgttctcccctacgacacttattagtatagaggtaatttgtagcgactttgccggggttctgtctagattagatgttagttttgtaaggacatgctttacaaaaacaaaaggggcacaaatctgccaatattaatttagcagatttgtgccagaacgatttatttaattagaaagacaatgactaacataattagaatttctacaatacctttgatgaccaatcccctgtatgccttataatactgttcagcctcaacgaggatagtctcgtactcagtttgtgtatctcgcgtcatcccattgtctatctcgaacacataatcttggttttgatagttatccggatttttattacgccaccgactcattgcccaatacataaataccgtaattaagaagcgaaagattgctaaggccactaaagcaatcgctaaatagccaatgtactttaaggccgtttctgataatggcgcaaataaatcgattacatgcgttatcacagccaaaacgattggaatctcaacagcacgttgatcatcactaatctggttatgaccttgtttgacatgatatgagactttcatcgcgtcgttcgctcctttcgtttttattaggtatcattggtgtctgtactttaacacatgacctggctattttagcacgagattaagttgcctgggtacgtcaaatgccatcatcgatgtttaatgatttcaattgtcaacaaccaatttcatttctgtttcacatcgttttcgcagatatttcatatctccgttgacgacttgatatatactacacgcttcttttgtaatcgtcaacactttctttaaaacaaattttgcaaacaaaaaacggtgacaatcgccaccgttttaaccagctatttttacaatgtctaataataggaggacttgtctgataataactggtgtgaccaaccatgttctctccggctctcctatatacgtactctatcacgactagtaggcccctgcaaatgacgcactactgaccataatgtaaatcacgtgcgacagtccgctgaacctcggcaatcgtttcactatgaaagtcgcgatgatccaacaccatccgcttagtcatttcacgtggcgcttggtagaacatccacggccactcagattgcatctcaaacgacgcttgccccacttggaaccgatcgcgaattgccgtggcatttcgccattcatcaactaaagcaaaaacaaatggaccaaactcaccttggctaccatcaagataggtctcccagtcaccaacaaccaaagtctctggatcatggtcaacggcatttcgaatcaaaacctggtcatccccagtcgtcaccgcataataagtccggtcatcctcatctgttaatcgtggtaacgattcataattcagtcccaaccgtttcgctaacttttgcgacaacgccacgcgaacgtgttgcgcaggcacgtcactatcttgcgcaacaatatgtaattcagctaactcgtccgcaattgtaactgtcgtaaattcgtaatacatcaatgtcctcactttctgatttagttcgccagtgatgtaaaaatacgtccaatcatcttaaccatcgtaccaaatacatctttacctaatagttgaaaccgagtccccattggtaattgtcggtttgtcttaaagaaacggaacaagccgccaattaaaccaattactaaaccagctaacgctaacacaataaaaatcaacacaattacttgcaaaatcatcatcatttttctatcactccctttaagtctctccattataccaacagattaaggcataaaaaataggcaactcgattaacaatcaaactgcctcatcattcttattccacttttgcggcgtaatagcctaacagtagcgctacgaacacaatcaacgccattcgtcgattatcatggtacaaaaacatatcaactaacgcatagacaaacagtgcgaccgcaatgacggtcatacccaactttaacgtactctttttcatctcgtctcgtttacccttcctcagcatagcgaattgttgcatcacggaggtagctcgcaaattgttgatgacccacctcatactcaaacgcatctttaaaatccgcaatataactttggcgaatcgttgggtgaccccaagttgggcgccagtctaaccggtagataccatccgttagtagcacgtcgtaacctggaaacgccatccgcaacaccgacaacgttttatccgtcattggaaactgcttcacaagaagcggatgcgcattggtggcagggtcaaccgcttcagtcatcgcaaccgcactatcagaagagccaattaacaccagtcggcgcgacgcatcggtcataaacgtaccgtccgttaacgaaataccgtcaaacacagccgcctttaacaattccggtccccaaaattcaatcacctgttgttcatcctgcataccaagtgtgcctcctaacgcaaaaaacctgaccatcgttgatcaggttttcattatagcgtgaatttaaactaatgtcttggccaagtagaagctacctaaaataccagcgtcatccccattacccgctcgaaccaagtagtcatctaagttcggcaccgccaaataatctgacagttgtgccgcaaacgacttgcggacaagcgacatcaagacatcgcgatgtggcacaccgccgccaaaaatgattttttctggtcgcaaaatcgtagtatacgtcacggccgcctgagccaagtaaaacgcctcaagctgccacgctgtgcggtcatcatctaacaaattagcgggttgaccccatcgttcagccattgccggtccagacgcgacaccttctaaacagtgatcgccgtggaatgggcaatgtcctttatacgtgtccattgggtgcttattcaccataatgtggcccgcttccggatgcgaaataccttgcagtaattgaccattggccacaatgccggcgccaatacccgtaccaaccgtcaaatacagaatgttattgttttcctgaccagcgcctgatacgaattcgccccacgctgacccgttcacatccgttgtccaatagtatggtatatcgcgccattcggtcatggcgcccaaaaagttgtaccctgaccaaccacgcttgggcgttgccagcacataaccatatgtgcgactggctggattaacatcgattggtccaaacattgaaataccaatcgcaacaatatcctgatattgatcgaaaaacgcttgaatctgactcatcgtctcagctgcgtacgccgtcggaaaactttcccgtgcaacgaccgtctctggatgtgccgcatcggctacagccaccacaaatttggtaccgccaccttcaattgcccctaatagtgccatgattatcccccaaattgatatcatttttacctgttaagcatagcacaaatctccccttaatgtaagcgctttctttgcgtggtgaaaagaaaggctgtctcggtagcattgccaccaaaacagccaaatcaatcacccttattttgtctgggccatgacttccgcccacgtgatgccttgaccatacaagtcatcgtaatcaattgtcttggcatcagccaaatcaacccaacgtgcttggtgatttaactcgttaacaatacccaaaaacttatgcccatcaatggtaacgatgcccttagtattaaggtcaacaccttctggcacagcattgtccgcctgatacacacgccggtaacttggtcgcacgtgcgtcaccgagacgtccttcgttgtgccatcgtcataccaatcgttggggtcataaccactttgtgctgttacaactgcctttttctgcttgaaatttgcgtgcgaccggcgccgtaacacttcaaacaaagcaaacgccactgcggccacaacaattaaaatgaactcaatcatgataagccttctatatcttaatataaatctacacagaaattgtaggctcattttctcagagattcaagctattaggctagataatctgcaactgcgtgcattgacgtttcccataacgcttggccatcttgcccgtcgacatcttggttcttcaccttcagcaggtggttaccgttataaacagcgccatcggtaaagtcaactcccggtgtacccaaagctaacttaaccaggcgttgcgcgctcttagctgggctaattgttcccaaatatttcagtggtgtctgatagagccaacgcatcacagtattcgattcactcgaaaaactcgtccggacgactcccggatgaaacgcaaccgcatgtagttgtcctggataacgacgcactaattcgcgggtgaataagatattttcgtacttcgcatacccgtacgctttttccgacgtatagctttggaccacgttgagatcattcacatcaaatggtgccccaaacagattagcagcgatacttgacgttgcgatgactgtcgcgtgatccgccaccaatttatcgagcaacagttgggtcaataaaaaggcccctaagtgattaacctgaaacgtcttctcgaaaccatcggccgttaatgtccgctcgcccatgataccgccggcattattcgccagcacatcaatatgatcatactgacgtagctcgtttgccagacgttgcacatcggcaagtttcgtaaagtccgccaagtggtatggtatcttaagcgcattcgcgacagctgccgtctttgttggattgcgtccgacaatgatgactcggtgccctaaaccaactaatacttttgccgcagcagcaccaataccatcactaccaccagtaattacaattgttttcatgagtatcccctatcgttttgaacgctttgcctcgtcaatagcctcttcaattgccgtaaccataacggcctttttcatattaatctgttttgacgaccgcacctgcttaatcttaatttgcttggtcaagtgccaacgctccgttgttgctgtatacagacgcttgccagtgttatccgtaatccgataactagttgcgaataaatggaatggattccgccgcgattggccaacgacatcccctgatttatccaaaaactgatactgatggaagaacaaggcccacaccttttcgcgaagtgcgccatcatacgtaccgtcggccgtcgcaaaaacaccgccgcgtgcgattgacaacgctaatagtcgccgagactggtgttcacggtaagccacgtcaccagctggtgtctcaagcgccaacgtatcaccaaacgggtgccaaaaatcgcccgtcaacgtgccaactgatttaccagctacccggacatcgtacgacgtcgataaccggaagaatttttgcaccagcgtcacttcctgggcttgttccaacgttgtgtctaattgtttaatccgttcggttgcctgatcagccgcctgaacgttgccagtcgtgaacagtatcaccgctgtcacagctgccaaacttaatcctagtcttttcaattgcatccctcacaatctgatttgcctaccagtataagcatttgcaaatgaaaacaccataacaaatgctatggtgttaccggttatttaatcttgctgatctgttgcgtcatcaatcaactcagtcattggtaacaatttcaaacctggatcggaaacttgcagactagccttgaaggcttcaacttgctctgctacttgttgcagaacgctatcatattcgccttgtaagcctgacactttaaattgtttacgggccatcaattgttgctgaatcgtttcggcagccatgccgataccagcaacggcggcatcaaccgccaaacctttcgcaacgcccgaaccccgtttcgtcgtccccgtactgttagttttcttccgtaacttggctgcttgtgaaatcgccatttgccctgcttgcaacacaactgctcgtttcgtcgcgttactaattgacttcccagccggattagctgccaacttcacgtagttggttggcgtcaccactgataactgaacgtcatgcaccaattccgcatcaaattcaaactgttgcgtcgcttcatcggtcataaacgccacgaccatattacgcatggcttcattaacatctgccaccaattgtgtttcaaaccggtgcgccacaatgttgaattcactcgtcgaaattgtgtttgctttatacaattctgctagctgtgcaatcgcggcccgccgactttgcttcatcgctttgaacggcaaggccaatttacgattaatcgtcatgtttaaccgtgtatccgtcgcccgttgttttacatcatcacccaaacgctgagcgcctcgttttactgcctgcagattttctgtcaactttgccatgttcaattcccccaaattgctttacgttcattataccggaaatttggtggcgaccatacattcttcacccaaacttgttacaatgaagtcactacgaaacgaggtaccgttatgattatcaaagcaacgttagctgaccctacattacctgaaatttcacgattaattcggattcccgaattccgccaaatggcccaactacacaaagcgctacagctagcgtttgggttaactgattcgcatctgtataagttcgacggtggcatttactacatcaccaacgacaaacttggcattgccgacgacaaacttaagcaaaagcaacaactgaagcactgggatgagctgtctcaatttgaacaacaacctgatttccgccacaaaacgttaaagatgcccgccgttttattgatggacttcttttctaatttaacccacgcaacgtatgtctacgattttggggatgactggcggtttgacttagaggttgtcgacatggaggatccctatgaagaaaatccagcgattaaggtgctggatgtccagggacccgacctgttagaagacgggcacatcgagttcccagccttggtgatggctgcttatgaggaacccgaaacgattcttgacgggagtgcccagctggctttcacaaccccggaaaccgctaattacaagctctttctcgcaaaactttatgattatagttactaatgacacccaaccgcgccgtttatcaatggcgcggtttttattatgacggtcttctttcgccaatgtcgtcaccatttagtccccctccgaaactgttaaccctgttgcaattcctctataaacgacaaatgaggcaccggcgcaccggtacctcacaagatagttttattgtagcatgaaaaattttgttcagcaattaattttcggccatttgccaaaatgtcagttcatgctgatacgaagtcgcgtaaatgcccgcatagtcaattgtggctgattggctttgctgtaagagttgcgccacggttgcccagctccaagtaaccgcactttgataagcatcccccacataatacgccacccagtctgtgtatccgctgggggctacacccgcttgggctaatttttgcgcaatcagaccgtacgattccgtacagggtaataacgctaacatactagctaacggatcacctagctgcaccgtctgatcaagatgcgccaaatacgccaaattatggggtgccggatcaatctgatgataataatcactaggctgcaaccccaaatgagcatctgcctcatcggctgtcacagcagatcgacgccgtaatgtcggtggcaattgttgcatcgtttgcgcaagtaacgcctcaaagtgcccgacataatgggcatcttgggcaacatagtaatcccggctcgcctggcttaagtcacccgtgcgaatgccttgcacgaacggggtcgccataatctccgtcaaccatttcgtttgaatttgttcgagctctgtttgcttcattatgccatcccccataagctggtcatctcctgcactaccgttgtggcatcaggcgcctgacttagcaaactgaccaccgcgacaccatctagacccgtccgagccagcgctggtaacgttgctagactgataccaccaatcccgaccgttggtaaatggtgttcattatgggctaacacggtcgttaagccggccaagcccaacggctcggcagcatctgctttcgtcgtcgtggcaaaaattggcccgacccccagataatccagtccggccactgcttgtgcggcctgcatttcggccacattacgcaccgacagaccgacaatcatctcggggggcgtctccgcaatcatcgtccgaatatcacggtcatcttggccaacgtgaataccatccgccccaattgccagcgcaagatcaacatcatcatcaataaaaaatcggacattggcggccttggcggcagcttgtaatcgacgcgctaacgccaaacgggtggccgaatctgtcagcccagcccctttttcccggaactgataggcagtaatccccgtttgcattatcgcgacaattttggcttcatattccgataaggtcaatgttggaaagtcctgtgagccagctacaaaatagcgttgtaagtcatctttgttcatcccgtcacccaatgattcaatggtccgtgtccatgaccgacagcaatcgtttctgaaattgctacggtcataaaccgcttggcatctggcatcaacgctgctagtgtttcacctttagccaaatgcgcagtgatatacgccgacaacgtgtcaccggtgccgtgagtgcggttagttgccacccgtggcgcacgaagccagaaccccgtcccgtcagctaacgcaacatagtccgccacttcatccgagcgactgtcagccaaatgaccaccctttaggacgacattcgctggtccgagcgcccgtaaatcatgcgcagctgccaccatcgcggtttccgacgtaattggccggtcaagtaatacactcgcttccgctaaattaggtgtcatcactgtcgccagtggcagtaattcggcaaccagcactgccactgcgtcatccgtcagtaatggcgcgccacctttagcgaccatgactggatcaacgaccacaagtggaatttgggcttgtgccaaattatccgccaccgtttggacccgttccgcatcaaacaaagcacctgttttcaccgcttgaatcgataaatctgctaacacactatcaaactgggcagtcacaaaatcagctggggtgggcaaaacagcttgtacgcccaacgtattttgcgcggttaaacccgtgataatcgacgctgcgtacacgccttggttatgaaaggtttttaaatcggcatttgcaccagcgccaccactggcatcaatgcccgcaactgtcatgacttgtggcacatcaatcatgcgattacctccgcttgggccaattggtacagtgcatcaaatagggtcgcaacaaatgtgccgggttgatttggcccctgcgcagttgcttgctcaccagcctggcccagcacttgcgcagcagtctcaccagctagcagataatcatcggtcacggcggcaaacgcgccaactatgccacttaacatatcgccggcaccgacattcaccgccagcaacggtgaattggttgtcacttggcgagttgactgaccatcggtaatcacatcaataacgcctgtttgcacaatcgtggcgcccgtttgttgggctgcggccacagcatttgccacatgggcgtcagtatcatgggcatcaattccttggcccgccacagtcactccagcaaaccaaccaatttcggccgcattgcctcgaatgacatcgactttaatcatctctagtaaacgcgtcacaaactgtgcgcggtacggcatccccaccgccaccggatccaacacgacaggtttgtgttgccggttggctgcttgcccaactgcaacgaatagtggccagcgggcttccgataaggtaccggtattcaacacgacagcatcggcgatggccaccagttcttcggcttcggccacctcatcggtcattaagggggatgcccccaatacattaattgcatcggcaacccgttgcatggttaccaagttcgccacatttaataccagtggctgttgttcacggatattggtcaataacgttgtcatcattcctcctagaaactaaaaaaatcgaccaacccgcgtaacaaaaaacggatcgatcgattggaaagacattctagtcggtctaccatcttccctacgcaagtcttaactcaacaggttcaaagggtccggtttcccgtctcagccaaatggctcccctagtggtgaatattcaattcttctttagtctagcagaagttgcgcaaaaaacaaccaacgctttgctgttgtatcaactgattttttgctagactgagcataaggaggcggtatcatgacattattattggggattatcatgatcggactcggattattagaaatcgtgctgtcaaaacgatcagtcaaaacctacgaaaaggtagcccgcccgactgactcaccatttaaactattggggtttggttacggtttttacattggcatcgtcattgcacttttgtcactcggtccaatcatcaccgggattatgcaactcatttaacaattaacaggctgacctagcgtcagtcttttttacataaaaacccgtcagccaccacagccaacgggtatcccgacgtatcacggcgcacactaatcccaaattagtgtgacgcagccattccattgtttgcatcgtgcttatgcgatgccacctttgctgacaccacgtcagcaacatcttcatcattctcttcaatcttaaagattgtcttgtaaccagcaaatgaaaccgctgcgacaatcaagctaaacaaactaaatagaaatgtcatcatgatacgaacccccttaatatcgatgcgttcctttttcccttgtcattataataaccccctagcccctgtattagcggaaatggttgcaaattggcctagtttgcgacagttttaacaatcaccggccattcttaccaaaaacaagccaaattcagctcaattccgggacattccttactttttagcacaaaaagaagcgacctaacacaacctttgtgtcagctcgcttcataatgtgccggattttccggatttacttcaaattccaagcggcatactgtgaattgccaaacaactttttaatttcagccttagtttcggcagtttggtataccttcacaatttgcttatacaccttcttattagcttccgtcttacgggctgcaattaagttaatgtacggatcaacatttttcttcaaattttgcgttaacaaaatatccttgtccgctaacttggcatcgtgggcaaagttaccgttaatcaccgctgcatccgtagtcttcaaggctgagacagcttgaccagcgtcaacttccttgatgttcaacttcttgggattccaggtaatatccttcgccgttggatcgctcaccttggtgttgtacttgatcaacttggcttgcaccaggacattcaaggcacgttgctcgttcgtcgcatcgtttggcaccgcgattgtggccccggacttgatgtcactcagcttatcggctttcaacgagtacaaccgcattggcacaatcaccgtcttaccaatcgacgtcaacttgctacccattttcttatcctgatcatcgaagaaaatcttagtttgaaaggcattcaaatccaaactcccatcgaccaacgcctgatttggcttcacatagtcattgaattccttcaacttaatcgtgatgccatattctttcttggcacgttgcccgatgttctcccacaactcgcgggccgtatcaccaaccacacccaccgtgaccgtcttattatcggctgccaacacaccttgttcttgggcgacgacgccaaccccggccgtgaccaacgcactagccactaacaaacccaacttcactttatgcataaaatatcccctgttaactatttacttcaacgtaatatcccaagctggtagctcggcttgaccccattcagacttcaagtaagccttggtagccttggtttggtaagccttcaccacctccttgtaaatcttcttatttgcgtgcttctttgatgccgcaatcacattaatccattcagccgacttcttgttaaccggctcaacataaatggccgagctcaacttaatcttggcttgttgcgcgtagttggtattaataactgcaccagcctcagacttcaacgccgttggtgtttgggcagcatcgacttccttaatctgtaagttcaacttgttcgtcgcaatgtccttcaccgttggcaacgccacatccttcaaggtgatcaacccggctgattgcaacagaatcaatgcacgagcttcattcgtggcgtcatttggcaccgcaatactgtcacccttttggaaatccttaggtgacttgtgcttctcagaatacaagcgaatcggcgtaataatcgtcttaccaattgcctttacagaattaccgttagagtggttccagttatcaaggaagtagtagtgttggaacgcgttcaggtccaatgaaccatctgccaccgccttgtttggttggttataatccgagaataccttcgtctttagcgtaatgccgtattccttcttagccgtcttggcgaccgtcttccacaaaccagcatcttgggtacccacaattccgacggtgacagtctttgaatctgcactggccgtcacggctggcaaggccactgatccggccaaaacagttgctgcaattgctaccccaaacttcaatccatttgtcgtcataataattttctcctatctcctaataaccaatcaatctgctaattcagcgtaaacatcatcaaaacgttgcttaatgtaggccgctgactcggttaacttttgttgttcactggccgttaattgcagtggagccttatgtaataccccagcacgtcccacgaccacggggtaagacaagtacgtttccaaatccgtttgataggttgaaaccggcaagacttcatgtgagtctgagagcaccgcttcaaccaaatggatcgtggcacttgcaatgccgtaactggtaaattccttacccgcataaacggtgtacccaccacggcgggcttcatcttccaaggcatccaaatccaaatcggcttcatcaccgactaattcaccatggacgcggaccgttgaccaagccgtgaactgcgaattaccgtgttcacccaagttataaccgctcaccgccttgggattcacgcccaacgcaacgccaactgcccgttgcatccgcgccgtatctagtaacgtcccgctaccgataacccgattagctggaaaaccagtaaagcgttggtacaaggccgtgatgacatcgactgggttcgtcaccaccactaagacgccatggaacccagatgccacaatcttatcggcaaccccacgcacctgttgcttggtgaattgcagttcaacaaagcgatcaccagtcgcttgtccagtcttttgcaatgaaatttgacctagcgttgaaatgacaatatccgcatcattcaacgcttgccagtcattcaccacaatatgaacgtcatacttcaaattcgctgccgcatcttgaaagtccaaggcctctgcttccgctttagcgctgttggtatcgatgaaaattaattcatctgcgccattcgtggttaccaacccgtgcgcaatggcggccccaacgtgtcctaacccaataattgcaatcttacgtgccatatgaatatccccctaaaaataacctagtttaatctgtaataaatgcggcaatccgcgcgacagccgtttgcaaatcagctaacgaagccgcataactcaaccgaatgtagccggccccaccaatcccaaaggcggatcccggaataaccgcgaccttgccttcttgagcgagcgccaaactgaaagccacgtcatcttgttccaactcatctggaatctgcgcaaagacataaaaggcgccggctggttgcggaatcgcaaaaccaagttcgcgtaacgcctttaccaagtaatcgcgccgggctacatattcagccttcatcgccaacgtatcttggcgccccgcttcagtacccagtgcttccgccgccccggccatcgctggattcgaggctgacgtcaccgcaaattggtgaatcaagccgaccgcacgaattaattttgttgggcccaccacaaacccaatgcggtaacccgtcatcgcgtgtgacttcgataccccgttcaagaccaacgtttggtcgggcaagtactgggcaatcgaggtgtgttgtccgtcataaactaactctgaataaatttcatctgcaatcactgtgatgtccgtcccgcgtaagacatccgccaacgccgacaattgttccgacgtgtaggtggccccagtcggatttgatggatagttcagcacaaccgccactagttgatcgccataggtatcaatcgcgccctgtaattggtccggcgtgagcaagaagtccgtcgccgatgtatccacataggttggtacgccaccagctaagaccaccgttgggtcatacaacgggaagttcggcgccggaatcaagacgcggtcgccaggattaacaacggcggtaatcgtgtcgtaaattccttccgtggcccccaacgtcacaatgacttgtgagtcagcatcatattgcaagttgtaccggtcagctaagaaatgcaccgccgcttcccgcaacgcttgcgtcccagcggccggtgcatagtgtgaatcatctgctaaaatgctgtcgattgctgcctgtttaatgtgggtcggtacattgaaatctggttcaccaagcgtcaatttcaaaatatcagccacatcacttatctgtgcatcaaatgctcgaatcgcattgggttgaatctgtgttaaacgttcatttaaactcatcgtctacctccctaaaacttacgaccaggatttaaaataccggtcggatcaaaaacggctttaatttgttgttgtagtgtttgcaccgcgggtgacaattgttgtggcacccacttctttttaatcgtgccaatcccgtgttccgcactgaccgtgccaccgatgctaatcacaaagggcaatagctcatcaatgtaggcctgcgtttccgcgggtaaagccccatctttactttctaaaatgatatccggatgcaggttaccgtcgccagcgtggccgagcaacaataaccgttgaccatgcttagcggcaatcgcttccgcacgatcggcgacagttgctaactgccctaatggcacggcaatgtcttccacaatcaaacggccatattgcgcaccggctgcaaagatgtcttggcgaattttgataatagttgcggtacggtctgggtccgacgtgacgtcaattgtctgagcgccggccttacggagcaggtcatcaaccaaatccaacgccccggctacagcgacatcaagttggaaaataagcaaggcttgttcgccacgcccgcccaaatcaatgccttcatactcatcaagcgcttcaattgacacccgattgagaacttctagcattgatggattaacgccactggcttgcagcacttgcacagcatgcgttaatgcatgcacatccgcaaaggtcgctaagcccgtcacagtatcgccaaacggaattggtcggagacgtacagtggcttcaacgaccaccccaagcgtaccttccgaaccaatgaacaagtcggttaagtcataactggcattgttcttaaatgtggctccgccgagttctaataaacgaccgtcggcgaggacaaccttaaggcccaagacattttcacgagttgtgccatacttcaacgacgccatcccacctgcgtttgtcgcgatattgccgccgatggtactaattggcttcgaacctgggtctggcgcgtaaaagtaaccgactttacgagcagcttgatctaggtcgccgttcaacacgccagcctcaactaccgccgtttgattttctggttgcaacgccacaatgtggttgagacgggatagattcagaagaatactgccatccaaaccggctgccccattcgcaattgacgtgcgggcaccttgagtcacaaccgggatatgatgcgtcgtcgcaaattgcaacgtggcttggacgtccgccaccgaagcagcaaacaccaccgcgattggttgcccctcagctgctgtttcttgggtatagggattcagccggtattctgcaagcacaggcggctcggtgatcacctcaccatctggtaatgctaatgttgttaaatctgtgctcatactttcctccaaataaaaaacgtcccgtcgcagcacaattgtctgcaacgggacgactcatcatcgtgttaccacccgaattctgcccaaaatcacctttggacacttatcaagtacgcgctaaaaagcggtgatactctagcgcgataacgggcgcacccggaaacgacattcatcatcatcgtttcaacccactccaaggccatattcaccaactaagttgattgcttcacaccttacgcaactctctgaacaacttaggcttggttactcacctcttcttcgttgcacttattgtagtcacgttaaaatgaaaagtcaataagtttattagaattattctcatttaatttccgaacactaccccggctacccttttcaggccactgataccgggctttatgctaatatatgtcagttcctatttggcagccaccgcgctgcaacacgtgcaatccctggtccacgttaatcccggcaggaggacagacaatggcaagtgcttttaacagtgccgatatcgcggcgaagaaacaagaattgggttaccccgctgatacatcaaacttggcttacattcaagccagccacaaattggaggacgtcatcgcggcgtttaactcgttcacaggtaagaactacgtggtcagctttgaaccaaccggtttgttgttcatggggttgacgccactaaaccaatttaacggcaatgatcaattcgtggcgttaactgagattggtgccatcgcctaccgcgacgaagcggttttcaacggtcacgaagtcagcgacgctgaaacattggtcttggattcgctagctggtgaacacacggagcaccaattgtatacgtcattgtcgatggccgactgggtcgctgcggacgtggcgaacgttaatgcgattattgatgggtataaccaggttgattaattgttttgggtatagttaaggggatgcatcttgcggtgcatcccctttttgcgctatctacagtctactaaaatgccacagataaaaaggcatacgtaacttaatgcatacgcccgattctaactagaatttgtaatgattgcgatcatatcgacattttttaattaatataaaccctattggaagatttaaatgtagcagaatgctctttcacaactgttttttaaacaaaagccagtcgtcgttataccttgtagtacatctaattagcccacgttataacgttcccgctcttcttcgataatttccttaaccacagtaccttctgtaatcgactttccctcaacattttcgtcagctgcagctgaacaatcagcgtatacatcaaatacattctgctttgtctctagcaatttcacgattcgctcatcaacactgcgttcattcagaaatcgctcaactgtgacgttttgcaacatttcatcagctttgttgtctaattcacgacgtgttaacgccttagttttgtctttgatacgttgaccatctgtctttatcggaaagaaggcgtcttctgcatcacaccattgcgacaaaacttgctgtatatttctagttttatcaaccttctctttactccctaaaaaacaaaaaaacagctgtccttcaccagacccgctagttttagattatcaaaatatgagcaaacctactatgattttggtctgattatttgtgatctacttttccgtatcatcttcagccaaatcagccactggcaaaagcaacaaactaggttgtgccttcgtcaagctagctttaaacgtctcaatttgatccgccacgattttcatgacatcatcaaactccgtcttcaatcctgacatttcaaactgcttacgtgccaacatttggaaacgaatcttttcggcagccatttcaactccgccagtaacgatgctaattgctgcaccagccacgccagcattaccaacaactttagaaaccggcttcaactttgaagcggcatctaaagttttcgttgcactgctaattgctaatgtctttgctgaattgttaatcaacttgctgtcgttcaactgtaccgttgtcaaagatggcgccataccagatggcaacgttacctgcttaatcgccgtcttatcaaacacaaattgtttagtcgcgtcatcagtagcgaaatcaacaacaatgccttgcaacgcttcattcaagttttgaatcaattgttgctcaaaacgcgtacgaacatcttcaaaagtctcatcattcaacaactcctgctcgtacaattttgccaaactgttgattgctgcacgacgggtcgtgttcatactcttgaagggacgacgtaatttaccattcaccgccatgttcaaacgtgcctcggccgtcttcgatgaaataacctcagcaaccttgcttgcgcccacttgtgcggccttcaatccgttacccacagattccttaatcttattaaccataaataatccccacccttctactatataaaacaattatagcttaagcttacacggacatcctgaaatatctttgtattgctcagaacatccaaagtgacacagcataaatgttactgcttattcacgccacatcaatctatcgcaggcatcctacttccactcaaacttatccaaccatacctgtacaagtggtggcagaatcgcttcattatctttgctaaagataaatgatatcagttcgttaagattgtggcgttcgactgtttcgtgcgtcaacctaacgaaatgtagtgtgctgtctccgtctatggcacctaacctagaaacaagccaaacttcatcgttcaccccgtcccgaagcaaatgtttgtagtcgctggtatataaatcaaccttgccgtttttcgtttgaagataaatctttttccccgttcgaccacgggcatctaccatcacaaactcatataactcagttgaaattttatttgttgacggaatgaccacatatccatactcactatatagccaaaatgccaccaggtcttcgagaccaatagcccccatcaagttaaatatttgtgtctttgggatctcagatttaatcagcgaaatgttgttatgtttatctatcgccgactttgcaatcaagcttgtcgttgtgtagacatcatcaccaaattcaattgattcatccccattatcaattcgttgcatcgccgcttggagacgacctttggccgtcgtgacactgcctgggacagtatcctctcccccgacttcaatccattccagcggaccgatatgcgcaactgcatccgccgccataaactgttctgacatatcgaacttaaacatgcttttcgggtcttgtggtacttgtgtcacccagtacgtccctttgtttttaagccagacaaaatcaccagcctgtagattatcaaacagatagtgaacactttggttattccatttcttgttccaaccaagcttgttggaagtctcatcaaagaatttgcggtaatccgaaaagctttgaattttttcaacagcctcaaccatcatctcaggagtgtctttaaatgaccatccggctgataaaactcccttttcaatgaaaaacggtgcactatctgtttgatgatccgcatctgccttggctttattaaagtatgaacgtttcataatcccccccatttcatttcgtccgttgcaatcttatatggttaaattttacctcaattttaatcactcaaaaccctggaagccttctagcacccggatcgtaatctttaatacttgtttaacataattttccagccatttgaccttcagtcaactgaacttataataatcgctctctttaaatgaccttgctactttctcaagtgatgtttgaagctttgtaccaaaaaaggcaacgccgaataaacgtctcagcatcagcagaacttttaacatttcaagctcctgtacattcacatcatatggcgtagagagtgacaacttaccaccaagcacgattactatgcttccaatcaaaattggcacgtctttcaatgccacatactgtgttaacttttctgcgcgtgcagatggtatttcgtcgtactcggcaatttagtcactcccaacgagggaatccttctcaaaaatgagataggcacccacgaacagacaacgatgttaccgggtctcaataaattgaagtgtgatatcatcgttccgatgacgatggttgtctttcgatagaatccgagtttcgaatactgcctcattattggcatacatatcgtaaaagtctcgtcgcattggatcacacggctaataatccactcagaacaattaactccctttttgtcaacccttttagccgaaatacagtaaactaaatattaggtttaactgttaaaaaagaaaagagatgactcctgcaaaaacgatatcgaacacatctaacatttcagtcaattttctaaggagatactaaatggcattaacagaagaagacgtacgtattgcttatgctgcaagtaagattacaactggtaacaaccgttcaaactctggacgtgttgcgctttggctagaagcctcagttgatgatgtgaaccagattattgatcaatattcactccctatcaagaagacagcggcaatttcgcacttttagcttctgatttttctcagaaataagtacttgatgacaaatataacgggccaagaaatcactttcgatttcttggcccgttatatttgtctgatactactcgcctcaacgaaccgcatcctaatattttttgttcttcacaagtgcctgcatgaacattatgtcatcataggaaacttccattgttccgtcatcttcagtttttcgatttgtcaaatactgattcaagagccagaaagtcagataatagtcacttgttgcaaaatattgtttgtacgaataatcaacatcgtggtcaattcgattttgtataatgctcatcaacctctcttcttgtaactgtgatgtgtcgggaaatgatttttcttcgtctaattcttcaaagtgcaacaaaaacttcaccaccgctcttaatacatctatgtctccatcaatcatcaattttattaaatccggaaaaagtccatcgagtttaccccctgaaatcgaaaagtcattcaaatttatttcagcagccattcctctactaattaaaacgtcaatatgaagatgatatcggtatagtagcatttgaacgaatgactagttctggggagaaacttggtagttttcctgatcaattatacattggtagtgaccttaactataaggttaagctcaaccttaagggcgactacgccgaaacaataaaaactagcgtgtttaaaaaatttaaatttccagttttcgaaggggaacgattttcatctgaagggtggctattcaaaagtataatgctggatggctggcaatctgtaaatatctcttatccaatttgtgtgggcgattacctggatggtggacttaccagaggtggactagcaagcaggctgaaagctccgaaaggaatgatgctcaatacagacttaaatcttagagtagctaatagattttctcaggtcactaagcaggctattatatttgatatttatagcttggaagcaggggaaatattctcacgtgacagatttaatgaatataaaattcttaaaatactatcattaccatttgctgcgattattaggtgggcagttaagatgaggagagcaatatgagtttggagaaaatagattttgttattgcatgggtcgacggtgaagatcctgaatggttgcgtaagaaaaataattacagtgttaaacgacaaaatgtaagtagtggagatgagaggttcagggcaaataattcattacattatttaatcagttcgatgcttaagtatgcaaattggttcaataatctttatatcgtaacagataatcaaatccctaaaaacttaccagatgattctagaattcacattgttgaccactcggatattattcctgcggtctatttaccaacgtttaattcagatgctattttattgaacattcataaaattcatggattagcggaacattttgtatattttgatgatgattttctgttgttgaaaccgactaaaaaaacggacttctttgataaaaatgggaagcctaaagatatgtcagctcaatttgtttatatgccgagagatgattttagccatatcgcaattaataatatttcggcaatcaatactaagttcagtaagaagacggcaataaaaaagaatttttttaaatacttatctttaaagaatggactgatgttaaatgtattttctgtgttagtatcgccattaccgtatttcacacgtttctatgatccacatgtcgctatttcgtataagaaaagcaattttgaagcggcaacaaaaatatgggaagctgaaattaatgcgactatgaagaataagtttcgtagttctaatgatgtgactaattggttgataagatactatcaattggtaatcggagatttctcgccacgttcacataaatttgggaagtacatttcaattaatgatacaaatttaattgaaaaggcaataaacaatgggaagcatcatatgattgtgattaacgattccgagggcgccacggaacaacatttcagagaatatactcaaattatggaggggattgcaaatgactaaaagaccatggctgtcagtgatacttccagtctacaatgtgcaaccttatttgaaggagtcaattgattcggtgcttagtcaaaacagcgatgttgaattgttgctgatagatgatggatcaacggatggatcagagaacattgttgaccagtatccaggggcgaaagttttacacctcaccaacgggggattatctaaggcaagaaatataggaattaaaaatgctaccgcagactacatatattttatggattcggatgatgcaatcaggagagggtttttagaatcggtttaccgtgtactagaaagtactaacgctgacgtactgtctttccagtatgaaattattagaacggacgggattcttgatgaaattaaagcaccgatctctctcaaatcattcagaactgttgataggaggagttgcctgagaatgttgatgaatcattcaattagtcaatctgcatggtcttatgtaattcggaaaaaaatattaatagacaatgaattatctttcacggaaaacatattatttgaagatgaagattcctcggtcagattttttgcgcattgtaatcaaatagtgctgttagaatacaatatgccaccatatttatatagaaaacgaacaaactctataactgataaatcagctaaaaatccaagcgttagagagttaacagacaatattctagttgccaaaaaagcatacgaacagtatattgccagctacggaaatagagatgaagtagatgcctggtactttaattttagagtatggatttgtaagcattatggtggtttctcaaatgaaaatacacagtatagtgtaacaatagcaaagttggaacgtgaattgaaaaatgagtttgcaagcatcgcgcgaaagctaacgattaagcagtttattaggtacgtggaatggcgatttgactttgtgaaatcaattatgcgaccaattaatagcctttataaatctattaaatgggtctaggaatgccgtatggttaaagtgtctttaataattcccatatttaacttggcaacgtatgttgagaggttggtttattgtttaaaaaaacagacattcacagattgtgaaatgttaataattgatgatggatctagtgataatagttttgagctgctacaaaaatttgttcgggaatgtgaagacggtagaataaaggtgcttagcaaggcacattctggagtttcagatacgagaaatgtaggcatagagcgttccaaaggtgaatacattatgtttgcagacggagatgattcatttgcttcagactatattagtgaatatgttagtgggatagaagaggatgattcagatattgcattctacccttttgatatagtaaagggtggctcaatcaaagagttgacaaagtatcaaacacgatatgaagagcttgcccgagacaatcactattcaaaaagagatcttctagaatttttatctactggaagagtgggtggttatccagtggcatatattagtaagaaatcattatgggacaaggttcaatttgacacaagatttgaaactttggaagatttacatgcactcttcaatcttgtgatgcgaagctcagaattgaaagtatcgttttttaaaaacggatactattcgtatgaagttagagaagatagtcaggtccataccgcggggtgggaaggcttttatgaccgtgtatctgttgaaattgatatgaaaaagagaattaacgacccgaagttaaagaaaaatctttcatcaatgatttacatagagtatttaaatcacgtttttaatcaaatgaatccggatcaatcccgagagatgtatgtatttttgcgattcaacttcttcgatgtgaaattatcgaagaagcaaagaattaaggctttggtggccatggtatatctaaatgtacagtcaaaaagatcaaaaaatgaccaaaatgcaagatgaccccttgttttctataattttagtagcatatgacgtttccaaatatattgagaaggcaattctttccgttctgaattcaagttttgacagttgggaattaataattattgacgatggttcaaaagatggtacatacgagatttgtcaatcgtatgagtatctttctaaagttaatgtgtatcagatgtcaagaattgggctagggtcagcgcgaaatttagctttaaaaaaagcgactggccgatatattttatttttggatggagatgatcgtgttgatgaaaacattatgaatcatctacatttgaaaataaaactaaacgagtatgatttgttgagttttcaatggcaaacagagaataatgacacgggcgttattgctaatactctgaatccagagacaactattgccgtttggaacaaatgttacagacgacaatggctgaatgaccacggcatagtatttcttgaggatgtatactatgaagatgtttcttttactttagaagttgtacacggtggtcctaaaagtataactatccctcatctaggttatgtgtacacaaaacgtaaacagagcataacccatatgccttttcaaaccaagaatgctcgagatacattgactgtgtttcaacatctgagctgtcaattaactaaatttaattcagattttgaacgaagttatattgttgacttttggtggagacatctattattgatgttgaatgcagacaaattagatggtaaagatttcctattaaaggcaatgatagatacgtatgtgagttcaggattagatttgttaaacgatgggccctataaaaacacttcatttataatgaagtttaagtgcatggaccttttgttacgaagaggatggtacgctggtgcagctaatatcaatttatttgctgatttcgtgcatactctgataacgaaaattaaattttgattgtatataaaaacaatgtgtatgttattatttttcatcttgttaatataaatcaaaaaatgtatagcgtgacactcgtggcctaaataaaaataatcacaaaacagtacctattcagccgaattttgtatgacaaagttatcactattttgctggacaataaactccgtaacaactgtaccccctaaggagtaggtggtacgaaatattatggaggaaattttctatggcaaaatggaaaagtgcagcgctaatcacaacacttgtgttgccgttggcggtttcagctggtggagagggcgtcgcaatggcgtcacaagctcgtcctgacgagacgacgatcaagattcacaagcaaattcgttatgatgacacgattagtgggttggcggatgatgagaaatatttcgcttggaatcacggatcagatgaggatggacaacactacttttggggtgatggtactgaagcgaataaggatacacttaccagtgatggtaagactgtttcttcaaataacccatttgactggactaattatactaaggccagtggtaaggacgaatacactgttgattacacaccgacagatgatttcgcaggacaagacaagattacatggaaagatctttggtcagacctaccaggcgtgcacttcattggtattcaattaccagataacgtgatgacgatcgacgatgatggtgagccacaaatcattgctaaggatgccaagggtggtattgcattcacgacatccgacggtaaagatatttactggcaagatattttgaaggcccaattgggtgtgcaacacacggatgaatctaatccatcacacgaaacgccaaagcacaacttcaactcaaagactggtactgacaagtacggtatgaagcacgaagttaaccacagtgcctcagactttgaagtggagttccaacaacttggggctgctaaggatttgacggaagcacaaatccgtcaagcgttggtcgctaactacacggacacggatgaaacagagcctgtctttggcggtaagggcgaggccgtaactgatgagaatggtgtcttgtcattcaacaacatcacaaacggtaactggttgttcatggaagatttgcaagattcaacgccaggcttggctgatatggtgacgcaacacgcggccccaatcttcttggcaacgccatacttgcaaccaaatgccgaagttgattcaaagggtaatggtacaaacaagggtgataagacatggttcgataactctgatgcgaacgccatgcacatctatgccaagaactatgctgctcacggtgatttgacgattgaaaagctggatgatgatactggtaaggcattgtctggtgtacaattcgcaatgatggaattgacggacgaacaattgacagccttgcaagagcaaatcgatgctggtttgttgtcaaagtcagtgacggacatcaaggcttacttgaagacgttgggcactgaagatgagacgttgttctacggtacaactggtaacaagggaacggttaagttcagcaacttgacgccaggtaagacgtactacgctttggaaatctcaacaccaacgggttacatggttaacccaacgctacaaaaggtttctcttaacagcgtaaatgacacgcaagttgatccaacggttggcggtgacgacacgactgtgcaagcacaaggtggaacgtacacggttcgcaacgatgacagcattgccttggataaggacatcaacgtgcaaaaccctgtgacggttgataacttggctgttgatggctacgatgctgatgggaacccaaactacatcgacaaggcgacgaataacccatactacgacgatgacacgctttggggtgtttcacgtggtaaggccttctcatacacggtcgatgccgaattgaacaagaacattggttcatacagcaagttcaacttggtggactcagtgccataccaagtgaacgccaactcatggacgatgtacgtacaaattgatggcgttgtgacaccattgttgcaagccgttgatacgcaaggtaacgcgaacgagcacagtactgatgacggtatctcaaacgaatctgttgcgtacgactcagataagggtgaaggtgtaagttacaagtttgctgaaggtgccgaagacttcgccaagtcacttggttacacgggcgccttcggtaaggatgcagatgcccttaaagcccaaacagaattcgtggctaccaacttgttgcacatgtatggtgaatcaagtagctatgagtttgataccgactaccgttctgttaaggaaggctcaggtgagaatggtacgatgaacctggacttcaagacggacttgttgaagggcttgggtgaattgatcaaggatgacacaactggtcacacgtcagttgtcttcaagattaatgcccaaacaaactcagctgcgcaagctgatactgacttggacggtacggataagtcaatcaacaacaaggtgacgttgaactacaacccttatccaaacccaacgcgtatgcctgatccaacaccattgactgatgaggccaagacacacgctgctggttgggatatccaaaaggttgatgaaaacggtaagccgttggctggggccggcttcgaccttggtcgtcgtgtcaatgagaacaacgttgaaaacgtgatttcacaattgttgacgacgaacaacaatggtaacgtgatgaatgaggcgtcattgattaaggccccagataagttgaagcttgctcaagatggaacgcctgcagataaggttgctgctgcaacggcatacttcaacggtcaagcggatgaattgcgtacagccgttcagaatggtcaaacaccattcgtatggttcgtccacttggatgcaccaactgctgatacccaacacggtaatttgcaaccaatcttcgacgtgatggcatcaaacatgcaaatgggtgacatttactggacgactgagcaagcattggcaacgacccacatgtcaggtgatgatggttacctccaatactgtggtttggccgacagccgttacatcttgactgagtcaatcgtgccagatggttacaacaagatggctgaccaaaagttcacgttggctggtgatgaaaactcatggtacttgcaagatacatcaaagttgttggagttcccattgatgaatggtgatgcttctgacaacaagattacgggtacgaacgaagacggttcaatgtcaggtgagtacttggaagttgaaaaccaaaagcaatcaaagtcaatcttcccaatcacgggtggtgttggtatcttgggtgctttggccgctggtttgacggtcatgggatcagcaatcttcaaccaccgtcgtcactaataagattaatacattaaccataccggtcgtggaactggtataaacatatctaaaatttgataatcttatgcttagcgagcagttctggaaacaggactgctcgctttttgttcataattcgtccacagtttaggtgcgcttacttggcacactaaagtaagtgcattttaggtagggagagactgatgatcgaaaaactaaaagactggttaaaaagtcacacgttatggcgcttggcgattcgcccaacgttacgcgtgcaactggaacaattaaatacggctaagccaacggtgttttatctaggcttgccggaacatggtaacttaggggaccaggcgattgctaaagccactgaaatttatctacaagaacaattaccgcaacatcaagtcgtgcggattgcgaatgacgctgtgttaccatgcatcccactcttgaagcggattatgcaaccaaatcacttaatcgtgatgcatggtggtggcaatctaggcgatttgtggccaggcgctgaaagtgtgcgccgggcggtagtgaatcgtttgaaaaaatggccgattattcagctaccacaatcagtattctttattgataagcaagaacatacgttatcgaagaagtgctatgacgacgcagaccgcttggtactagtcgcccgtgaggaacaagcccacagcgcgatgcaacaagctttcacctgtccgtcgatgcttgtaccggatatggttttcacgttgagtggacggctgaaagagttgccaattcaacgtgaaggggtgatggttcttttccgtcacgacgtggaaaagttatataacgacaatgtccgcgatggtgtgattgatcaactcggtgatttgtttgaccgggtgacggtgacggatactgtgttgccaaccggtgtgccattggagcaacgcgatgacgtcttgattctcttctggcgtcagatggcgaagcacgaattggtcgtgacagaccggctacacggtatgatttttggtctaatcacccaaacgccaaccgttgcgttattgaacaataatggcaaaattatctcgacatttgaaacgtggttgcagtccgtgccatggattaaagtctgggcacccacggatggaccgctcgaagtagcgattgtggatgtgatgcgggcgccggtcgcgccggtcgatttctcacgtcagttccgcccacttaatttctacttggcgaactttcgcaagggagagtagcgatggctgaacgtgcgcgcgagttaattcgtaacacagggatttttgcaatcgggtcattatcgacgaagatcctgagtttgttgatggtgccgttgtatacgacggtgttatcaactgctgactacggaacagttgatgtaattggcacgtttaccggtctattagcgccattggtaacattgagtgtctacgatgccgtctttcgctgggccttagatgatgcaaatgatgccagcactgcgttttcgaatgcgttagttgtttgggcaagtagtatgctgattttctcaagtatctgcgttggcctggcagcactgggtgtggcgcacatcggctacttctggtttatggttgtgttggggagccttggtgcgatttgcagcagcttagttcgtggcttagggtatgtcaaactattcacggtcgctggcattgttagcagtgttgtgtttatgaccttgaatttggtgttcctactgcaattagaactcggcttaaccgggtatttgttggcgagcgccatctcggcagtagtgagtttactggttgtttcgttcggtgcccgggtttggcaatactggcaagctaccgttgtgcaaccggcccgtatgcaacaattattgatctacagtttaccgctggtgccaaatgcgttgtcatggtggggcattgcgagtgcgaaccgtgtcgtcttgctgacctttgcaggcgttgcggccaatggattatacgcggtggccaataagttaccatcgttaatcaatttggtgtacggggcctttttgcaatcttggcaaatggcagcagtaaagtcttatgacgatcaggatgccggtgattattacacgaagacgtttgatatcgtcgcgcgcttgcagttgttgatggtcatggcgctattgtgtgtcacgcagtttgtctttgcgacctggattgcgccaacgtattggcaagcctggcaggcagtgccgggcttattattaacggtcgtctacaccaacatgtccgcaatggtcggggcaacttacttagccgccaagcggacgcggggcttgttcttaacaaccgtctacggtgctgcgattagtattggactgagcgtcgtcagcgtgccattcttggggattatcggcgcaagtttggctagttgtgttggtttcgcagcggtgctagggattcgcttgtatgaaacccggcgctttgtcggcattcgcgtgacttggtcggcaatgttgaaatatcacctggtgattggactacaaattggcctgatgtgcctgctgccagtcggctggatgcaaggcgtctgcttaagtttactgatggtgggcttaatttggtccgattggccgtattatcaacgcctattcgtcaccctaactaacaaaagataggtacggtttgttatacttgaattaacgtgttaatttgaaggagaagccgtatgattgtcttatttgttttgggaattgtgttattagcttatgctgccattaaaggggtcacgcgccatgaagtgcgctggccagctttggtagtggggctaattttgactgttttgatggggcttggtttacaacgcgcccaagaacgtcactttttgatggccaaggtgccggttgaaaagacgcaaaagatcgccccagcgttgacaattaacggtattaagttgattacgacgcaaaaggcgagtgacggtgagattcgttatacctacacattgggtaagaagagctaccaaacggtcacccaaaatgcgaagacaatcgtcaagacggcggacaaacaagcgacgttgaagacagaagtgatgacgtaccaggcgacatctggttggcgtcgtttcatgttgctgggccaagaaacctttgaaaagggggccgcaacgtatacgttgtcagtgccaaaggattggtactttgtgacgacgagccaagccaagactttgcaaaacatggtcaaggactcaaaggcgggcattgccaaggaagtcgcagccgaagtcaagcaacaatttgcggataaggccaaggctgacaaaaacttcatcaagaacaaggacgcccaaactaagttacaagcccaaattgtaacggacgtgacaaacaaggccaaccaagcccttgatcaagccatgctagagaaaattcaaagctggcacaattaagacataaaatactagaagttcctaaacgtccccgcgacagtttgggaacttttttttgcgacactttatagtgaataaaactatagggggacgcagactatggcgaaatggcgcaatatggcgttgatttgtacaatcgcaatgccattggtaatgggtagtggcacagcacacgcggctgagcatagcatcgatgtggctgaaacggatgtcacgttgcataaatacatcacaacaaacacagttttatcgggtaatgattattattggggaaacgggacgacggggttgaataacccgtttaccgctgaaaattcagagtggtcgaaggcgggtaagggttattcgtttacggcctataagttagcgaacggcgtaattaagttggcgacggatgggaccgtgacgatttcaaccgatcgagtgcctgaattgggcttggcatggtcagacttactgacggtccgttcgggtgaaacagccgcttacaaggaagcaacgaatccatcgactgatgtgagcgacaacattgttgaattaaagagtggggtcacggaacaacaagtggccgacttgcaacaatacttggctaagacatcaagtgatcatcaaacagtgacgaccaataatgatggtgatgccacgtttgatgatttggctaatggccagtggattgtgtttgaaactggtgcaccagatgccgtttcgacgttagcgcaacccatgattttgaacttgccaatgaagaatgcggctgccgacacggcgcaaggcacgtggtttgatggcagtggcgattacaatgtgaatttgtatcccaaggacttcatgccaagcacggaagagccaacgattgataagatgatcaacacgttgcaaaacgtgagcgtggatgagctaactgccaagtgggatgacgccaagggccacccggtctatggtggtaacgtggtttctgatgacggcgcggcggtgaaaagtgcggtaacgttcttagaaaacgacaacttgtatggcgtgtcgcgtggtaagtcgtacaactacacgttggatatgcaactaccaaaatcaatcgacaagttttcatcatacgggtttgtcgatacgattccatatgaagtaacggttaattcatggacgatgtatgcgcaaattgacggccagttaacgccgttgatgcaagccgttgacccgaatggaaacgacagtaagagttcgagtgacggactgtcacaacctaagggtgattacgattcagaacgaattgtaacgccggatggcaaggaagctgacgtgaactttaagtttgcggaagtgcgtggtgacaacggtaaaacggccgccgcgatgtttggttataccggtgagttaggtaagagcaagacggcgattgctgaacaaacggcctacattgctacgcatttgttgcgcatgcaaggatacacggcgacgtaccaatttaacggtgatgtgacgacggatgccggtcagtttggggcgaaccgtgccattatcgatgcggatacgggtgaaatgaagattacaaccaaggaattgttccgtgataagttggctgcctgggcaccgttgcaaaatgatacgactggtcacacgtcaattgtctttaagttgaacacgcaaaccaattcggcagcgcaagcgaatacaggcgataacaagattgataataaggtccaaatgttgttcgataacggcgccacgaaccaagacacggctgccaataagtcggccttacgtgattcgtcatacacgacggccgtgggttgggaattccataagacagacaagtacggtaacccattgcgcggggctggtttcgatatgggtcgtttggtaacaccacagaatatcgaaaacgtgatttcgcagttgttgagtgaagataataatggtaatccaatcaaagacacgagctacttggaaatgttcgagcatttgaaggatagtcctgagtacgtgacggagtttagcaagtctgattacacgacggacgccgctaaaattgcagcgattaaggaatacttggacggccaagcggctgatttacgtaagcgcgtggctgaatacgctgcccaaccagatagcgagaagtcaaagtacgaagtctacgtttggtttattcacttggacaatgccgctcacggagcaaagcaaccaatcgtgactgacatgacttcaagtatggaaatgggtgatatctactgggtgacgaataacgccttggctacgacgcacaagtcgggtcgtgatggttacctccaatactgtggggttgctgatgggcgttacttgttccgtgaatcaatcgcacccgatgggtataagcaaatggctgacgtgaagttcacgttgtcgagtgggccagattcggtttaccaaccaacggctgaattcccagatttgaaggatgccaagggcgtgtcattgggcacggactcccagattactgggttggttgagaacttggatgggcattatgtgcacattaagaactacgccaaggggatgtggccagttagtggtggcatcggcgcattggttgtctttgcccttggtggggtgctgatgaccagtgcttacctcaagcgtcgatttgaccgacgaaacgattagccaaatggcacggtgactttcttgtataatagggacaaggaggtgacgtgatgacaccaaaggataaagcaaagagcatcattcacagcgcttcggccgctgcgggtagtgtggcattatcaccaattccctttacggatgcggccttgttagtaccgattcaggtgggaatgattacgtcgttatttaaggcgtatgatcaaaaaatgatgcagggggccattcgtggcgccgtgtgggcagtcgccgcaacctcgtttggtcgtggcgttgtcgggaatgcctttaagttcgtccctggtttggggacagtcgctggggcaacgatttcggccaccacggcggttggcttaaccgaagtgattggctgggccattgtgaatgaactagagacaggtaacaaagtccaaccaggcgatattttcggcatcattatgaatgcggtaaaaaagcgttaatggttaacagaatagacaaaaaatgacggcggaaacgccgtttttttttgcgaaaatttcagtgtgagcaccacacggggagttgtggtcggggaaatgaataaggagccaaacaagatgaaaaaaacacaatcattgcttttgattagtaccttaattgcaccaatgatgcttggtacggcgggtgtttctgccaagtcagctgaagctaatccacccaaagagacgttagtgcgcattcacgcggtaacagatatgaatgccactgccgttgatcgacgcgaccagcatgactattgggggaacggtgggattcaagatttgaataaaatcgttgaagacaattccagctgggaaccaacggtcggggcaacgtatgaagcctttgccttaccaactgggaccgtgacgtatgaaggtgaagatatgaagccagtcattaacgacaccttccatgccacggttgatggcaaggagtggcgttggacggacattctgaagccggtccgggccgacaagttaggtgctgctacgacgaacttgattaaaaaggatggcaatatttcaccttggactatcgaaattgccggtgggatggacgtgcgtaaggccgtctatgccttaacggatttggacccacgtacgccacatccgaaagcctttaagaataccgatgctcaaggtctgacggaaatgtcattggctaagggacaatgggtgattgcggaagacttggaagcgaatatgaagtcgacggcatcagtgccaatgtttatcgacattccgatgattaagccagatgccaagcaaggtggcgaggatttctggtatgacaacacacaggccgacgccttgaacttgtatgccaagcaatatgatcccacaacgttgaaggtgaagaagacagataaggaaacgggcaaggctttggctggggcgcaagtcttggtaacggagaacacccacgaagagcaactgaaaaaggtcttgccagaattgttggccgccattaagaagcaacctaaagatgcggctaagttggttgaacagtatgtaccagaattgaagacgggtaactatgcaatccgtaagacggataagtctggtgaggcgacattctcaagtgacaatgctggtgagcgctttatgacgccagggcatacatatgccgtggttgagttggcagcgccaaccggttacattgttgaaccgcaaattcaagatgttgaattgtcgatggaaaagaacccggctgataagagtttgattcaaggacaaggaaaagctgatttcattgattacgatgaattgcaggttgataagtcagtaacgattggtgataagacttatggtgccggcgctgaagatggcggcgacacggaacaaggtgttgccaagggcacaactttccagtggcacatcaacagtgaattgaaccaaaacgttgatacgtatagtcagtatgaattggtcgatacgttaccataccaaaatgattggcgcacgatgacgttgaacctgacgtatcaagatgcgagcggtgcgttgaagacgacatccctattgcaaatgacggcgaatggcatgaataccggcgctggcacgacctacaccactaatcaaaatggggtgaacgggattacgtataacgccgcaacggccccaactgtgacggcattgggtgatgcgatgacggctgatggcattgaattgtcaggatctggtagtcgttatgcggttaaggatggcaaattggatgccagtcaatcagtcgctgacggcacgattatgttgtcagtgacggaaactggtcgtaagcagttggctgctaagatggctgagttgctagccagcggggcagccaaggatggcacatggcagttgtcatggaacttagatgtggtggcgaaccaaggaacgcaacccggagaaatggttaacaaggtcgacttgaactacaagactgcgtttgaccaagacactgattctgatacggctaagacattcgtgaagggatcgggtacgccaacgattcatgatacgccaactaagggtggtggtgtcttgccatacacagctggtgtgatgggcattggcttgaccattttggggttgcttggtttggcgcacttgttgaagaagcgtcgggctgaagattaattaacgagggaagagaaatggcgaaaaaaccacgaaagaaaatcagtttaacgaccgctgtgttgttcattgctggtttggcaattttttcgtatccgattgtggcacaagcttatgaagcaatgcatcagagtgggattgtgcagaactatgagcgcgaaacaacggtgatgccaaagaaggaaaagaatgcggtccagcaggcgattgatgctgaaaatgccaaaatcaaggaaaaggcgaaagacaccggcaatgatgcggacgttattgctgcgatgacggaactgaaccagaaagatagttatgaaaacggggatgacaatacgcttaaaaagttggttggtaagccaatcggggtgatttcgattccaaagctaggtgggttgcgtctgccaattttcaatagcatcaaggataaggcgattagtaatggcgctggtttaattccagggacttcaattccacaggccaagaaggaaggcttacactcagttatcacgagtcactcaggtttgccgaatgcaaagctgtttacggatttgaaaaagctacagctgaaggacaagttctacattgaaattgcgggtggcaagacgttgacgtatcaagttgataagattgacgtgattaagcctgaaaaattggagacctacttcaagttggatcaaaccaagaactacgtcacgttgctgacttgtacaccgacggggattaactcgcaccgtttgctagtccgggggcaccagattccaagtgaagcggtcccaactaatgttgtgcgggctgagttcatgtggctgggcgcgttgattgtggcggtgtcatcactcggcggcttcttattgcgcaagcgcatcatgttgaagaatgcgatgctggctgtggttaagaagtgatgtttgttgtgacgaaaaaatgattgtgttatagttgatttactgattggagtgccaggtaactggcgctccttttgtggtttataggggatgattaacagggttagcaaagaaggggtgacggggatgacagaatatgtcacgaaggaagcgtttgaaaagttcaaggccgaggattttgcgcaagtacggcaggatttaaccgtgttaacagtgaaagttgacaccttaacaacagcagtggctgccttgccgacgactagtgacgtgaaggtactaattcacgaagcgttcaaagaagcgcgggggaccgcaatcggtttaggcgtaatgattgcggtcatcacggggacgattattgccatcttgtcgtttgtattttcggtttacgttggccattaaaactcaccatgttcgggcttatttcaaacaaaagtgataaaatgatgagaaataaacagaacgaggtacaacgcatggcaacacgaatgcaagatgatttttatgatgcgattaacgaagcgtgggaagcggatgcggtcattccagctgataaatcacgaacaggtggttttagtgacttggcggatgacatcgaagaattgatgttggatacgacggatgcctggcaagcaggtcaaaacgtgccaaccgatgccattttggctaattttgtgaagtaccacaagttggcagtggattttgcaacccgtgatgcgttgggtactgacccagtgaagccattgattgcgcgctaccaagcgtttacgtcatttgctgattttgcggcacacatcattgaattggaaaaggcaggcttgcccaatgctttgccaattggggtagcgccagacttcaaggatgcgcgtacgaatgtgttgtgggccgatgcactaggcattattttgccagatacaacctactatgcgcctgatcacgagcaaggtaaggaattgttggctaagtggcgcgccgcgcaagaagatttgttgcctaagtttggcttcagtgctgacgaaatcaaggatttgttggacaagtacttggctttcgatgcccgcatagctaaggttgtgttgagccaagaagagtcagcggagtatgccaagttgtaccacccctacaagtgggctgatttcacagctttgacaccagccttgccattggacgagattttgacagccatgacgggcaccgcacccgagatggttgtcgtaccggaagaacgtttctgggcagcatctgatcaattcttctctgaagaagcctggcctttgttgcaagcaacgttgattgtgggtatcgcgaatgcctttacaagttacttgtcagatgaaattcgagtgctaggtggggcgtacgggcgtgcgttgtctggaacgccggaagcaatgaaccaacgtaaggcggcttattacttggcagctggtccatacacacaagcgcttggtttgtggtatgccggtgaaaagttccccgaagcagccaagactgacgtggaacaaaaggttgccacgatgattgatgtgtacaaggagcgcttgcaaaccgctgactggttgcaaccagctacgcgtgaaaaggcgattgttaagttggacgccattgtgccacacatcggctaccccgaaaagttgcctgatcgctataaggataagattgttgatgatggagcgacgttgtttgagacggccgaaaagttccgtgcccaaggggtggcctaccaatggtcaaagtggaatcaaccggttgaccgtgatgagtggcacatgccagcacacatggtgaatgcttactacgatccacaacaaaaccaaattgtgttcccagcagcgattttgcaagcaccattctatagcttggatcaatcatcatctgcgaactacggtggtattggggcggttattgctcacgagatttcacacgcctttgatacgaatggggcatcatttgatgaaaatggtagtttgaacgattggtggacagaagaggactacgccgccttcaagtcacgtactcaaaaggtgatcgatgagttcgatggtttggattcatatggggctaaggtgaatggtaagctgacggtctcagaaaacgtggccgatcttggtggtgtcgctgcggccttggcagcagcaaagcgcgatgctgatttttcagcaacggacttctttgagagctgggcaaccatctggcgtcaaaaggcacgtcctgagattatgcaattgttggccgcttcagatgtacacggaccagcaaagttccgtgtgaatgtgacggtatcgaactttgatgacttctacacgacgttcgatgtgcaaccatctgataagatgtaccgcgcacctgaagatcgcgtgatgatttggtaatcaatgaataaaaaaataaggtctgcattggaattttccgacgcagaccttattttttataaatttttcttttttcgaatcggtctatgggagacgacagcgatgtaggtgccgaccaatgacgaaaggccaaaataaaaaccacgtacactctgcaaagtaaccgtggtcaatctctaatgttcaattaaagtgcgacttcgcggtgctccgccacaaatctagtatataacagaccgaatgtgtttgccaccaggcagatcgcattcggtttttctttacacattacagtgtagttttttagaaagcgattagttaaattgttcacaaaaccggattttccttactcgaaaatatgaaaacgcattcaagaaatagattatttgcacattttttcactaatttacataaaagggttgcacttaatttgcacaaattaagtgcaacccttttatgtaaattagtgaaaaaatgcgcatatagccttgtttttgaatgcgttttcatatttttaagtaagcagattgcggttttgtgaattaataaacattacgtcattatcaaccaccccacatcctaacaggtcaactggtataaattttgaagaacatacaaaaaacggtcaggacattgttgtcccaaccgcttaaaagttactctatttgaatctagctaaaccaaacgccaatttcatgttctgcattggccacactatctgaactatgcacaatattacgaactgcaccatcttcccaatcacgcccatagtcaccgcgaatcgttcctggcgctgcttcacttggattcgtcacaccagccatgactcggaaattcttaacaatattagtccccgtaacaatcattgccaccaatgggccactcgtcatataatcaacaatttccggaaaatatggtgcgtccaccttatccgcatagtgctcacgcaattgcgcttcagtggctgtcaccattcgcatatctgtgattcggtagccctttcgctccaaccgagaaaacacttcccccatcaaaccacgtgccacgccgtccggcttgatcaatactaatgtacgctcttcagacataatttagttcccctcatcgtgttatgtcgtcattgtaacgcgcttaacaccccattgcaagcggtttcaattataagattggtgccaacaaacgtgagaacatttgcttgaaacgtaaccaaagcgattgttcactgaagtattgccgggtcaatttcgttgcgtgtttcagatcttcagcgaagatatcattcatctgtcgagccacatcacgactatacataaaagcattcacttcaaaattcaacgcgaaagatcggatatccatattcgcactaccaactgaaaccaccttatcatcaatcaccagggtctttgcatgtaagaagccgttatcatacgtataaacttcggcccctgccttcaccatctggtgcgcataatattgcgttgcccgataaacaaacgcgtggtctggcatccccggaatcatgattcgtaccttaacaccagaccgggccgcaaccgacaggacatccataatcgcctggtttggaataaagtacggcgactgaatggtaatgctttcttgtgcaatcgccagcatgtggaggtagccttgataaatttgcttggcatctgattcaggtcccgacgagacaatttgcattgcaacgccacctgctactgtggtatctggaaagtaatcctctgaaaattgtaacttttcagtcaccgttgtcgcgttccaatccataaagaaacggctctgcatggctaagactgcatccccttcaacacgcaaatgggtatcacgccaatgcccaaattttggcttgcgtcccaagtattggtccccaacattaaatccaccaatgtagccaatattaccatcaatgataaccagcttacggtgatcatggttgttcactcgcagtgaaaacatttgccaacgcgccatcaaaaaggcctcaacttggccacccgcatcgcgtaaccgttggtacatcttgttatgccggccgccagatccccatgcgtcaaagataactcgcacacgaaccccttcttgcgcctttttagtcagcaaatcaactagttcattaccaatttggtcatcataaattgtgtaatattcaatgttaatgtgatgcgtcgcgttttcaatatccgcaaataaacgcgcaaatttttcatgcccatcagtaaaaatttcgacatcattttcatttgtaaaaatggcttgttcgttatttaaaaatagccggacaaaagtttgctcttcacggtactcgttatcctcaagccgcttcatttcctgtttctgttttttcgctatccggtcaatccccataactcgttgcgtccgaatatcaaaaatgcgtttgtctgataacttccgcccaaagaagaaataaaacgcaaatccaaacaccggaaatagcagcaaaactagcatccaagcccatactgtggtgatatcccgtgttttatcgcggaacaccgttacaatcgctcccagcgtatttaacactagtaagataacgaccgcaatatttaaccaatgctcaattaccatgcccacactcctgtcttgaatttaagtaatcctattgtatcaaatgtcgcctcgtcagtttgcccaataaccgtccacttaggaaataattacgttacaaaaaaacgccctgcaatcacaagtttcttggattgtgaagagcgcttgtctgttttatttctgaataaattcccaaaagagttttgccgcttctgtatggcgaacatttgccttacgaataaatgacatttcgcttgcatcactaatatcgatatgccgcttaacgattgtgccattaggtggcaaatcaatgctcttttccatcatgattgagacgcccataccactggctaccatattcataataatatcaatacgttgtccttcataagcgacatgcggtacaaaaccagcttttttagccaagctcatcacatggtcataaattaatgtttctcgtcccagtagcaaaaagtcttcattctgcaaatcagttagattaacaacctcgttttgagcgagtggatgatccgcaggcaaaatgcacacaaacgaatcctcctcggtgacaacggtttcgtaatcatcgccaaaatcaccaaagtcacgaccaaatacgatatcactctgcccattacccagcgacataatgacgtggtccccgtgaacttcagacaaatgaagctccacttcgggatgggctttatgaaaggctgttatcatttcaaaaccacggtaatttgataccgacggaatggcgtgaatatttaggacaaaatcagccgcatcagcatgctgcagtagcgtctgtcgcattgcctcgtactcagacataatcttattggcatagatgactgcgatatctccggcttccgtcaacttaatcatgcgatgactgcgctcaaataacttaacatccaattctttctctaaagacaaaatctgttttgaaatgtttccttgtgtcgtaaacaatcgttctgctgtttccgtgtagcttaatgttttcgctaaatccagaaacacttcaaatttacggatatccataatagatcctcttaattattactctttggaataatataccacattttaagctattcggcgactgcccccacacaaaaaagaggtttaaacgtcacatgtacgtttaaacctctaaataactatcttagtgactaaaaattagtccttttctgaaatagctgcgatacctggcaaagtcttaccttccaagtactccaatgaagcaccaccaccagtagagatgtggctcaattggtcagcaacaccaagttgttgaacagcggcagttgaatcaccaccaccaacgatagtcgttgcaccgttctccttagtaaccttaaccaattcttcaccgatagccaaagttcccttggcaaagttaggcatttcgaacacacccataggtccgttccaaacaaccgtcttagcatctgccaaaactgacttgaacaattcaattgacttaggaccagcatcaagacccatgtagccatccttgataccatcttcagcaatgtaagtgtcagcgtcgttagcaaacttgtcagcagcaacggcgtcaactggcaagaccaacttgtcgccagcttcttcgatcaattgcttagccaacgcaaccttgtcctcttcgaacaatgagttaccaatagccttaccgttagcagcatcgaacgtaaaggccattccaccaccaacgataaccttgtcagccttcttcaacaagttttcgataatcgtaatcttgtctgaaaccttagcaccaccgatgatagcaacgaatggacgctctgggttttcaacggcaccacccaagaacttgatttccttttccatcaagaagccagcagcagtttgcgcaatgttagctgcgatacctgcgtttgaagcgtgggcacggtgtgcagtaccaaacgcatcgttaacaaagacatcacccaatgaagcccagtacttaccaagctcaggatcgttctttgactcacgcttaacttcttcaccgttaacaacgtcttcgaaacgtgtgttctcaaagatcaaaacttgaccatcttccaatgcagcaacggcatcttccaattccttaccttcagtagcaggaacgaaagttacaggttgacccaacaagtcagccaaacgttgtgcaacaggcttcattgacaagcccttcttgtcatcttcactcttgatacgacccaagtgtgagaacaagattgcacgtccaccttgctccaaaacgtacttaatagttggcaatgcagctacgatacggttgtcgtttgagacaacaacttcaccgttctcttccttcaaaggaacgttaaagtctacacgcatcaaaaccttcttacccttcaactccaagtcttcaacagtcaacttagccatgggaaaagtccttctttctgtgtatataattaaattacttcaataagtctattataacaaaaaacaggtggtttagtatgcctaaaccacctgtttttactctatctgctagaaattagcaattagagagttgccaagtgcaacaaagtacggatcatgtttgaagtgaaaccgtactcgttgtcgtaccaagcagcagtttgaaccaattgcttatcaccaacagtgataaccttagtcaaagttgggtcaaacacagcaccgtgtgtgtcgccaatgatgtctgatgacacgatctcgtcttcgttaacaccgaatgagtcgttcgtgtacttcttaacagcttcgttaacttcttcagccgtaacagtctttgacaaaacagtcgtcaactcagtaacagaaccgtcaacaacagcaacacgttgtgcgtgaccgtccaacttaccagcaacagaaggaacaaccaaaccgatagccttagcggcaccagttgagtgaggaatcgtgtttgctgaagcagtacggtttgaacggaactttgatcccttaggaccgtccaagatcatttgcgttgaagtgaaggcgtgaaccgtcgtcatcaaaccgatctcgataccaaattccttgtccaaggcgtttgccaatggagccaatgattgcgtcgtgcatgaaccagcagatacgatgtgatcgtctgcagtcaacgtgtcttggttaacaccgtagacaaccgttgggatgtttccagctggagctgaaatcaaaaccttcttagcacctgcatccaagtgagcttgtgacttttctgctgaagtgtagaatccagtagactccaaaacgatttcaacaccatcgtttgcaacccacttcaagtcagccgcgttacgctcagcgtaaacacggatcttcttaccatcaacgatgataccgtcttcgtcagctgaaacatcaactggcaaagtaccgtgcgttgagtcatacttcaacaagtatgccaacatagcagggttagtcaaatcgttaattgcaacaacttcgatgtcgtccgcagtatccttcaactcaaggatgcgacggaaggccaaacgaccaatacggccgaaaccgttgataccaatcttaacagtcattattaagattcctcccagaaattctttgtaaacgtttttacgttgtttattatacgactttgcataaagtttcgcaaacaattgtaacaacgcgctttcaacaccgcaacaaacgttgccgttcattacgaaccgacccaaataaccacctgatgtcaccatcaaatatcttatttaatcgatacatctattatacgccttaaacctaaaaaaagctcaactttacattgtctcaaatacaaaacgactaaacctcggtttagtcgtttttgtcttatttgactttacttagtaaccgtcgctttgtccgccgaaatacggttgacatgacacttgtgtgcaactcaattaacgtcagtacaactaacaccgtcactgtgccaataactgcaaaccacgttcccgtcatatcaatcaatgatcgttcttcattcgctgataaagaaattgaagaagctttcacaacctcctcttcggtcaaagcatcattaattaattgatagtctgccatatgaatcaaatcttgcaacgtaaatggatcatttaaggcttgaaaatcatgcaaatttgtttgtaggatatcttcctcactctttaacttatcagcccaaccatccttatcatcattaaaaatagtcagtaaccgcacctcatgaatcaaaaaaatgtagtcagcgacatattggtacgccgactgttcggcagacagtagtccgttctcagtttgtgtgaggtgatcactcaattgatgatccgctttctttaagcagtcaaccacatcggtctcagccttgaagcgatcacgcatcaaatcaatttcttcaagggcatcgacatacgctgcaataattgtatttttatctgatgccttactattttgtgcaattggtaatgtcactgcgtcatccccataaccagttaccgtaccaaatgccattgtcagcgagaaactcgccgcaatcaataaaaccaatcgtttcatcatggtctcaaccttcccttttctcttctttgatagaataacaagggaatgctggttattttgggacaatttgtgatgaaacactcctaaattgtgaacaaaaaaagcaatcagtctcactgaactgattgcctatattgataccttatttttgtaaaactagtcggtgcgcttcctgctgatcagcaccaccaagacgggcaaatccataacgtacaatccgacccaagccacggaagatagctgcccaacggcgtgacatcaagtattctaccagtgacgccactgacatcatcccaatccaaatgattactaaaattgcaaatacaacagctcctgcaaatacattaatggtcatatccatcctcccacttggttaacttaaacctaaccctattagttaataaaagtcctaatcaacataatccctgttaactaggacactatttattataggttaggtaaaagttaattgcaagtgttttgttaggtttttcctaacgatagctaatgcggtccatgggatgtgctgcattgaaagcattaatcaattcaagcatatcccggcgagtagcgcccttttggacatacttcactgctttttgcttatcttttgcaactcctgacaccattgattgaaaatgcatgccattgcgctggtttgatggtaatgccattgttctactaccttcttttcttaaaaaacaatctgtcgtcgtgtctaccctggaatcaggccacgacgccgatagtacgcaaccgtttcctcagcaaaatcagccgggtaacctaaatgctcagtcagcatccacgcagcaaacggttcgtcttcgtgatagtgggctacccgcactaaatcttccggtgatgtcatgtaggcaatcacctcttcacgggcgctcacctcattattatgtgcacgcacagcgtcatagtccaaatgatcaccaagatctgaaattgcatgatgatattcctcaactaaggtccgcgccttatcaaacgttgccaaggttttatcaatgaaaatgtaagccttatttcccttcagatacgccaccccatcaagaccggaattttctttcaatggcattgtatctaagacaaccgcttctagaccatgggccaccaaatcttgctcgacgcgcatcaataactcatcgtaatcgttacttcgcattccgatcctcgtagtccgcaattaatccttcgatataagctttcgcccggtcaatcacacgatgacgatcttcatcaggcaagcccgaaatatccaacccccagtgtgctgccatcaagaccggctcgtcagtggctaccgctgtcgacaccttgtctggatcctcaactaagtctgattttgataccccgaagtaatcagccattgcttcaattttatcgatgcggggatacgtcttaccgttcgaccaatcagaaattgtcgccgttgatacaccaacgatttcagccaatcgtgccgctgtaatttctcgttgctttatgagacgcttaatgttgcgtcccattattgccttaccttctgatgatgccatcttgttcacctttttctatgtattatcattcgttatgtttaaattttaaaaaatgcctgtgaccacgtcgcacaagtattctgttatatatttataataaaggtaaacttaacgcattgcaaggtttaacctaacggatttgtggcaaaaatggctatcttgcttacgatagacgtgattgtgctacaaaagtgctacaaagcaaaaaataaaagccctgaaatgcctttaaatcaagactttcagagctttattttcgttatatcaatgaatctggggggaatcgaaccctcatctccggaaccggaatccgacgtgatatccattacactacagatccaacaatataactagtatagcgactttttgtgccttgcgcaagttactttgcaagctttccatagccagtcgcataattaatgacaacccccggctcaacgtttggtacaaacacgttgtattccaaagaaccatctgaagacttggcctccatgtgcgaacctgatggtaccaggttgtttccttcatagactggtgtcacccggtaacgcactgtcttacgattatccaacgcctttcgtaccagcgtctcatagtagttctgacctgtattctcatcattaccatttgacgactggttagcccaggcagtttgggcagtaatgttctgtgggttagcttctgacgcatcaaagcccttcacgctacccgctaaagcgtacccaattgagtgaccacgattgtacaacacgtggaaattaccaccaattgtcaactggtgccaccctaccggattaatttgccgcgagttacccgtttcatcacgagaacgataaatacggcttgacttgtttaacagcgcgttagccacacctgcacgaccaagtgaatcctgcttagccaactgtacatacggtgccgaagaaactttcgcatcgagcgatgtcttattatcgttcaaaacaaaggcacccgacccgttaaatcgaatactattggttgcaagttgttttttgactgcatcagttaaaactgatgaggccaaagattctgctggatgttgatcttccggtgaaccgtaatcaaccgactgattcactttcacacttgaatttgcataattcgtcttgccttgctgtgaaccgtgattgtcctttaaaaccgtttgttgcaacgcaaaaattcccaacgcaacaacaacacctgcgactgaggcttttcgtttacgtcccatatcgacattctccctacttaattgctaacaaatagtataacatgacgccacatgaaccgcagaaattagcgtttcctgggcgcaacagtcttcgatgaaatggcacattttcctactcgtttttcacgactattctggtatgattaatgtattaaatacatcacacgaggataatactatgactaacaagtacttagttgccaagaatgatttgcaacacgccactgactggcaacccgagacggcccactcagacgttcgcaccgaagtcgaagattcaattgccaagcgcttgactgaaatcatgacgacagtcgctgattttggttacgaatctgccactgttaatttgcacgacttacaagactacgtacgtgaagatgtcattggtcactaccaattcttattccgcaagaacccacaattgcgtgaccaactcgttctaacaaacgaaatgccactttcagtatttaacacaatggcacaagccgctgttgcctcaattttggaagattctgactacgactattcattccacacagatggtgaagttcaaatcttctggcactaatacggaggccgggacagaagtctctgtctcaaaaaaagccgccaatctcccgatctaaaatcggaggattggcggcttttaaacgtgttccgaaaggctaaacccttaatataacgcgacttgatccactcatacctttacacaagcgggttaaacaacattatcatcgggttcaaagcgtctttcgtctcactctcttttttaaatcatttgattgttgtacatcgagatgctgattccttcggccgacaattgcattttcgcaatcgaaccatttgctggacgttcatgaacctgaatcttgccttgtccataccggtcagccaaggaaatcaacgtattcccatgacttatcagcaaaacatcatccccatcctgcaaagctggattatctaaaatcagcttgaatcccgcttcgactcgttgccaatattcagtcgcatcttctgcgtcatgccatggatcagccgctttcaacaaatcttttgttttatcaacaccataagcatcaacaattgcggcataagtgcttaagccaacggtcgcaccagcatttgtccaggcgacatccatattgctgccttcatagctaccataaaactcttcacgaaaattccaagccgtttgcaaactaatatctgtcgccgtttgattggctgccaaaataatgtttgctgtatccattgctcgggttgtatctgaactataggctgctttaaatggtacgtcagctagtcgttcgcccgcttggtgtgcatctgcaattccttcatcagttagtggcgaattaccccaaccttgtaatttattatagcggttaaagtatgtcttaccatgccgcaccactgttaaatttaatgttttcatccgacgcctcctgacaccattgtagcgcgcttatttgttgcgttccagcacacctttacggcgacggatttgatccgccttaagctgttcgcggaaaatcgttagcgcttgcttagctttgcccccgacaaattcaaaagtttgaccttgtgtcgtcttgataaaaaaaccacggaagtaaaactttaagaagatttccatgctaatcgtttcaatgttcgtccacggaatttgaatgtatccgccgcctgcattggcccgaaattcaatcccttgatcaccatagaaaatacgcccctgcttgatgtttaccggtgacatcattgcattcgcatttccttccaaaaataactttgtattcaacgcttgtaccataattctttccccattcaattaatatgtatctggctagcatgagctaaccagttaaaaataaaaatggcaagtaacgtctaaccgccactcaccattttaccaaacattatgtcattcggtattaacccatgatacctagccagtaagccaagataccaacggcgaacaaaccgaagataattgtaatagctgatacgcgcttacgtagcaaccacaataccaagaacaacaaaagcaatggtgccaaaccaggaatcaattggttcaacgtgtcttgcaacgttgtaatcttgtaggcgcccaacgtttggccacccttaatttggttcacgatttcaatcaactttgatactgatacgtgtccgccattgatttgtgaagccaagctgctcatgtcaacgccggctccttcttgaaccttaacctttgacacaaccaatgggaagttcatcgtcgtccaacgaggaaccagcacacccatgataaacataccaaggatagatgcacccatcgtaatcttttgcatggccccaccggccaagttttgcgtgatattcgtaccttgcttgtaaccaagatcctgtgtataccacaagaatcccatacgcaagatgttccaaactacgaagaagataattggtcctaggattgaaccaccttgggccattccggccgcaaaggctcccaaaactggtcgaacagttccccaccagattgggtcaccaacaccggccaaaggtcccatcataccaaccttaacaccttgaattgtttcatcgtcgatgtcagcaccgttagcacgttgctcttccaaagccaactcaacacccaagattggtgatgccacgtatgggtgtgtgttgaagaattccaagtgacgcttcaaagcagcggcacgatcttcttttgatgagtacaacttcttgattgctggaatcatggcgaatgcccaaccaacgttttgcatacgctcatagttccatgaaccttgcaagaagaatgaacgccaccaagttgcacgaagttctttttgagtcaagtgaacttcattctttactacttcatccatgatgttattccccctgctcctagtagttgttcaaaatggcatcgactgggtcgccaccacttccaccagctgaaccaccaccgtttgatccgccaccgttaccaccgttaaactttggtgacaattgtaggtaaatcaaggcaagtaccaaaccaatgatacccatagcgatcaagttcaactctgtaacggctgaaagggcgaatcccaagaagaagaatggccacaattcagcagttgccatcatgttaataaccatggcataaccaacaaccacgataaatcctccggcaacagccaatcccttagtaatcacttcaggaatagcattcaaagcggcgttaacagggccagcaccaacggccataacaattaccgttgggatagcgatacgcaatccttggaagaccaaagccaaccagtgaacacgttcaactcctgcaacattacccttttcggcttcacggtcagcgatgtgtgccaaggcaaccgtaattgtacgaacaccaatcgtcaagatttgtccagcaacggccaaaggaattgcaatagccataccagtcttaacatcaacttgtgctggtccagttaccaagtaagctgaaacaactgatgccaaagcggcatcgggtgcgatagcggctccgatgttcatccatcccaaagccaacatttgcaacgttccaccaaggattacaccttccataaggtggccagttgccaatccaatcaacgttgctgcgaccaatggttggtggaattggaactcatccaaaataccttcaacaccggccaagaatgcgattagaattacgaaaaacgctgaaatcatgcgttcatcctcccaaataatttcttagcaataaagtaacatgaaatataattatgacttcttcaacaagtcgaagatgtccttactttggtcacttggcacctttcgaacatcgaaagaaatgccttgatcacgcaagtattcaagtgtcttcacgtccgcatcatcaaccgcaactgcgtttgtaaccatgcgctttccctctgagtgagacattgaaccgatgttaaccttgtccaacttaacgccaccttccactgctttcgcaacatcttgtggtgtttcaaacaaaaggatggcctttactgccgcaaaacgtgggtcatcccacacgtcaatcaacttttgaattgggacaacactaactttgacaccaactggtgctgcttgcaccaacaatgtcttacgcaattcatcctttgccacaccgtctgatacgacaataatgcggtttggttgaactgactttgtccacgccgttgccacttgaccgtgcaacaaacgtgaatcgatacgggctaagcgaacatcgattgtgcgctcaccactgtgcttaacctcgttaatatcaccaactggtgctgcgaccggcgcatcttcagctgctacttgcgtatcagctgccaccgtttccgctgcttcaggcaatgacttaacaccgtcgcgggcaactggaatcaaataatgtgcgatttcagctgcagtttccattgtgaatcgagccccataagcttcaatcaacatcggcaagttcaaacctgtaataatggccatttgatcttcatgcaacgcttgaatacgtgatgctgcgttgaatggtgatccaccccacaaatcaaccaagaacaacacttgactgtttggttcaaatgttgctaatgcatcctcaaacttcttcatcaagtcttctggaccttcgttgggcataaacgtaaccacttgtacgttctcttgctcaccgaagatcatttgacctgactgacgaatgccggctgcaaactctccgtgactagcaataatgaaatttaccataattgccacgctccttaatttattaatcccttaggtacaaaacaaattgtacagtacattccggaatatgtaaacgctttcagtgaaatatgtttgcattttatgattattccgataaaactggatgtttttatcctagcgtcagtatttgtgtaatctatgaattttttgctgtattacactaacaatgtgattataccgccattttaaccaacattacgtcggcgtttaaatgttcatattcccttgaatgttataatattatgacttctttaagggggattaacctatcatgacggcgttaaaacgttactggaaaaatatatatcttctatatagcatactatttttattggtcgctgctgctgttttcgtgccctattttgtaacaggcacctcattaatctggcaaagtgacggcattgcccaacattttcccgccttggttgactggcgtgtcactttacgtcaactgctgtttgatcatatttggccagcccagtggcagtggcggttaggcctcggcgctgattatttacaaactttttcttattacactttgggtgacatttttacgtatggcgtagcttttgtcagtcaagatcacgtcttggcttactacaattacagcgttatcgttcggctttttcttgctggcctcagctttttatttgttgcccgtcaatttataccacgagctccccattggtccttgatccccgctacattttcatatatcttttttggttacacggcatttgccgcatttgaacacccattctttttgaacccgttgattatctttcccctccttatttggtcgctcaaccggttattagtaacccataaaacctttttgttcactattatcgtgacttggacactgtggaataacttttattttgccttcatgatggcgttaggcgcactgctgttctggcttggttacctatatgcaacccgaagctggtttaattggacacaacatttgcgtttattggtggcaacaggcattgggactttaatgccaatggtccttttgcttccgagcctcattagtgtcctggattcagcacgtagcggtaaaacactagccaacggcctcatactgtacccagcttattattatttcgggctccccggcaacttaatcgctaactttgcgacaccagatttttgggtaacgggtggtttcagcgccttagccgtttttgcagtcatctatgctttgcgccattggcatgaatacaagacgtttaactgggtattcattttagccggcgttggattgctcctccctgcctttgctggcatattaaatggcttttcatcgccatcaaatcggtggttattcatgatttcgttacctgttaacttaatgatgattcactttttgcagcacttgcgtcgtttgacactgcgcgactatacctggttcgccatcgttggtgtcatcgccagtttatcgctatttatcatgagtgattttagtctcaactcgcgctttagtccgatgattgcgctgtacgcgattagcctgctgttaatctggtctttgcaacatcatcctacccagcctggcttaaaggcactgatgatcgctgtcgtgctgctaaacgtcacatttattacaaatcgtaatcataccaataatacgaatccggcgacctctgacatgcttagtgagcggagcattaacaaactgctacatggacagcgtgactacttgcccgaaaataccgctaacccctctttcagtcgggtttacatcgacaatcaattaggcaacgcaactgggattgccccaactacgaacttgcccatcctcagtcagactaataacattgaaagttactggtctgtccaaaataaggcggttaataccatgatgcaacgcttgcaaatcgctggtagtagccctaacgacatcactagtaatttggataatcgtaacattctcatgaatgttttgggcgtcaaaacacgctatcagaacagctcgactatgaccccaaattcgtacgaacaaaatgccaatgtgagcgttaatcatcagaccgcattcacttcgtcagacagttatccgcttgtatatttacctaaatatactgtggctgccaaagactacggcccaatgactgccactgaaaaggaggctactctcgcagatagcgtggttgtgccaggcatgcgagcgggtcaatcttctgcctttgccaaacaaatcgtctctggcgtaatccgaactgatcaaaccaaatctgggcaaacgagtttgcattaccactataagacgcacgcgtccctgttacctgatggcattttcttaatggccaacaaacagttacgtggtaccgagctacatctcgaaattagtaacctacgttataccccagctaagtttggtcagcgccaacaaaatgctttggcagcgtatcagtattcagcaacccaaaacgcccgcaacatgcagagtagccctaacatccgctataatcccaaagcatttacgtggaactggacacagcatcatttggatacaatcggtacggaatacgctggctacaaactaacagccaattataatgatcatgacgtctcattcagtcagaccgggcaaacaaatttgtcattctacaatcctcagaacgcggtaacgttgaatttggggcaagcaactgattataaaaacgaacaatttatcccgttaacttttagtcgtgatggtgactactcatttgatgtgcgtattgttgggataccaactgataaacgctttagtcgggttgcccgtcaaatccaaagaacagcccctaaattgcgttttaagcgcaatcaagtgctcaccacaattcgtgtgcagtcacctcgtatgttagcgacaacaattccatattcaactggttggtcggcaaatggccgccaccttgtgaagataaacgatggtttcatcggtataccactgaaatccggacaaaatcaccttgtactcacttatcagacacctgggttaaccatagggctttggctgagcttgttagggggtgtgctcagtagtattgcccttgttttgaaactaatcaaacgtaaatagcgcattgtcaattataaaaaaggcgccagcagagatgatttttagcatcctgctggcgtctttttatgccatatttatttaaacttcattaagcaaatttacctgattcatctgccaaaatcagttcgcgttcaattttatctttagcacctaatgcatcaaaccatgtttctgggaattcatcataggcgaaactggcaatcacaccaactaacgcggcaattgtatcggtatcctcacccaatcccgctgccatcataacggcttcttgataactcgtcgtgtgtaataacgtccacaacacggcttttaacgtatctacgacgtaaccagtacttggcacttcagtacgcggccaacgcttaatagttgctatcacatcctgtgcagattggctatcggttacagctaaccagcccaaatcttcagtttctaaggttgccgtttccattgcggtacgatttgaacgccgaatggccatctctaacgcccgttcaatgtttttcactcttggcatcatccgcaaaagatacacaaaaaagcgagacgccaatcgtgcgcgccggtgtccatgtgtcaaacaagtgagctgatcgataacattctctaacgtcaagtcagctgtaaaatcataaaaggcaactggccaaatccgcattaatgcaccgttaccgttgttcatgtcatcatccgctttaaaagggatcactttatgcgtttccttgtacgttaagatagcctctcgcgtgccgatgccaacatcaaacacatcttgatacggcgtgaatgcagcatcatccaaataagacacaaagttatccataacgttaactaattcgtatggttcaaacagtgcattaatcgttgccagtgttaaactcgtatcgtcgctccaggtacccgccggttgaaaatgggtttggtagccaaccatctctgacttaacctcgtacgtatcacgagccttaaattcatacggcacaccaaacgcatcacccattgcgaaaccatagagtgctcgccgtaacattgttgctgccatactgccctcctagataccttccaacgcaaaccaatcagcaatcgatagccactcttgggttgatttagctaagattgtataaccagtaatgtcatacaaggtcttacgatcccccttaagtggtgaccaataagtatcatcagcgcggcgaatgacatcccagtacgtataggtctcttcttgaccagcttcgtcctttacttgaaacccatcggccaagttaaagctcttttcaccaacttgaggtccaccaacacctaaatcaacgagtaattgttgataggattcatttgtaattggttcatttgccatgtcacaatacctctttttcaaaagtctaatagcattattctaacacttgtctgataaaaaaagacccaggaacaaatattcctgagtctttttacaatcgggacgacaggattcgaacctgcgaccccctggtcccaaaccaggtgctctaccaagctgagctacgtcccgatattctcttattcaaaataaaaagcccgttaccggacgtttcattttgaaatgccgtcggtgggggtcgaacccacactcccttgcgggaactggattttgagtccagcgcgtctgcctattccgccacaacggcattttattaaacattacgtcagggcggtagatgggaatcgaacccacgcatgtcggtaccacaaaccgatgtgttaaccacttcaccactaccgccatggcaggggtagagggaatcgaacccccaccaacggttttggagaccgtcgttctaccgttaaactatacccctaaaataagacgtaatatttaattatacggtcacaacgggattcgaacccgtgatctttcgcgtgacaggcgaacgtcctaaccaactaactatctaaataatgacaaaacaccccaggtccgcagccatgaacctggggtgttttttaagttgttagtctgcgtggacgataaatgtattaacgcgtgatgttcgcgaaacgaattctgtgacggaaccttgcattaaccgttcgacagcattcataccagttgcgccgatgacgattaagtcgatgtcatattgggcgggaatcaccttagcaataatgtttttaggattgccagtttcgctgatgacggtcaaattagtgacgccggcttgttttgcttcagtagcaaaacgttctaaaagtgctttgctctgtgcaatcgcgttttcttctaactcatgtgagtaatgcgccgcgtcttttaacttattcgtatcgaccacgtttaagatatacaggtgtcgtgatggcgtgttattgacaatttcgacagctgttgcgaaggcggcttctgattcttttgagccgtctacaggcgctaaaatatgttggtagttatggattgattgcatcgctgaattcccctcaaaatgttcattgcctttattgtacacgattcaaacaaaacccggctattctctttggataggggtataatgatgggtaaataagttaaaaacgaggccagtaaaatggaatatcgaacattatcaaacggtgtggtcatgccagtattggggtacggtatggcacaagtgcaggggcctgaggcggtgcaagcagttaaggacgccattgcagcggggtaccgggcgattgatacagctgtcatttatgataatgaggctgacatcggtcagggaattgccgaatctaatgtcgatcgatcagatttatttctgacaaccaaggtttgggtgcaggacatgacttatgagggggcaaaggcgtcagtgatgcgttctcttgaattgctacaaacggactatttggatttggtgttattacaccacccaattggtgatgtttggggtgcttggcgggcgttggaagagctttatgccgccggtaaaattcgggcgattggcgtgtcaaatttctcaccagcgttgttagcccagtttattgcgcttaatgatattgcgccgatggttaatcaaattgaaaaccatccattccaccaacaagttgataaggtagcgtatttccaagagcaaggtgttttggtggaagcttgggcaccattcgctgagggcatgcatgatgtcttccattccccaattttgaccgcgattgctgataatcatggtaagtcagttggacatgtcatcctccggtggttgttgcaacggggaattagtaccattccgaagtcaatgaagccagcacggatgcgcgataatttaaatgtatttgattttgaattgactgaaccagaaatggccgcgattgccacaatgaatacaggggaaactttgtttggcggttcggataatccggatgttgcacacgttgagaagatgctgaactggacagtcacacactaagataggaaaaagatgggatttattatcatattgattttggtcgcgctgtttgtgtacacacaatcacgcaagcgacgtcacgatcacgagatgcgtcaaaaagctgactatcttgaaggtaaatttgaagacatcacgaaaaagtaaatgctaagcgtcaattcagattaatgagttgacgctttttacctatcgtcaggggccgaattaccctgtataatagacgttgacagaaaaaattagagagataggaggcgcgataaaatatggacattgcagaaatgaagacgcgccagtctcacattcgtaactttagtatcgtggcgcacattgaccacggtaagtcgacgatttcagatcgtattctggaagcaacgcacacggttactgaacgtgagatgcaaaatcaattgttggacacgatggatttggaacgtgagcgtggtatcacgattaagatgaatgccgttgaagttcactacaaggccaacgatggggaaacctacattttccacttggttgatactccaggacacgtcgacttctcatatgaggtgtctcgttcactagcagccgctgatggggcgattttggttgttgacgccgcccaaggtgtagaagcccaaacgttggcaaatgtttacttggccttggaaaacgacttggaaatcttaccattgatcaacaagattgacttgccagctgctgatccagaagctgtccgggctgaaatcgaagatgttattggcattgatgcatctgaagctgttttggcatcagctaagcaaggtatcggaattccagaattgcttgagcaaatcgtggcgaagattcccgcgccagagggagatttggaagcgccattgcaagcgttgatttttgactcagcctatgattcctacaagggcgttattttgactgtccgggtgaaggaaggtgttatgaagccgggtgataagattcgcttcatgaactcgggggctgaatacgaagtcacagaagtgggtgttaactcaccacaccctgtgaaacgtgatttcttgatggctggtgatattggttatgtcgctgcctcgattaagaacatccgtgacgctcgccctggtgatacgattacgtcagttaagaacccagcggcggaagcgttgccaggttaccaaccaatgacgcctatggtgtactcaggtttgtacccaacggataactcaaagtacaatgacttacgtgaagcgcttgaaaagttgcaattgaacgatgcgtcattggaattcgagcctgagacgtcacaagcattgggatttggtttccgtactggattcttgggcttgttgcacatggatgtggtgcaagaacgacttgaacgtgaattcgatatggaattgatcacgacggcgccatctgtaacgtaccacgcgtatacaacagacggtgaaatggttgaagtggccaacccatcagaattacctgaagctagtgccatcaagtggattgaagagccatacgtgcacgctcagattatggtgccaaacgagtacgttggggcagttatggaattggcacaacaaaagcgtggtgaattcgatacgatggattacttggaccaaaaccgcgttaacgtgaagtactacattccgttgtcagaaatcatctttgacttcttcgataagttgaagtcaaacacgcgaggttacgcgtcattagattacgagatttcaggttaccgccagtctgacttggttaagattgatatcttgctaaatggggacaaggtcgatgccttgagctttattgtgcacaaggattttgcacaagaacgttcacggattattacggcgaagttgaagcaaatcattccacgtcgtaacttcgaaattccagtgcaagcggccatcggttcaaagattgtctcacgttcaacgattaaggcttaccgtaaggatgttacgtcaaagatccacacgggtgaccctgatcgtcgtgcaaagttgttggataagcaaaagcgtggtaagaagcgcatgaaggcggttggaacggttgatgtaccgcaagaagcctttatggcggtgcttaaggccgaagatgatacagaatttgcaaagggtgccaaccattaagcgcgttttacgtgacgacattcggaaaattctttggttaagagtctaccattcttactgaagatatgttattatattcaggttaaataaactgactctggttcttatagatccagggcgataaggagaaacacgatgaaggctgatatccacccagattaccaccaagtggttttcgttgattcaactactggttacaagctattgactggttcaactcgtacttcaaacgagacgatcgagttcgaaggtgctgagtacccaatgatccgtgttgaagttacgtcagattcacacccattctacactggtaagcaaaagtttactactgccgatggtgcggtcgacaagttcaacaagaagtatggacttgcctaagggcaattcatcagaaacgccggtatataggtttaaacgcctatataccggcgttttcttttgttttcgtataaccaattatccacgataaaaaccagctaaaatttatttttgggcacactcgggcacaaaatgggcacacaaatttagtcatcaaatagagccaacgtcttgtcagactcagagtttcttttggtagatagcaaatgaaaataagtgttctgtgtaattgttactgagctatgtccaagacgctcactaacgtatgcaacgtcaattcctttactaattaaaaaactggcgtgagtgtgacggagtccgtgtagcgtaattggcttaatacctagttctttaatcatcttacgaagatagtgggatggaacggactgagtcgttttttcaccaaagatatgttcttctaattttggatacgcttttagaaaacgttcaaattgtataaagtagcgatcgggcattgcgataacacgcgtagactttcttgtctttggtgtagtgtactcgtaaggcggacgattcgtctttgttttcgtcacagagattgttttatctgccacattaatatctttcaacgtgagcgccaaaatttcaccagcgcgcatgccagagagtgctgcggtatatattgcaaagtgtgcgggagttattggttcattttgaatgtattccaataacttatctaagtcagattcttcgaggaattttagttctccagctttgctttcagcccctttgaatttagcaccatgtgtggggtctagtgacagaataccgtcactaaaagcttctttaatcggcattgcaactcgcattgaaacttggcgaacggtgctcgaatgatgattaacagcatattcatcaagaaacttttgataacgtcgccgagttaaattttcaagttttacgttcttaaagtattcgtgcacaattttttgagtagcaagatgatttaaacgcgtctgctgtttgatgccagattccagatgacgttcgagccagtcgtcatagaattcagtgaatagaacacgggttttatcaatctcaacaccagaattcaactttgccagtaagtccgcctcccaggctttggcagcagccttagttgaaaaatcgctctttgtccatcgtcgtcgcttaccttcaatagtcttgctgacgacaactcgatactttttacctaactttgataccgacatataaacttaaacctaacctttatctaaaaattttaggtagtttaaagacatgcccaggtctggtacaattaaatgcataagcaggacattgctgttctgttttggataacgcgcacatttccttgtttggtcgcaggatgtgcgcattttttgttataacaaaatattgttaacggtattctgtctgatagaggtatttgaagtatgaaatttggtatgcggaagccaagtcccatgcgttctattaaagctaggacaactggtaaggctaaacgagcagttaagaagtcaattattccaggttatggtcagaagggcatgggctggttaacagatcctaagaaagcggcttacaacaaagtctataaaaagaccacctttagtattttcgatctattcaaataattcaccagtactttgccaccttaacgggtggctttttagtctatattaatgcctttttctctcaaattttcaatacactcaattaaatagatattgtcatgctctgggtaaattggagaagtcagaacttcacttgatagtgaagtataagcagcttccttagttccacggtacaaggggtctaaccataattcgttaggtgtatatccgcgacttagcatctcattcattactagttcgtgatattgaaataatttatatggtgagtgatcaaagacgtaattcacagttgcatgtttcttaccccaaccgccgccgcgaagcgcacaacactctctatgttgacccagcaattgctgacgagggagtttggggattaaagattcgtgccacaatctcatattaataattcctttctaaataacgttgttagtacgtccaatttttaaagaagcaaagatagataaaatttgctattgcgaaaccaattatccatgcagcagctacatatttaaaataagatcctttcgttttaaagtaagcatatagagatagagagactagcaataataatgtgttgacgattattaaaattgtacgtaccaaacgaatgcctcgctttcatgcttgcataaccgcttcgcgggccatatcttcaaagtaagaaggcagtcccaaggattccataaaattaatgtaattacgatattcaacaggcgtgtcttggaatacatacttagcgattatatgcatcgcttgttcgtgtgcaatgcgctcggatgatttagttgccccgatagaaaaagcataaacacgattttgttcaacactaccaaataaaatgtgtgataattcatgcgctaatctaaatgccactgacacgttattattactatttctattgataataaccttacgttgagatggaacgcttaaatcgggagtataggtgtccaaatcttcgctaaaaactaccttaatatcatttctaatagcaataaataatagatagtttatgaggtcagtcatccatgtcctccaaaattcggcgaattatgcgcatttctgcctctggtatatctttaccgtcatacttaaggacaggagtagagtcgataaactcttttaaatcatatggagcgtctttcttattactgtgcatctcatcagtgttacctaataggtagtctactgatacgccgaggacgtcggccacggcttgcacattatcagttcggggtgttttatttttccaagagtatatagcgttttcgcttaatccaacttgtttagccagatttttaaggttagtaccacgtaatttcgctgtttcttttattcgttcaaatacagtcatatcaaagctccattgagatttgatgaaataaaagtattctaaagttgtttttgttgttgacaaaagtattctttagaattatagttaattcatcgagttaaacagcaagcaaaaataacttaaatatcaattgcttttggacgagctaacgttgatatataggtttttgcaatgcttatttttctatgcctttattgtattctttagaatacttaaagtcaagataactctaatttaacttcataaacaaggaggaaacacatatgagtgttaaggaagcgcgtcgtactttaaagcgagcgtatagtgattttcaatttcatttagatgaaaacgaagtatctcggaaagaacttgcggaggtaatcgtcgtctcacaaatatttcatatctctgagacgacttaatatataatacagaatgttttttgatatgtcaacaactttgttgaaccatattttttgtcgctttctttcaaaagacaacttaaatatattacctcgttcatagcatgaatgcaacccccaattttcagaactttgccttacgcattttctataccgtgatatactggtaacagttataaacgaagtaaggaaatatatatggcaaataaagcagaaaaggtggacgcagctgaattcttagcaatgttgctacagtacagccgtgatttccactacaatcacatcaacgttaatgttcgtttgaatcgtaaccccgcatacacacgtcaggtaatgaatgtcatgttgaagcgtaactcaaagaagtacggtaacgacgaacgtctatatgcatcaatgaccgccgacgaagcaactaagtttcttgcgttaatcaatcagttgaaggaagatatgtttgcttcttttgctgataagattacttggcacaccgacctattggtacgtgaagagcaagaatttggttatcgtcaaatccgcgaacgcgatcaatacaacaacctagaatttgaacttttgctctaatcttataaaagcccctagttattcaataactgggggctttttttgcgcgcaatcctcatcttattttggtacgctgaacacaaatcagagaaaggacacccacttatgtataagcaactctttgttttcggtagtcggttgcttggtctcaatcacgtttggcagttgtctggccaagcattctgggaagagttggctgaaaagcctgcgattgcagccgagccgagcgcgaaaatgcgacgtgacttcgccatccaccatcatgactacctagatattatggcccctcgtcgctgcgatattaaaacaacgacagatattggcctttatctacacggcggtggtttcatcgaaccgattactgcctaccactggcattttatcagcgatatcgtcatgaatactaatatgccagttgctgtcttagactatcctctcgttccaaacgcaaatttggatgacatttatgaacgcatgcaagacgctatttgggaattgcatcatgattttcctgaagctaacattagcttaattggtgatagctccggtgcgcaacttgccttaggctatacacaattaattgaagccttacctattaagaaaatcgtggctatcagtcccatggttgatatgactttgtctaatcctgacatcaaaacaattgccaaacgtgatccagttctatccttacccgcgatgcctgatgtcattaaagttattagtgaacaccatagcctacaagatgccgtggtatcaccgctatatggtaattttgataaccaacatatcttacttattagtggtacccgtgatttaactaatcctgacaaccgactctttgccacaaaattcgcggcaaacgtgacttacattgaaggggaaggattaccacacgcctatccaatttggccattaacccggaacacctcagtcaagcgtgacatttatgattttttgatggggcacactgatgaaatttgatttgaaaaaagaaggtaagccagaactaaacaaaacccggcgtccggccttactaaccatacctagtcactattacttagcaatcaccggcaccggcgatccaaacaccatgaactttggtgatcacatcgcagcactctatgcgattgcttatccaatcaaaatggcttataaaaaaacaccctctcatgatagtcactatactgactatgttgtgccaccgctctgtggtgattggtcgatctccgaagcggcaattaaccgtgagagctgggacaagacggattttgtgtatacattacgaatcatgatacctgattttgttcccttagcattagcctcaaagattttagttactaagcaacaacaaactgaagacaagcttttacgagaagtcaccatcgttaaactgccggcgcaagaggttgttcaaatgttacacgttggtccttatgacgaagaacaaataacctttgattacttaacgatgttcttagaagaccagcaattacagcgcacttccaaaacgcacactgagatttatttaagtgatgcccgtcgaacagctcctgatcgacttaaaaccattctgcaaataaccgttgcgcgtaaataaagaccccaccaacgctttcgtcagtggggtctctttttgctatcgtagtggttcactataaataacagtcaactcttctagaacaacatgcaaacgcgttaagtctagtaactcaccagcttccgcaaactctgctctaaaaaacggttcatgaacttgtcgccagtatgccaaactgcgatcaccttcaccttctgcgtaggcatggcgctcatcaacatcagcatacttgcgcacttcaacattagtcgtgcaaataatggccactggttctcctgccccgttaagcaaaacatcataaccctgcttagcaaccgggattggttcattctcaagttgatataactcatatgcgcttgctgtggcagtcttaatacctgttaatgtcaaacgtgccaagtcatcagcttgctgtgaccctttaccaaacgcccaagctgaaccaaacacagccgttggttcattcatgtccgtcttaaattgtttccaatattttgtaacgttatctgtcatgttgtcccccttaaccacttcagtctaccaaattcactgattttgtgcttatctgtgatttgattttcggtcaacaacaaaaaaactgagcacgccatgttgtcgtgctcagtttatagactgtctattaatatgtctaagtcctactcggctggcgcttcaggaactggatgttgggccgtatacaaggccgcaataataccatgtgcaacagatacgttgagtgaccgaactgaaccggtttgtggaatgtaaatcatcgcatccgcagcttgaatcaattcatcagccaaaccaatttgttcctcaccaaataagaaaacacttttctccggcaagaccgtttcaaacacgttgtgtaattcatagcctggtgtattatcaaccgcatagatggtataaccttccgcgtgccattgatcaaatagtttttgataatccgtaatcttgtgatgtgaaatgtgctcgtagtgttgtgcaccaaccgcgccggtcttattccacttcttagcgccttcttcattttctggatccatgggattttcgggatttaagaagacaatttcgcgccctgaaaatgcgttgtggttacgcacagcggttgccttattaaaatcgtgagttaaattttgaagcgctgtaatcatataaccacgtcgttggtctaaagcttgcatgatatcttcgttcgtcatgcctttaaaatcatcacccaagttacggtagtcaatcgcattttttaaatcaatcttgctcatttttctatatctctttaactgtatttctgttcaagttgttagttagtgcacccaatgttttgtgagcgcattttcagtcgtgcggtttagaattggtccttcaacaattgacgaatctcttccaaacgaggttgacgtgggttacctggcgtcgtttggtcgttgtaaaccaagtcaggcaacgtgtccaatgacttctcaaagtcagcctttgaaacaccgttagctgacaatgaaggttgtacttcaacaccggcgaacaacgtgtcaatcttagccaacaaagcgtcaaccaattcagcgtcattcttaccttgcaaaccaaggtagcgggcgatatcagcgtaatccttttgggccgtgtacgtctcgtaacgtgggaatggcgtacgcttaacgttaccagttaccgcattgaacttaatgacgtgcttcatggcaattgagattgccaaaccgtgtggcaaaccgaattctccaccagtcttgtgcgccaaggcgtggttaattcccaagaaggcgttcgcgaatgacataccagccaacgttgacgcgtagtgcatctttgaacgggcttcttgaccttcctttgatgggtgggctgggtcgtacttgtatgacgtctccaagttatcgaagatcaacttgatggcttgcaacgcccatggacgagtgaattctgaggccattactgaaacgtatgactccaaagcgtgtgacaaagcgtccaatcctgagaaggcaaccgtacgctttggcaccgtcatcacgaactctgggtccacgatagccacttgtggtgtcaactcgtagtcagccaatgggtacttcacgtgcgtctcatcatccgtgataaccgcgaatggcgttacttctgaaccagttcctgacgtcgttgggatggcaaccatttgcgtcaagtgttggtgatcaaacttcacgatacgcttgcggatatccatgaacttttgtgccaactcgccgaacaattccttcaaggcagcatcgtcgttcaagatgccttcgtggccctcttcagctgagtactcgtacaagaagcgggcaatcttaccagcgtcaagcgctgaaccaccaccaatcaagacaaccgtgtctggttggaattcggccatttgacgggcaatatcgatagcttgaccaattgttgggtctggttgaacagaaccgtagattgatgtctttacttggtccgcacggagtgcgaattgatccaaaatcttgtcgacgaagccgaacttgaccatacctgggtcggccacgataaaggcgcggtcgatgtttggcaattcttgtaggtacgtaatggcgtttgactcgtagtagatgtcctttggcaaacggacccattgtggacggttacgacgacgggcaaccgtcttgatgttaagcaaatcgtaagtagacaaattgtgtgacaatgaattcttcccccatgatccagttcctagcgtcaatgatgggcgcattgcatccgtgtagatatctcccacaccaccgattgaatctggttggttaaccaagatacgtgatgcttcaatcttatcagcgtattccttaacgaatggatcgtcttgggcaccgatttggatagcagcgttgtgaccagcaccttggtagttcaacaaagcgcgaacgatttcaatggcgtcctcacggtcagcagccttgtagactgacaacaaaggactcaacttttctgatgacaaagcttcaccgatgttcttcttgtccaattcgaacaacaaaacatccttatcttctggcaacttcaaacctgattgctcggcaatccacttacctgacataccagcaaccggtccgttaaccccgtaaccttctgcgtttggcttgaagacaaagttagcaaccttctcgtagtccttctttggcgtcaagtaagcaccttgttcttgcaacttgcgcatgacttcgtcataaacaggggcttcgataaccaatgagttttcagtggcacagatcataccgttgtcaaaacgctttgacaatagcaagtcttcaaccgcacggtcaacgttagccgttccgtcaacgaacacagcaccgttaccagcaccaacacccattgatgggtttcctgacttcaaagcggcgttaaccattgaaggaccacccgttgccaagattgacgcaatctttgggttttgaatcaacgtcgttgtcccatctagtgatggcgtgtcgatccattggatgaagttcttaggtgccccagcagcgacagctgcatcgtaaacgatcttagcagcgtgcgctgatgacttttgagcttgtgggtggaaggcaaagacaatcgtgttacgcgtctttgcggccaacattgacttgaagattgtcgttgacgttgggttcgtcgttgggacgataccagccaaaataccaagtggcgctgccaattcaaccttacccgtaacgcggtcttctgagataacgccaaccgtcttgtcgttcttgatagcgttgtaaacagattctgaggcgaaacggttctttgtgtccttgtcttcgaccacaccacgaccagtttcatcgtgcgcttcgtgggccaacaacaatgagttttctgaaccagccaaagccattgcggccacgatcttatcaacttgtgcttgtgtgtacgttgagaattccttcaaagcgatttcagacttgtcgaccaactctgacgtcatcttcttagcagcttcgaaacgtgctgccttttcttctgccgttaaaactttcttcttaggtgcatcagccatgatttttacctctaaataatctttcaaattttcgtttgctcatttattaacataattagtatatcatttcacaaagagttgtcaacaccatttgccaaaattcattatccttaccaaacatgcgttaataccaacctttcgaactgattttttctacacgtgaataatatcacataagagttgataggttaagttattaagggcgcatggtggatgccttggcactaggagccgatgaaggacgggactaacaccgatatgcttcggggagctgtaagtaagctttgatccggagatttccgaatgggggaacccaacttgttatgcaagttatcacctaatgaatatatagttaggttgaaggtagacgttgtgaactgaaacatctcattagcaacaggaatagaaagaaaaatcgataccgtcagtagcggcgagcgaaatcggtagagcccaaaccaaagtgcttgcactttggggttgtaggactgacattgtggagttacaaagttagcgtttagcagaatcagctgggaagctgagcgagacagggtgatagccccgtatgcgaaaaatgttgacctcccgtcaggatcctgagtacggccggacacgtgaaatccggtcggaatccgcgaggaccatctcgcaaggctaaatactccctagtgaccgatagtgaaccagtaccgtgagggaaaggtgaaaagcaccccggaaggggagtgaaaaagttcctgaaaccatgtgcctacaagaagttagagcccgttaatgggtgatagcgtgccttttgtagaatgaaccggcgagttacgataacgtgcaaggttaaggtggaaagaccggagccgtagcgaaagcgagtctgaaatgggcgaattagtacgttgttgtagacccgaaaccaggtgacctacccatgtccagggtgaaggtgcggtaaaacgcactggaggcccgaacccgtgcatgttgaaaaatgctgggatgaggtgtgggtagcggtgaaattccaatcgaacttggagatagctggttctctccgaaatagctttagggctagcctcggaatgtagcgtgttggaggtagagcactgttttggtgcggggcccatctcgggttaccaaattaagataaactccgaatgccaatcacgtatgtccgggagtcagacagtgagtgataagatccattgtcgaaaggggaacagcccagatcgtcagttaaggtccctaagtgtgtgttaagtggaaaaggatgtggagttgcatagacaactaggatgttggctcagaagcagccaccatttaaagagtgcgtaatagctcactagtcgagtgattctgcgccgaaaatgtaccggggctaaacacaccaccgaaactacgggtgccacgtaagtggcgcgataggagagcgttctaagggcgatgaagtcagaccgtgaggactggtggagcgcttagaagtgagaatgccggtatgagtagcgaaagacaggtgagaatcctgtccaccgtatgactaaggtttcctggggaaggctcgtcctcccagggttagtcgggacctaaggcgaggccgaaaggcgtagtcgatggataacaggttgagattcctgtaccaggtgaacatgtttgaacgatggagggacgcagaaggctaacggatcccagctgctggatatgctgggttaaataataagtcttagatcgagttaaatgctttatcttttaaggacaagttatgatgaggaccgaaataaagtagggaagtccgtgatgtcacgctgccgagaaaagcttctagttagtgtttacctgcccgtaccgcaaaccgacacaggtagtcgaggagagcatcctaaggtgagcgagtgaactctcgttaaggaactcggcaaaatgaccccgtaacttcgggagaaggggtgctcagcgaaagctgagccgcagtgaataggcccaggcgactgtttatcaaaaacacaggtttctgcaaaatcgtaagatgacgtataggggctgacgcctgcccggtgctggaaggttaaaaggagtgcttagcttcggcgaaggtacgaattgaagccccagtaaacggcggccgtaactataacggtcctaaggtagcgaaattccttgtcgggtaagttccgacccgcacgaaaggcgtaacgatctgggcactgtctcaacgagagactcggtgaaatttaaatacccgtgaagatgcgggttacccgcgacaggacggaaagaccccatggagctttactgtagcttgatattgagtgtttgtgcagcttgtacagcataggtaggagccgttgataccgggacgctagtttcggtggaggcatcattgggatactaccctcgttgtatgaccactctaactcgcaccactaagcgtggtggaagacagtgtctggcaggcagtttgactggggcggtcgcctcctaaaaggtaacggaggcgcccaaaggttccctcagaatggttggaaatcattcgcagagtgtaaaggcacaagggagcttgactgtgagacttaccagtcgagcaggtacgaaagtagggcttagtgatccggtggttccgcatggaagggccatcgctcaacggacaaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggagctgcccttagtacgagaggaccggggtggacgtacctctggtgtatcagttgttccgccaggagcatcgctgagtagctatgtacggatgagataaacgctgaaagcatctaagtgtgaaactcgcctcgagatgagatttcccattctttatgaagtaagacccctcagagatgatgaggtagataggctagaagtggaagtgcggaccgttcacagatatttcatatctctgagacgacttaatatataatacagaatgtttttcgatatgtcaacaactttgttgaaccatattttttgtcgctttctttcaaaagacaacttaaatatattacctcgttcatagcatgaatgcaacccccaattttaaatcttacatcaccgcaataacgcacttgtatataacgcttgttgcaggataacgatgtggatatcaggtagcattaatagacgcacttcagtaagtacaaagatggcacagacaaaccgacactgtgcgatcgtataaagcgccacgccccctcattatcaaagcactcgatgacaaacctaaagatgccccgcaaccaagctactaatacctaacatgccatcaacaggtcgcctaaacgataacctcgtcagagaattctgctatttagtcagattatagttcaacagattaactttctctaacgacgttggcatgcatatgactactttaccgacgactaccattaacacgcttattgattactaagcctataggcgcatccacactaatcggggctattgctgccagacgattcaccaattacgccagattaactggcaaatgatgaattttctctaaacacatcacgtcatgaccgttcctgtcttctggccaaacgatgaattcatctgaccaaaccgtcataatccccaattattattaatggatcctcgctaaaatctgatgaaatcgcaaattagtctgaccatcccgttatccttttctcactcatagcgcctactataggcgttctgccaacaacgacaaaattgattacagcacgcgcgcctgataaatgtcgcttttggccaggtaattgtcatgaatacgtactaccggaaatgcccccaccccatttggtcagataaaactcactgctagtcagataaaggagccgtttattaagtatttctaacggcctatctacgaataagccctgtttatctgcctaatcgagtatttagtctgactacacccgcaaaatccacctcatcttggctattaccgcaaatgttatctgtccaaatcgcacttttgtctgaccaaacgtcaaagattacattctatactgccggttacttaaccctgcgcgattgtaaattacagtgccactcactaatttaaggatttggtgcacttaattcgctgatgctactagcattgcgtcagattataatggcaagtattaacattatctaaagtatcctgggggcacgttagacgttttatcccaatgcttgctgtaatcctagcctatcgtctccccccagaaatgagttatcacctggactcagctgttatatctaaatgaacgcagcatttactaaccttaatcgctggtaattctgtctggcgatatacccttagcttctgacatacctcagtttcaacgaatcagtttagttagatcatccatcgtaatctggcaaaaccgcaattccttctgaccttacatcaaaacaactaacgctgctatttagggtatcgctatttgtccgccgtaacgcatctacccctagtaagcactatcaagttctggcttggtttaatcaggggcaacattctccatctgctttataagccgtagttaatcggctgcctcacattagaagcgacctgagtatcggtgattatataatatctgtgatgtatccaaatcatattcatggcgagctattttaattcttagccaatcttatgtggatcactagagacgcaagtgcaaaattgagctcattatttgccattccgacaaatcccccttagtactagccagacgaatatgtctgtcagtcagacaaacgggtattttactaagaatttctaaaggcccctcgtctaatatgatgtatttgtctggcaaatcaaccaatccttctgaccatcacactcaaaatggtcaactatgcaatccatcgaacttgctaagcaggttgcttcgtttcttttaacacttcggtctaacagcaacaaaaaacaccagttacctgatgtaaactaaagtcaccaaaccaactctaaggggactgatgcttttaatggatgatacgttgattttaatcacttcgcctatagcagtaaaaataattcacagggttattatttacacggcactccgtttgaccgtgcaagatatttcataggaagtgcgttgattattcgcgttactcacagtcatctgttcgttatctcatcaacgacgaacttaaagattatcgttataactactaatcatttaccattcgataaattacgtcactgatatagctgttggaatttttaaatgcaattaaaaagcagcttagtaaacccacacttgatcgtgatcaaacgtaaaaattgtagactcaaggaaattgagcgcacgactatggttatcaaagcctcagcaattacctgcatcgtatccacattcaaatgaaagacagtagattctgaattattaaaaatgaggatcacatttctgtcatcctcactctttgaaagtcatccaatcacgttaattttcaattttatcacggcaactgtcagtcttaatggtcccttttttagccgtgcctcaaaaccaaaggtgcaacctgatcacgtcgattgtctaaagtctccgatattagaaaggaggtgatccagccgcaggttctcctacggctaccttgttacgacttcaccctaatcatctgtcccaccttagacggctggctcccgaaggttaccccaccggctttgggtgttacaaactctcatggtgtgacgggcggtgtgtacaagacccgggaacgtattcaccgcggcgtgctgatccgcgattactagcgattccgacttcatgtaggcgagttgcagcctacaatccgaactgagacgtactttaagagattagctcaccctcgcgggttggcaactcgttgtatacgccattgtagcacgtgtgtagcccaggtcataaggggcatgatgatttgacgtcatccccaccttcctccggtttgtcaccggcagtctcactagagtgcccaactaaatgctggcaactagtaataagggttgcgctcgttgcgggacttaacccaacatctcacgacacgagctgacgacaaccatgcaccacctgtcaccttgtccccgaagggaacgctccatctctggagttgtcaagggatgtcaagacctggtaaggttcttcgcgttgcttcgaattaaaccacatgctccaccgcttgtgcgggtccccgtcaattcctttgagtttcaaccttgcggtcgtactccccaggcggagtgcttaatgcgttagctgcggcacttaagggcggaaaccctcaaacacctagcactcatcgtttacggtgtggactaccagggtatctaatcctgtttgctacccacactttcgagcctcaacgtcagttacagtccagaaagccgccttcgccactggtgttcttccatatatctacgcatttcaccgctacacatggagttccactttcctctactgcactcaagtcatccagtttccaaagcaattcctcagttgagctgagggctttcacttcagacttaaataaccgtctgcgctcgctttacgcccaataaatccggataacgcttggaacatacgtattaccgcggctgctggcacgtatttagccgttcctttctggtaagataccgtcacacattgaacagttactctcaatgtcattcttctcttacaacagtgttttacgagccgaaacccttcatcacacacgcggcgttgctccatcaggctttcgcccattgtggaagattccctactgctgcctcccgtaggagtatgggccgtgtctcagtcccattgtggccgatcagtctctcaactcggctatgcatcatcgtcttggtgagccattacctcaccaactaactaatgcaccgcgggaccatctcttagtgatagcagaaccatcttttaagtagcaaccatgcggttgctattgttatacggtattagcatctgtttccaaatgttatcccctgctaagaggtaggtttcccacgtgttactcacccgttcgccactctttgcaatgtccatcgtcatatctgagcaagctcttcaaatcagttgaaccacaaagcgttcgacttgcatgtattaggcacgccgccagcgttcatcctgagccaggatcaaactctcaatttgaagtttgagtataactcaatttttgttgtttaacagaagttaaacgaatttactagcgaattgacttcgcaaatgtttttgcatgctcttatgctagatttacggacagatttttctctgccctgtaaactaatagcagaggagcattttttatatgattcgatattcaccagaatttaagcaatctcttgtcgagatgcacaaccaagggcgttcttacattgaactagccgctgaatacgggccttcggccgattcaatccgtaactgggtcaaattgtacacagtccacgaagtggacggcgaaaaatggacgcaagctgatgtaaacgcattacaaaaggaaaacgccaaacttcgcgaagaacttgagattttaaaacgagccgcggtgttgctttcgaagtacaattaacgcaaaatcgcgagttaggactggaaatcattgaccggtcactcgcaatgggacaccgcataacaagcgttttatcggctttgaacattgctcgaagcacgtattatcaatggaaaaactggcaacctagccaacgagaaacacggcgtactgctctgaaaactgcaattaaagccgtttataacaccaatcgtggcatctatggctaccgtcgtatcgcagcgttcttgcgcttcattttgaagactgatgttggtgatcgtttggtttgggaactcatgaatgagctcaatctcaaatctcgcatggtcaagaagtcatacaagaagccaacaacaaccactgacacacctcaaaagcccaacctcatgaagaagttggatgatttgagtggcgttctggcaactgacattacgtacatccagttgatgaatcgtgagtgggtttatctggcaaccgtctatgacccagaaaagcgtcgcgtagtctcatacggactaagcccagagatgaccaaggaattcgcaacatccgtcgtagttaaggctctaagagccaacggtaagccaaagatgattcacagcgacatgggaagccaatacacttctagcctgttcgaaggaacattacaaaactctggaataaatcactcttactcccgtaagggtcatccttacgataatgctcgtatcgagagcttccattcgctcatcaagcgcgaaatgatttatcacgaagagtacaggaccattgatgatgtccgggtgtctgtcgagtggtacgtgaactggtacaacaacagtcgcatcaactcacggactgattggcttcagaccgcctagaccaatgtctggtttacttaatctcggttatcggcactagccggtacgacgccgtttataagccgtcacttgtgaatttcaaaaattcgccttgtgaaggcttatttgttgcacgatacaacttgtgaaattcggctggttcacaatctataccacctgttttctctcaccggtagggctcggccctgttccacctacaaaaacacccagaaatcacgccgttttaagctgaaatccgggttttgaaaaattttcggagtgcggtacctctcggtgccaaaaaagcctgtccataatcttgacatcagcgccgaccatgcgaccaaacatttctgtttatgctgaactatttattttagttcaattgcgggagcaggatttgaacctacgaccttcgggttatgggcccgacgagctaccagactgctccatcccgcgataataatataagtgacatctacgatgtcaaaggagaatgtgggattcgaacccacgcgccgctttcacgacctgacggttttcaagaccgttcccttcagccagacttgggtaattctccataagacgttaaggtctaaaaatggaccttgttggactcgaaccaacgaccggacggttatgagccgtctgctctaaccaactgagctaaaggtccttgttatttgagtcaatcgcggcggggggaatcgaaccctcgacctcccgggtatgaaccggacgctctagccagctgagctacaccgcgaactataacatattctgttataaatcgggacgacaggattcgaacctgcgaccccctggtcccaaaccaggtgctctaccaagctgagctacgtcccgaacttattcatttgaaattagcaaactacgttcgctaatggacctagcaggactcgaacctgcaatacccggttcgtagccggggtgtttatccaattagcatataagtccataaataagtgccggctaccgggatcgaaccggtacgatgtttccatcgcaggattttaagtcctgtgcgtctgcctattccgccaagccggcaaagcgaacaacgggattcgaacccgcgacctctaccatggcaaggtagcgttctaccaactgaactatattcgcatgatgccgactaaaggactcgaaccttcgaccctcgctttacaagagcgatgctctaccaactgagctaagtcggcgacataatataaatcaccggttgacggaatatttattatttgtgggtcattacccaatgggtcgtcaggggctcgaaccctggacccatggattaaaagtccactgctctaccaactgagctaacgacccaatggacgttacagggatcgaacctgtgaccccctgcttgtaaggcaggtgctctcccagctgagctaaacgtccaatacgcatcgcgacttcctatcctcgcaggaagcgatcctccaactactttcggcgttactgagcttaacttctgtgttcggtatgggaacaggtgtgacctcagtgccatcgtcacgacacgactaatatttaaattagcattacgagattaattatctcaaaactgaatcataatgtcaatagttaattaacagtttaaaagcccgatggacttagattaattttcttgtctggcgggcttttttgcgttctgagagcctagtatgtttttagagtggtatgattgatccaactaagaattgtacggagctgtcagagcgtgttttcgatagcatttagacaaattcttctacatcaggtacgtcccatgaccactcatgctcaaccgcatgccaatttccagttgcagcagaaggaccaattttagttgctagttcgatccaagtcttaacgtcgaaaagagttggccgaaacattgccttagcagttgcctcggtgtaatcttcccaaactagttcgttctcttctagcaagggttcaacaatttctcggtgcaaattaatgtaagcttgcttagaattaaatccgttagccacaagttcgttaaactgtcctacatataaaatacgttcatcttctgtttctgatttcaagaaactgttcagtcgttcaatccagtgggtggtctctgtcatattaggttcctcttatatttgttagtttaaacttaattatacaataaaagtgcaaataaaaaagttccaaacttcaatttataaaggcaatcagatggcaatcaacgagtcgaactaattcaaaaaaacgagtttaaaacagcctatcgagtagttaactttagctattcgataggctgttttttgtgttatatttaattaatcggatatgaatttattatcttatgggcacggatagcattgtaggtcgacaaattttgcgccatatttgcgccaaaaaacgtcttaagcactggtgtataagcattcttggttgtcgataagatatttctctagtcgacgcgagtagacgccggttgcctcgaagccgacctccgcaccaccataggattggataattgactttaaactttgaaacccaatggcatcgatagtgatatcaccgtcgtaagttgtttttccatctactgctacagataactttgtggatgcctttgaaacatccaaaccaataattgtacgcatgatactctacctttcttgaagctcttcacgttgattttaatatccaagttttcaaaacacggtttctagaaccaaactactttgagcgaatttgctaaaaccagtgaagcagccaatttaacatgcgtcctcgatgggccaaaaagagctacggcttttgcttcactaccactataaagtaatagaggcgtacatgaacttcgtcgagtttcacgtacgcctctaagcttaatagttttcacatattcttaaatcgaatcaagtgtttctaaaaatgcaagatccataaacgattgatatttgaatcgaccttgggactgtagctcagctggttagagcgcacccctgataagggtgaggtcggaggttcgagtcctctcagtcccatatggggaattagctcagctgggagagcacctgctttgcaagcagggggtcatcggttcgatcccgatattctccattacacccttcgggttgtaagattagatctttgaaaactgaatcataattgtaaatttttaaattcatttaatattgttaacacaatataaattgagccgaaaaaatacaccgcgtaattttttgagtcctggacccacggattaagagtccgttgctctaccaactgagctatctgcccatatttctatgtcgttgcctcaacaacaaaatatatattaccagaataaaatgggttgcgcaagtgttttgtttaaaatgttttggttatcggtttgtagccgattgatgaaggcgatggtaaacgagctgcttatctaactatgggaataattattgcaaaaaagaaaaccactagatcaaatgacctagtggtttatgggatgggcagacaggggctcgaacgatatgcatagcgacgtcctatcctcgcaggaagcgatcctccaactactttcggcgctactgagcttaacttctgtgttcggtatgggaacaggtgtggcctcagtgccatcatcactacacgtttatgttgagaaattattaggtctctcaaaactgaatcataatttgtaaatcaaacttcgtttgagccttacaccacgttttcaacttggttaagtcctcgaaccattagtactagtccgctccatgcgtcactcgttagtaaaacatcttcgccgaaggtgttttttattttcgagagtccctgacattagggacataggaagtgttgacaattaggttagtcttccgtaaaataatgtcttgtaagttagaaataacgcgtgtcgtgatgatggcattgaggtcacacctgttcccataccgaacacagaagttaagctcaatagcgccgaaagtagttggaggatcgcttcctgcgaggataggacgtcgcgatgcatatattgatcgaacctgtgaccccctgcttgtaaggcaggtgctctcccagctgagctaaacgtccatgtgcatcgcgacgtcctatcctcgcaggaagcgatcctccaactactttcggcgctattgagcttaacttctgtgttcggtatgggaacaggtgtggcctcaatgccatcgtcacgacacggtatttaattgagaaatgttattacaacccgaaggttgtaatggagaatatcgggatcgaaccgatgaccccctgcttgcaaagcaggtgctctcccagctgagctaattccccattaaatgggactgagaggactcgaacctccgacctcacccttatcaggggtgcgctctaaccagctgagctacagtcccatgagattcgactctcttgtcttgttgccgactgggggattcgaaccctcgacctacggtttacgataccgttgctctaccaactgagctaagtcggcataactccgaatgtcgggctcgaaccgacgacaacacgattaacagtcgtgtgctctaccaactgagctaattcggaattcaagttgcatcgcgacgtcctatcctcgcaggaagcgatcctccaactactttcggcgctattgagcttaacttctgtgttcggtatgggaacaggtgtgacctcaatgccatcatcacgacacgttatttaattgagaaataaactcaaaaaattacgcggtgtattttttcggctcaatttatattgcgttaacaatattaaatgaatttaaaaatttacaattatgattcagttttcaaagatctaa

SEQ ID NO: 32 - skipped
